United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 8

SEQ ID NO: 262 - DNA, 276465 bp, Homo sapiens
tgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccactcggattgttcctttcttgctcatcctcccccatcgcaccttagaaagtgtgctaggcttcaggagactttcagagaacccactgggcccctccaagacggatgcatggccacaagagcctgttgtgtgccaaatgaaggttgcatccatggtcgcagcagtctgggtagtagagaaggacgcaaccagtcgaatatatcaaagccccaaatcagtccaagaaaacaaatttgaattttgtcttgggagtcttagggtggagacgcagagctattccctaaccctgagagtgaaattgattctcagtggaagccatagcattgcccactagaaaactttaatttttttttctttttttttgtagagatggggttttgccatgttgcccaggctggtcttgaacccctggcctcaagtgatcctcctgcctcggcctcccaaagtgctgggattataggcgtgagccaccatgcctggcctagaaaactgtagaaaaatgtctccatctgttggaaatgtatccactcatttgctgttatcaatgtcgatgtaaacatggcccagcctgaaagccaagggattgatttaattaattaattaatacttcccgaccatggagcagctgctgcctcagagatgggggatcagtcccatcagccccgctgaattagctgattcttgtcaccctctggatcaagaatcatggaaagaatggggtgggtggagaggaggagttaaaaaggaaaaagaaagaatcaaatgtgaaaggagatttttaaaaaccagacacagcagaggccatctaagtctaacatactcattccccccaaacagtatctctgtgagccaccctggccctctccctggtctcgccccagaaggaggccagtgcccccatcccagctttccatccctgagtccttcccccggaccagggcttgatttgtggataggagttgacggtttgctcaagaaggtgcattttcccactttggaaaacactgagtgtggaatgacgagctaggcctggccctgagaacaagtgttggccgcaaccagcagggaccactccggttcccacttggagaagctttggtctttccccagctctagaatggctttgggaagacgccggcgtggcctcaccaggccgccgcggctgtggttgctgtgcctgcctggctcaaatcccccactgcagccttctctgtgttttcaaactgcacgtgcgtggcacagtagagtgctacttttatttccgttttaaattaggtttttgtttttttttttttttgagatggtatgtcgctctgtcaccaggctggagtgcagtggcgcaatctcagctcactgcaacttctgactccctggttcaagtgactctcctgcctcagcctcccgagtagctgggattacaggcaagcgccaccacacccagctaattttttgcatttttagtagagacggagtttcaccatgttagctaggatggtcttgatctcctgacctcgtgatccgcccacctcagcctcccaaagtgctgggattacaggcgtgagccaccgcacctggcctaaattagttttaatactgaacttccaaccaggcagctatggaattcccaaagcaccatcaggtttctcagcacccagctccaggcccacagcccaactcctgggctgcctggggcatctctgaggccatgggccatcaggttcacaaagacatgcacgtggggggacctccatccccactggcctgaaaacatgctcctttccctcctgcctgacccaacccacccagaagcagtgatttaagggattgattgttttcgggaagcccctattaaaatcccctctgtcacagaagagcccggaaggacattttcagaagctcccttggtgctccctcctggtacacagctgcgtgttcgtagacgggcagctacgccgagacgggcgcctggtgagagcctggatgtgcccacggacaagggccaggccataaatcagggcagggctccaacctgcacctgcagacactgccccggggccaggcatggcctctgcagcagttggtcccagaggtcaggatttgagcagtaaataccagcttcccttattctcagccctgcttctaactgaggaccaactgggaaaagccagatacccacaaccaatctcctgggacgccctgcttctgagcgcctccagcttcccactccagcagcctccagccagagcatccctggagcctccttttctccaccgtgaagctcacccacccccccgtccgaacgcaggtaagagcagtgagccccttgctggagaaagctctggataagcagcctctgctcacactcattttagtacagtcttagccttagcggccatagtgaagtcccatagactgggggcttaaatagtaggacttgatttctcacagttctagagcccagaagtctaagatcatggggccagcacactcggttcctggtgagggttctctccctggtttactattgatcgtcttctccctctgtctgcacgtggcagagtgagaaggagcgagagggagcaagagcatgagaagagacttctctgatgtttcttcttacaaggcacaaatcccatcatgggggacacacacttatgacctcttctaaccctaatcacttcccagatgctccatctctagccatcacaccggggcttagggcttcaacagtgaatttggggaaacataacattcagtctgtcacaggtggtctttgtttattttcacactggcattccagggagaaaataggtgttcttttatttcagagaagagttgctgaggggcctctggggactctgaggccagggaaggagggaggcagaggaggcggacagagcctcaggagactgacctccctgctggggctccccaggggtccagacaggcagacgggcagccttccagggctgctcccgaaggcctggcttcccctctgcaaaccacaagctccaaaatggtcattctccatctgaactcagccagtgacactatacagatagggaatctgaagcccagagaaggcaaggaagttgtccaaaaccacgcaggaaacagtcacagtcctgcattccttccgcccttttttcctgctgtgttttcttcaatgataaactcacaagtcctggcctcagggccccgggagtagtagccagctgcctttctccacagagctgggctgggggtgtctagcatggtcccttggggtgctcgtcctcacccgtgtgggtgccccaagcacagtctccagccaacatggagcctggctcagtggacatgggcgtcaagatccaggctctgagaaaaccacagagctatgggtccttccaattcctatccagccagggatcctttctagaaattctcttttttttttccaactttttttattttatttttaattattatactttaagttctagggtacatgtgcacaacgtgcaggtttgttacataggtatacatgtgccatgttggtgtgctgcacccattaacttgtcatttacgttaggtatatctcctaatgctctcctttccccagccccccaccccacgacaggccccggtgtgtgatgttccccaccctttgcccacgtgttctcattgttcagttcccacctatgagtgagaacatgcggtgtttggttttctgtccttgcaatattttgctcagaatgatggtttccagctgcatccatgtccctacaaaggacatgaactagaaatcctcactgatcggcttaccggcccccgatgcacagccataaggtagctctgtgttgattcccagagtgggatcggaagtggccacaagttcaaggagacacgtaaacacacagaagagccgggtcagccacccgactctgtaacctccccccgggagaaagtgcgtgccacacgctcagcatgggcctggcccaccgtgggtgtgccagcaatgaacacactgccgccttgcccaccccaagtaaagggaaccccagaaagccgcaatctttgtctgttttgttcactgcagaagcctcaacacatagaaccatgttcacgatcagagggaaggggagggtcccacctgggtcacatcacggtctggaggtctgcaagaaacaggtggatgctgggggtgaccagagccgccgtgtctgcggttccctcggtgggaatgtgctctgtgcgtccgccgggctggctcagaagctcacggaagccctttcaacactgtgcagagccaggtggacaataaaatgtttgggaaagaggagaaccgttttcaaaatgatatgaatatatttaaatccattaaaatgtttcatttgacttacattcgtttatcttcaacctcttcatgagctcagtgagtcgagttctgttagcttccatgtgtaaaccacaagcataggtacggtagtataaaaacctaaacgtcaggaatggaacagggcccgaaagaccgtcatgaagccatctgaatgggagtcctttccgagttctccatgtattcctagtcatttacagttgcccacaacttatttcaactccttttttttagcagattgcccctactgaatttttccaaatcactcaacttcgtttttctaggaatgacaccattttgtttttacactcactgtccagagtttaagtgggattgaatccaatttggctccgtggataccactgtgctccacccagcacccctctcagagcagggtgggactctgcaggacaggacactgtggcccagctcctgagcatgtgggctgagctgttcacagctgggcccttggctagcctaccggacctgcaggggacctgcctggttgaaggtcacagaccctcccaggagcgccacctggccaaggaccgtgtgacttgggataccaatacccagtccctctgtctcaatttaggacaatctcaaaggttatcccagccacagaggcttcagctcaagggcgacgtcctgggggacaggctgaggccgacaggctcagcctcagccccccggtgcgtctccctagggcactaccagtgaacctgcatgaggcagcggtccctcagagagtctgtttctagggatcctaatcgaacctatgactggagtgagaagtacaactacaaaggaaatgaaacaaaacaggtgtgggcgcaaacccaacagacgctcggcgagcccagcggcactcacctctgggggatgcaggcttccacctggaggcgaagaccagaccggccgaccaccctgagtgtgggcagtccatgtgctacacagagggatggagccgcagcagacagcctgcaccctgctttcataatgtcagtcagggaactgctaccacccagactagacacggcccacctggaacccctctgttgacctgcaggggattcgcttgggggcagctcagctcctcccatgcctctgccatggaccccaggtactgcctgctggcctggtgggacctttgctccaaagccgagtgactaatgcagaagcgtggaggacccactgccagcatcctctgaacaaagaagctgctccctccctcccagccttggccctagcatgggaagttcctaagttggaggagtctggagctccctggctttgactttggttatcataactaatggctttccagacagaggccagccccacccatgagctggttattcgtctaatgtggtttgtgtcagcctggtgggaacgtgtgctggcagcttcagcagcctccacagtcagttctagggttcacaggacctgcttggtgaggaagatggtggcacgaggcagaaacagcaacgtctttgtggttgtgaggcctgagaccacatgttcctatcagctgtgtaacatcgggcaggtcccttcatttctctgagccccaactttctcatccttaaaatagaacaagtacctgcctctttagggtgttgtacaaattaaacattgtctgataaagtcctttgttaacctgtgtgctacatgagtgtggggtatgaccactgtaagtttcattactgttagggttaggaaggaactacatcagtcccttgtaggaattacttttgtagccgtggacgtgggttaacagagccacgcgcttgtcttcagaacatgtacgggtctcaaccctgaggctgtgcccttgtaggaaggctggccttcatcacagggccccccagcccgggaggacccaggaagctatttttgagagacttgggtctgcaggtctgactccaggacaagtcgaggttaacaaagttagaatgagaagcagcttcccagagggcagctgaggcctcgcaggaggcctgtgtcagaacgtccactttaattaaaatatttgcctgcctgtagcctgatttcttttacacatggtctaatttcttatagtggacctaagtgactctcacacaccaccctgcaaggcaaggcaagagtttttaatttgaagtttcgaccattagggaaattcatggatgggcttcagggggtctatgagtccctgaaattgcaagccaaagttgtgtgtccctgcacgtctaataccatcctggtggcaccaagaattgccacctggaaacacaagccattcatgccgaagggctttgggcctcatggactaaactcccttacaaatctcactcaatgagacagcttctggcctggaagagtcatcgaggcacctccagacgatgtgagaatctcactgagttttctttctctttctctagaaaagggctattaacaaatttgagacgttgatagaagactttcatactcagccaagtagcagccatgaacctcagcccaaggagaatgcgttgactgcattttcacctttgttactactggagtctcagaacatccttgggaaggacatgaggcaagtaacataactattccaatttcactgataaggaaggtgcacaaaatttaaatgatttgcccagaggatgtagctggtttttacttcaaccagctctaaaaccctaattcccagccaaaggcttttccattggaaggaaaagggaaaatttttcatttcccaaattagttatcccagtagatcaagagacccttcaggagacctaaagtcaacttgtgaagattcacagtgttaatttctgcttgtctgaacttccacagtgatgaatggagccacagccagtcgtgctaagctgattaaatacgcactttgctagccacccaccatgatgccaactctacccgctttttttagtattcctgtcgtgtggagtccactcccacatggaatcaggcttgacccctgtgactacagaatactgcagaggtgacagtgcgtgaatgccaaggcttggtcattaacggtactgcagcttctgtctttctctcctggccagatggctccttctgtgggaagttggccaccatgttgcaaggatgttcaagcagctccacggagaggtccatgttgagaggaactgaggcctcccaccagcagccagtgcaattctccagccatgtaggggcgccaccatggcagtaaatcctccatcctctgtcagtcccacccatgactatggccacagctgacatctgattgcaacctcaagagagactctcagacagaattcttggccaaggcactctcagattccaaatctaaaggaactgtgagcaatcgtaaatgactgttgttttaagccattaagttttggagtgatttgtcacacagcattcgataactaatacaactcacaaccacccccaaaaactctgccagcacccgcatcagtgcctctgcaggacacccctttctgtaaatatgggataggctggggcataagtgacccttgagagtgggcgcagactctgaaccgtctgacataagtcactggttcctagtcccaagcatcaaatccctgctacattgggaagggttcacaaatggcaggaagagaaatggtagaaaaattccttcaggcactaactggagtccaccctagcactaccacccctctttcttagaagtggaacccccagtttttaactgggcctatggtcatccagaataaaaactgttccggcctcttcgctgagcctaacttctggccactgggatgtatgtgacatgccacatggcagctgccaagacacttcctcaaaagacagcagggaagcatccttggtctcatcttctccctcctccctctgggttcctgaagacccaacagagccttggtccacaaggtggaagctccgagccaagggtgacagagagcaagcagatgctgcctgggctcctggcaggtgggcacactataccagccctggtgtccctcatcagaacgctctatcttctttatcttggccttttctgtgttttgcagtcaaatttgatgccagctagcacactgcactgtgagggctgaattacacaggccagcggcttgatcctagggcccagagcctctcactgcaaaacgctgtgtagttgccagttattcaggacaactaagcatttgcattggacacaaggcagatgactatgcatccattcactccaaagatcacaatagccacattaataataataattaacatttatgaaaagcctgctctatatcaagcactgtgctagcattctgcgtggataaacacatttaatctctgcacaattaacacatttcaatctacaactaccccatgaggttgggttaccattatttacgtttggcggacaggaaacaaaaggaacagagagacgccgtcactggccccagataacaaagccagtcagtgctcgggagggagtcctgccaccaccagctccctctccaaagggaggcccttaccaggtcccaaacccgagtctacccacgtttgggcacagcagatgaactgtgtgacctccatgtgtttgagtaataggcttggccttggcaggttgatttgtttgagctgaaagagaacaaagaaaggccttctgcccaggtgcctggagaggtgagcaggggtcgctggtctgcgagaggctctccagcaggagctgaagaactcgttttctgggagacaaagggagggctggcttggcctgggaggctgggggcactctctgtggcccagagggagcgccatgcagtcggtccagagaagctctgagatctggggccacctgggcagcccagggtctgcagcagcctcctgccagtcaccacggctggaacctgggggctgtggagggctccgaggtggaggatggtcccatgtgtctgggtgagcagcagacaccacgggagcagctgtttgacctgagccagtcacacaaaggagtcaatttccagctgtgtgggagcctgagtccaggcacacttggcaaggagcccttggtggccagcgtcctagcctgagatggcagggggcaaagctggtgaaacgtaggtcgtcagtggtggtgagacccactctcacccagaggccggcaaggtcagtgagcaagattatccactgtagttcgttcaatcggatttcactgccagtattccctgtggagaagagtggtataatcaacataatttttttttttttttgagacggagtctcgctctgttgcccaggctggagtgcagtggtgcaatcttggctcactgtgacctccacctcctgggttcaagtgatcctcctgcctcagcctcccgagtagctggaactacagatgtgcgccaccacacctggctaatttttatatttttatagagacgggctttcaccatgttggccaggctggtctcgaactcctgacctcaagtgatcctcccgcctcggcctcccaaagtgctgggattacaggcgtgagccaccaagcccagctcataagtatataaatatgatgaattcattgaccagtagagaagcaggacccatgaatgtctccaaattctgttttcaactgc

SEQ ID NO: 263 - DNA, 160234 bp, Homo sapiens
tcaagatttagaaattcagacagcctgcctgccccctccaccaagaagaaccttgacagctgcctagtaatgaaaatccaccctaaagggatgtgactcctctttcaggaaatgaagcgtcgccatatagctaagccattctccatggagaagttactctaccagattgcacaagcagaagcaaaaaaagaaaacggtcccactctcagtaccatctcagccctcctggatgagctcaggtaacagacccccagagcccacgccagagagctggacccggctgcccttcgggggctcaccccccgagcaggcctcacttcctgacaggagggtgtgtctgcagggaggccggtgtggggtgcgtgtgtcccctctgctggtgagcatggcaggccgtcactaaaggtgcgggccgtctcccgtgtctggcagggatacagagctgcggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtgagcccgcctggccctgccggcgccctcgcatgtagtgcttggcctgagagctccggggttgcccccagaagagggagggcgctctctgcccaggagacctgctgtgctcccatctctggagccggctgtgggacctcggcggagcttctggccgccggaggtggctgcctcacccacagtgaccaggccacacagaggctgtccctctgttctgcccacgcgtggccctccctcggtcctgcagtgcgtccttcctccctggggagcaggtggcctccctctccgccctactttgtcactccagcccccacgcactctgctcttacccattctttctgaggcagtgaggggcgggtttccagtactgggcagcgtctgccattccctgtggcctgtgcctggtgcacctgggcccatggcctctgccctttggctctgttcttggtttcctggtcctgctcagctacatgatctgcctcagcccccgaggacttcagaatctatccttggtgaaagctgatgttcctcctgtcccatctgggatcagagatgcttttctggcacagccactccaggccacagcaggctgcattcctcttgccttctcgactgtgccctgctggcttcctcgtgcccacctgcctgcctcagctttggggttaataccaaacacctcctccccctgctcacccctgttccagcccagaggtgggctcagaaaagcccttccatggcgactggatggctgtggcctcgccatgcttcttccagtctccccttgacctctcaccagagagctgccctgacacactctgggtagggacgcccagctggcactgcagatggctccacagcactacacaccttagcctggaacagagagcatgcccgaagggcctgacctgcctccccgggcctcgtccctttccacagtgcctcacatctccagtacagaagcctagcttaggaggtgcccaccccatatgctgtgtggtgcctgtgtcccacaggtgcccccttcggctgcacactcgctgagaggccagtgcctctgcgtccctctgcttgtccatggtgggccaggactgagacccgggtcgactctccttggcctcccagtgtgactgtgtcatgccgtctcaccccgagtcctggcgtgccctgtagaagagggaggacacagcctctcccggatgagtcagatcgtcagatcgtcagatcagggctttgtaacatttgaaagagctaaaaactcggtgtgtcctcatctcctccttacctaaggacgcaaatcacattgtatcagataggcccaccctcatggcctcatttgagctgatttacctctttagaggccctacccccaactgcagtcacagctgagatcctggaggttcaacgtttgcatttgatgggggacaaatgcagtccgtgaccgccctgcctcctgtcctgtagatttccttctgtctggttttttcccccagacttctcaaaatgtattacctagagccatttggttcttaaaagaaaatgatgataagcattttcccagatcttcaaagtatcttataaacatcactgataaaagctgcatagcttggtgtgctctctctctgttcttttttttttttgtttgtttgagacagtcttgctctgttgcctaggatggaatgcgtgctgtgatcctgtctcactgtagcctcaacctcctggtcatcctcccacctcagcctcctgagtagctgggacagcaggtgtaccaccacgcctggttaactttttttttttttgtggtagagatggggttttgctgttacccataggctgcctacttcagcctcccagagccccaggattataggcatgggccactgcgcccagctgtccatcctcttgctggaacacgctattcatttccatgcactgagggctgtatggtagttacacctgggggtgaagctggtctgtccctgtgaggtggcaccaggtggcctcattttcaagccatccttcagaaacttcagagttgtcacctggcatttcctgtcagcctgaaagttattttaagaagaatgtattgtgaggccgggcatggtaggccaatcccagtgcttcgggaggcaatggtgggcagatcactcgaggccaggagtgcgagaccagcctgggtgacagagggagactaatctctacaaaaaatacaaaaaattaactgggtgtggtggcgggggtatcacttgagcccagaagttcaaggctacagtgagccatgatcacaccactgtactccagcctgggtgacagagtgacaacctgtctctttaaaaaaaaaaaacaaaaacaaaaaccaggcacggtggcttatgcttgtaatcccagcactttgggaggctgaggcgggccaatcacagcctggccaacatggtgaaacaccatctctactaaaaatagaaaaaattagccgtgcatgatgttgagcgcctgtagtcccagctactcgggaggtggaggttgcagtgagccgagatcgcgccatcgcccaggtgacagtgcgagactccatctcaaaaaaaaaaaaaaaacccgttataaatccataggcaaaaattggggtttgacttatacgttgacagtttgcattgcttggattactaatacatttgtgaatttaaatttgatgtgtttcctgttcttcctgtccttggccccgtgtctctccaaggtcttgtttctgtcagtaggtggcattcccacactcctacaacgtgttctctgttccttgcttagaaacaccgcagacgaaaacaagtccttcccctcaagctttctgagaaaggcctatgactcttctcctcttgagtgttaagactgaatttttccttattttcaaactcagaattagaataggacttggagtcagcgtgaagtatgggagccctccggcagaagccaggtggctgtttcctttcatccggcccctctcaaccctagacaggcccccagtgagggtctctgtcccagcactctcctgtggcctcaggcagcagggtgtccactggcgggacagctgtgggctttgtggacagcccgcccaagggggccggggctggtgggtgaggtcatcggcgtcacagcggtcaggaatctgtgatgttgagggttttgggggagtttgcatggggtcgttggacgccgcttgctctgttgactgtgagccactcatggaccaccatgagaacctgttttgctgctggaaagtcaagggtgcgttccccgggtggccgcctaagttggagtcctccatgttccacatctattccagcactagggtggtttcaaacacaggatctcaggagccctcagaactcaagagatgagaaatacgcacccctcactgtctttagcagcctggtggtgactgaacctctcccaggaaactccagcagaaatctggaggggacttgagggccactcccaggtctaactcagaggtggtcagttactcaccttcctagttgaagaccatgttccaggtgtttggtcagttttcgttttagtccatttccagcatttccagtcctcaaagcccttggcccgggtggtgggtgctggggctactctggcgcgggcagtgggtgtggtggctgcccggccgggcgtgctcctaccttaccctcccagggcgctgtggagctgcctcctgaccttcgggtgtcctgctcttgcttgcaggtggtacaagagaacgaaaacgtcgtgttctgtctggagtgtgctctgcgccacgtggagaaacagaagtcctgccgagggctgaagttgatgtaccgctacgatgaggtcagtccctgcccgcggggtagggcagggcggcagcgtggcgccttccctgctcccggctggatgtaggcactccggcctggcagttctgtgcctggcgggtagtcagggctctgcaggcctgaggtgccctgttcttaggccctaaacccattcaggccccatgttaggatcccagggggagcggggttcctgcacgggcatttggatttgagcaatgggctcttaacagggctgaggctcttcctgcagccgcccccccggctttcccaagggctgcaccactgtggtttagacccagacccttttttgtgacctgtcccaggcacagtgggatggttggcagtggcctctccaatctgcactaacttgacaccagccccttcaggctgagagagctggaagtgtctgcggacactggggcaggacgggccccatgatgtgaaatcccggtgccttcctgcaggtgccacgctcttctggagaggggggtcataacaacacacagcctgtgcagctgggggccgctctgagtggcggaactcctggcagcagtgcctctcccctgctctgcccgccttccccacgtgtgcttcccacagactctgatgaggctggttacgaggaaggtcgccacattgtggtcattgcacatttgaggccactgagtggggtgggtgctgcgggtatgactgtgaggggcctggtgtgtctgggggcccaggcagtggggccaagtggtgggtctcactggataagccttgagctaaatgatcggagagctggaagaagaactctttgcatctgttttgtttcaaagagcatgctgggtgaaggcagtaagcacctgctgtgtccctccttcaccttagcagcaaatgtccaggcacagttgcaaataacgaagcctttgcggctgagcacgagcatggctctggcaccttgtgggggtgcaggcggcggcacggggaggcttcctctggctgcctggaaagcgctctgtgaatcatgggttgtacctctcaccagcagcctgtttctgtagtcggatgtgtgacgtgaccagatcctgggaaaagaatggcattcaggggctgtctgagacctaatggttggttttgatgaattaggagcaaaggtatttggaaactgcatactctgtagtggctgagtagttcagtaagcatgtctgtgcctctgtcccctgttgagctgtgcatttttttgtttttaagacggagtctcgctctgtcgccaggctggagtgcagtggcgtgatctcggcccactgcaagctccgcctcccaggttcacgccattctcctgcttcagtttctggagtagctgggattacaggtgcccgccactacgcacccggctaatttttctttttagtagagacagggttttaccatgttggtcaggctggtctcaaactcctgacctcaggtgatcagcttgcttcagcctcccaaagtgctgggattacaggcgtgagccaccacacctggcccattcttttaaataggaaatttctaccttgtaaacagagaccattgcaaaatcttctcaacctcccagtgtgcccagtacacaaatcacccatgtctgggcctgctgacccgggacagtctgctttaaacacccacccttgctggggtggggggtgcacctagattgcaaatccctgaattcatggcttgggttctcatggatggtgaagctctctggggagtttggagccatttgtgtctctggcccttgcaggctggctgagcagggtgttgggccgcctgccgccgagcctagtgtgagagcactggtctggggcaggtgctgcccacctgtcgagctgcacgcaggggagggaacggtgtcctcctgtaaccgcacactgccgctcctcctcacttgtccttatggtaaggtagcagtagccgcctaaatgggttttatggcagctcatccacttatcctttatcagtgtttatcatcagtacctcaagcagccatgactatggtgttattacagatacgtgtggaccgccccgccttccgaaggcacctttaacttgtgatgggagccagctgtcactttctcaccctcatcttgagggcttttcagaggactagagatcaggccctcagatgtttcattccatggctggcttcctctcctgccagggtcagcatggttcccagccacccgtggcccagagagatgctcataagatgcacgtttgctactcctccccatgttgtttttaaaaatgatatgattataggatgtactgtgtgaaagttacaaacacagtttttggtgccgacagataaatgattctcttgagtgaattacaaggatatgtataggttgagaagtgtttgcatttacttgcatggccaggttcagtggccggtagctaaagtgagtcaagtagcttgggtatttgtgtcaccatccaggatgtaacaaagcccctgggtctctttgctgagtgctccgtggtagaggcagtgctctgggctcccctgccagccctgcccttatgagcaggcaaagcatggtggaccagggtgttgatgaggatgaaacggccatgcctgctatgtggcatcaggaggagctgggaaagggagactcactgcatctgagcctctcggggttattttaaaacctgttggttggtgtggtgaaggggaccgctgccctctgccctaaacttgcccctgcatggctctcagggacagagctcttgttaatacggtatgttaactgtgtcttcctttcacccccaaacaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtggaagatgactgaatggaatgagctctttcttttctcgtccacgggcagggggcagaggattccccccagccagggagcagagccaccccccacactgcagtcctgctcccacctgccactgggtccccttcagcctaacctaatggtttccatgtggcctgcggccgtccccctcatttcccatcgagctgcgcccccctgctgagcttgctttcatgatgagacgacactgggtgcattcagggtggtatggctgcagacagacagaccccctcatcccggcggggagtctgtcccctctctctcattgggctggaggagtgatggcaggaacacatctccaggggaccagtttcttttcataaagaatggaggattgctttgggcttgtttctgttcttttgggcccaggagtgtgaaaaagtaggggttggactggctggctactggactaatgatacttacttacttctgtaatgatcaacggaaaaccccaagctttgccagagtggtttggctacagtcagctcttctacaggaagtggcattttccacttgtgaaacggtaggtcattccctgcctcatgcagaactcagccctgtggagcctccaccacctggcccaggccctgcccacatgcaacctcccggggtggccctcaatgacctgcacgtcccttcactctaaggaaccctgagttacagtggccttaaggacatgtgtatttagaagcctttgtgtacaaactagctctgtgcgctctcagtttaccgtcctcacactttattgttagctgttctttaagtttctcacacattattggcaattatgtaaaaatcaagaacctctataaaacaacctggctttccaggtggaattccgcatacagccaaaactggattccagtgtggccagacaacgcccatgtcccaatttaagagtcgctgtcctcaccaccatccggagtggcctctctgtcagtgtgtgatgtggccagggcagtgtccacctgaacttcctcctcatcggactgaacaacgggggactccccaccctcactgatgtcccgggtggccgagtcggtgcaggtggaggaagaagaaggtggcttggctcttaattctgagggatttggaacctggagggtaatctcattctgacaggtactggattcaggccctgcaaaataacgtagggaagaaaaagccctgtcataaaaatattgtgaatcagaattgccgccaacagctgtggaatgtgcccgtcatgaaaggggggtgtggtttttgttccaggcacctggggcctgcagaacttgggaactgccctggaagacactgagctgagcgatgccagaggcagcctcaggccctgcggtgacccttctgtcccctaaggagtcagccacatgtgacacagatcaagtgctcctaaggctgtaatacgcgtgtaatagaggcccaaaggcaagtgctgcctatctttgaggagcagtccttgtaaccttgataatctagatttcttttttttttttttaccctttgcagtaattcagagacaccactgctgagaaagtcggaattactgaccttcagcagttctccaattttatggaactaaataggctcttcaaggaatcaaaattctatatgcaggtgtcactgtttctaaatcttcccctgactctgggtgagggttcacgctggtctccagtattctggccttctcaggatgagggcaaatgcacccaagctccttctcttccccaggatgacaccgttctgacagattgccaggagaagcgggtgagaagtttagaggaagctgaaaccgtggtaatggtagaaccttctacagatggctgaggtgctgctgggacgactgagctttgccttgacccagcccaaagaactggtctgaaatttgaaacgcaccaagcccaggtacaggtctggcacctcagcccatatttgctgcatgaatgtgaaacaaaattttgtgaagggatgaaaggaactgaagtgcaactaagtttacaacacaggccaagagctgaacacacaccatggctttgcccatggcaggcacgcccctaaatgcctgtcgcacgaagagggaagagtttcccgtgagccccgcaggagagtccgcacctccctgcaaacgccagtccttaaccacaaggagcagactcaaatggatttctgggtggtaaaggagggaaaacaaacaagaaagctctcaactcaccaaagttaccggagtggagcatgtcaaatctttgagaagaattcatgacggaaccacaccactgttgcagctgccacacagccgtgtggaaccgtggggttagggagccaggagctggctgtgagcttgggggtttatgcgtaagtgactggcagatggttctcacgtctcacctttggaggggagtggcatcgatactgccctggttcagctaatgcaagtttgtcaaccctacctaaggcgggggacagcacagtgttctcttctcctccagagttcaggaagacgtccagggcctcctggtccgatatgtccatcaggtccatctgctccagcatgtccacgttcacttccatggatgacatgctgcctatgggctctgcggatagatcaacacgagaaaggacacgctgtctttaatattactttaaaaggtgaacttccattggcattaggctaactacattgcatttcctaagcttccttcaaaatggaatttgaagcaacgtattagtagatgacatatgccagtctggcactttaaatgcatcctaaatcacccttggcaactattattaccttttacacttccttaatctgttcatccccagccctttgggacgctgaagactaatctctgcattaagtgagtcccggctgttttgagtaggacgctcagcctgtctcaaagaggccaacattcctgcagcaacagttagcgaccttcctccctgccagccacagctctgcttcctgcctacaggtgccctgaaccttcccggcaggcgcactcctctaattgcaagtggagtttccactggccttggaacatttctcgggcctaacggcagaaggggtttgacctacatctgtaagctgtaagagctccctgcagtggaagcacagactaggagaaaacaaaacccagcccaccagcagacggcgaccccatgaaacagcacatgcctagttggcctctgcccgggcactgagcacgggatgccccacaggtctttactcataggcaaacgacctctatggtccagaaaaccacaagccacgtaagttatcctagccatggggaatgcctggcagaagcaaatgcaaattatttctggaaggactctcccttaaccttggtttaaacaaagtcaatcccaacccaatctggcatttgtaacacacatgaaatgagccactccgagtgaagggcagcagaaacaaacatcatcctcgctgaagaatatgagatggctgttcatacaccacagtcacaggaaaggtgaagtcaaaaacaaggtgtcaaaaataaggacagacatttgaaagccaaataatgactaggtagaagagactgaaatctcaaactcggggcacagtcacagcccaatagaaaattaataaactagaaggcaggatgagtaaatctgccataatgcagcatagaagaacaaagaaaggaaatacaagagagcataaaaggtacgaaagatgcagaagcgtagcatctggtcacatttccccgaagccaagaaggggagataactctattcaaagaagctgatgagtttcccaaatcgatgaaagacctcaggacccagatttaaaaagcaaaacattccaagcaagatcaaagcaatcttcacctacaccaattgctttgaagttgaagaacatcaaaagacaaaggctctctaaaaggcagccagagagagagggcaggctaagaaagagaaggaaataattaggatgacaggcaactcatgaacaacaataataaaagccagaagactgcggagtaagttcaaagaggagagagaaatgtcatctctaaaatggtgtaacattaggtatcgtttaagatccaggagaaaagcagagaccaagaagaaacacgtcattatgagcctgctctcgctagaggcatagtgaaggaagggctgagtgcaagaaagcatgttaagcaaagagacgtgtgagtgtgtgagttaatgtaaaacctggaatggaacagtcataacgaggagtcaccaaggccaaattaccctcctgaacaaagacacgggggtggagaggagggtgcttagagccacagcgacgtgagattgcggcttcatctgggaggaaagtgagtctcattatcctcaggctcagaaaatcactaaagttcagcacttgaatgagaggtaagagtaattcctatttttagttggggaaaagtattatggtttagatgatcccatgcttggcggcatcaccctcgccaactgagccagcctgctctgcctcggacttggccgggggttgagcccagccgcacagggacagcagttcgctgggctggatcttcaaggctgagtggtcaggggaatttgaaggcacgctggtcaggcttgttctttttgggggcacgcttctgagggtttcctttctgacctacggaagcctttcgccaaggcctgtcttttagatcgtggcttctgacttcagttttgaaagtttgtctgtgccatcttcttgaaaagggcaggagagaaaaaactggactaagaagcataagaaaagctttcaggaaaattctgtagcaacaaataagatggtaatgggtgtgtcagtgatcacaggaaatgtcaatgagccaaacttgtcagttaagagattatacaactaaactaaaataaaatctagctaccttctgtttacaggagacaaatatggagacacagaaacatgcaaatgtttcttaaaaaatgaaaagatataatgaggaaacaaataattaagaagaaagctgatacagctgtattaatatcaaaatagattttaatgggaaacaaaagtaatattgggataaagagtagtacttaatgacttttaaatggttcaattcaccaggaagataatctaaaacttctatttttggttacgtttttaaagtaaaaatatggcagaatgacaatgaaaacataatatccataatcttgggggcatgtcactatacctatttgatgactgacatcagcagtcccaaagttagtaagagaaatcgaaatcccattctccaatcacaatgaaatttagttagaaattggtaactgctaggaaaactttcacacatctaattatttttaaaaaacatttataaacagttcacaaatcaaatatgaaatgctaatgataaaatttacccagaaattatgaatgtcaaaatttgtaggattcagctaaaatggtacccctgcaagaaatccatagctttgaatgccttactagagaggaacgctgaaaatcaagcctgaatattcaacttgggttagaaaaaaacaatagcccaaagaaagcgacactgaagagaagttaatgaaacagtagaaagaacaaagaagctggttctttaggggaaaaaagcttaaaaatggttatgttctgggtaagactcatcgtaaatagagatgaaaggaataaaaggcacatgaacaattttaaacatgcaaaagcaagcctaaccaggaacacagctaagggggagacgcacaccatggacaacgttatgctgacatatctgacaactaaagacaattccatggaaaacttgccaaaattaacgagaaatagtaaatctctataactatcagaaaaaaagaataggtaactcttcaaatagagtagtcactggtaacagcattggaggcaagttctactcaacactcaggaatgcatgagacacgtgcacttgcagaaagatccaataccactaagaggtccagtgtgtctccgtgcagaaacttactgcaattccgctcaaactgtagacaaggttcgtcaacaaacttgaaactgtaacacttataccaacggacaagaccccaagaagagtcatggcaactatgaagaaaataaatgcacacagatgtgcagagcaggtcaggaatggctccagcagactcaagcttcactagaaaacattttctcagctccagcactcctgacactttgtgccagatcgttcttggttgtggggtgtcctgggtagtgtggggtgtttaactgcatccctggcctctgcccactagatgccaatagcacacccttaccaccccaggcacgacaaccaaaatgggtctccagacattgccaaatgtccccttgggggcaaaagtgtccccagctgagaaccaacacttgatgactaagtagactacagtatggttttggctcagggacgggcggcagaagaatggagccgaaaagagaggcttgaagattcctgaatatacagaaactgccaaaggtgtcgtttcattccaacagattagcaaaaatttaaaaatctgatgctaccaagtgccggcgaagatgtaatcagaatgtgcatatgtggctgaggagactataaactggtgcaaatgttttggcaagaaatttgacagcatctagtgaaatgaaagacagccatgtcattgtgaccagtaattcctctcctagttatataccctaaagaaatggtttccaaagtgtggtcccctcagcatcacctggtaacttggttataatgcaaatcctcaggccccacctcacacctgcagtgggcccaggaatccatgtttgaacagccctccaggggactgtgggactgctcaagcctgagaacagctggtcttaaagcaactcttacgtatatgtacagagagagaaattataagaatgtccaaggccgggtgtggtggctcacgcctgtaatcccagcactctgggaggcccaggtgggaggatcactcgggccaaggagttcgagaccagcctgggccacacagtgagaccctgtctctccaaaaaaataaaaaattagcccggcatggtggtgcacacctgtcgtctcagctactcgggagtctgaggtgggagaaccacttgaacccaggagttccagactgcaatgagctatgaccacgccactgcactccagcctgggtgacagtgagactccatcctaaaacaaacaaaagtccatgccggcattgtttttattaaataagaaaactggaaacacccatcaatacatcaatgaataaattacatttattcaatggaaataaatatttaaggatggaaatcaaattagaggtgaatatatcagtatggatgattctcaaaatcatagcacttaggtgcactgttgcctgttaattctatcttttctaactttattgtaattttatcattagccccaaacctcgttctcttcccagggcactgggtccacgctggagcatcccagagctgatcaatccctctggaagcagggacacccctggctccataggattccattttgctgaactactggttcagaaacacaagagcctgacatctatgggaacacagagccagaaaacccaggcacagaccaggacatctccgaggtgatttattaataagtaactgcaggatatcctgacactcagcaataaaatcaaagcaataaaaatgcttttctaagaaaatggcagtcatgtcaggcagaagatcaaacctgggctagggccttacaaaacatctaattatatcctaacggcatggagaggcctgtggggcatgtggtggggcccaggccccctctgctgctcagccctcccggcaccgccttcagtcctcaagcctgagagcctctgtgcttggggggccacctggcctcagcaccatccaagtgggcacatatgtgccttcaccccttcctctgatgattctctggataaaactttccatggccttgtcttaattaagaaatgatgcttctgaaagtgaaattccaactgctatttctgatttagtggaatgagtccaaaacaccatgttcgctgtagagtttttaaaattttgattgattctcctaaattaatactaatccttggagatgaagattcctccctaagaaaggtgctgtggctcatcaggctgggaagtctgagccggctctgcacagacgtgcgatgagatgcccgattcccgtgtgtggctgtctctcagctctagctcaagagaaagctaaaaagcccagggccgccaattttcttcttcaaagctttcaaaaccatatattggcgacatgtgcctgatttttaccttaaaaaaatgagcccagcattttcttgaaacttaatctttgagatactcaaaaccacaaaaatttaaccacttcatatttccttgcaggtatttccagcaggtatctgctagacgcgttctctctgccagcccgctgacttgctagctgtggagcaactgcagtacgtgcccgtccctgtcaccaggggctggccatcaacagaagctgctccttccaagccggccacgcgtctactacttcatcatcctctcgggggtgcatccacggctctccctacaatgggagcttcctgagaggcactttcatttctctgtgcttcctctgggctcaccagcaagtgctaaactgaaggaagatagagttaaattgtttagcaatcagagtttctatgactgtccatcatcactgcatctcttctatgacatgagacattggtgcgatgtgtcattatgttcaaatgtgtgggtcggccagggtgtatctgtatggactgaatgtgtccccataaaatttgtatgttgaagccctaacccccaatatgaggatatttggagctggggcctttgggaggtaattaagttagatgaggtcagatggacatggcccctgtggttgagattagccctaataccaagagatagcagagagctccaccctactgttggccacgtgcacacatagggagaagggggccgtctataagcaaggaagagagccctcatcagaaaccgatcgcgccagcatgctgatcttggatctgaggcctccagaactgagggaaaataaatgtctgctgttgaagtcacccagtccatattgttttgttatggcagctggggtaagacagtgtccttctcggtttctacccttaacaggataaaaatccctggagcaaaccctctccttcctcccaaaggagccatgggaagccactctctacaatttgcagcaaacacggaagcaccagaatcctgcacgtatgctcggaggaaacgcacagaggacaaatgcagggtcgcaggatacaagaatggcaaaggctgactccagagaacgttgttaagcttcaaatctatactgtgcattggaaggtaaacaagcatcatccacacaactaactgactgcattcaccagcacactctgaagtcttcaactactgctattaatctatttttctcaacattattttctttcctcattcttggatttctttttatttatgtatttattttttgagatggagtcttgctctgtcgccaggctggagtgcagtggcgcgatctcagctcactgcaacctctgcctcccgggttcaagtgattctcctgcctcagcctcctgagtagctgggactacaggcacatgtcaccacgcccagctaatttttgtattttcagtagagacgaggtttcaccatgttggccaggatggtctccatctcttgacctcgtgatccacccacttcggcctcccaaagtgctgggattataggcgtatgccactgcgcctggcctcattctcggatttctttaacctctccttggaggggacacagaactggatgacaaggaagaaacactcctgggagatgtggttgggggcaggatagagagaacaaaggccagggccaggcaaggctggggaaaggatgaaggctgagatttggggggtgagggaggtgtccagaagatgatgagacgttcaggagaatgggagggcaggaaaacagggcaaggtttggacgggtctccccgctgccgggggtctggtactgcctgtgcagcgcaggctggagggaaaatgtaagctgcccagtgccgctgccctgcccacccctgctgcacctctgagtcactcagttcttccaaaggaaaagctgggaagaaggagttcggtgtctggacttctaatcagcttgttccttacagcactatttactgagggaaagattttaaatgttcagctaggaaaactggtggaatatattaggatacatcatgacaaaaagatgcagcctttgacacacaacctcttatagtatttttaacaacaggcggaaagagccctatgtaacatgaagaaaagttagagacaaagccatatatatgtacggtccagtcagataccaattagataagcagactcgacagagactagaaagaacacacgaaaagcagtaacagggactattctgtactggagaattaagggctatttttctttttttccattttggtaattttgcaggttctctagaagcataatttgtgtttgtaatcttttttttttttttttttttttgagacagtctcactctgccacctaggccggagtgcagtggtgcgatctcggctcatggcaacctccgcctcccgggttcaagtgattcccgtgcttcagcctcctgagtagctgggattagagacacgcgccaccacggccggctaatttttgtattttagtagagatgaggtttcaccatgttggccaggttggtctcaaactcctgacctcgggtgatctgcctgccttggcctgccaaagtgctgggattacaggcgtgagccaccacgcctggctgtatctgtaatctttagaggtattaaaaaaaatatatcttcaactaaagcttagactgatagaagaggcaaaagcagggcaagagagaggtggcccgacgcacacattttggttgctggggtctcataacagaacggaacttctgaggattctgccccatgccctgctctggggagaggggtccatcgccaccccgcacagccggtgagtccccacaccagcagccccagcccccactcgcctcgccgctctgcaatctgcaggtagccagtggacaggtactgctccatgtcctgctggaaggcttcctcaaaaaacttctgccgctccttcagcttcatttgctgggtgtgctccatttccaggaccttctgggcgtgctctgcatctagttcagctgaggaaacagaataactggggttagggtttgaaaagggactgagagaggaaatgggtataaacagctgctcgcatccaccctccaagtggatggagtcatgccgcgtttacagactgggctggtgccccgactgcgtgtacagctggcctccttgtcccccaatctgctgcacttcctccccctacctgggcggtcagggtcaggcccttcgttccacacctttgcatgtgctgttccctttgctggaacgaccttcccacccgcatcgcccattcatcagtcacaaacagctgttcaccttccaagaccagcttctcaggtcgtccttctactaactccagtggagtctgctgctccatccagatgtttccacatccctgtgtttagacttttgcagctgacttacaaaaattgcagtgcaattgctaaggatttggagtccctgcaagactgtgaccatgtatgactcatttcaacatgctgtcactcagctcagagcctggcacacagtaagctctcaaggtatgtttgttaaaagtatgtaacagtagaatactattcacccttaaaaaggagggatattctgacacacgctgtaacttggatgaacctggagcacatatgctaagtgcagtaagccggagtcacgaaaaggcaaatgctgtgtgcttccagccagtcgcgaaaaggcaaatgctgtgtgcttccactcatatgaggtacctagagcagtcagatggatggagacacgaagtgtgctctcagggctggggagagggcgtgggagcttagtggttaatgggtacagattttcagttttacaagacgaaagacatctggagatggatggtagtgatggatgcacagcatgaatatatttaataccactcagctggacacttatgaattctatgtacacataaaatggtaaattttatgtgtactttaccacagtaaaaagttgggaacagggccgggcgcggtggctcacgcctataatcccagccctttgggaggccgaggcaggcggatcacctgaggtaaggagttcgagaccagcctggccaatatggtaaaaccgtaaaaccccatctctactaaaaatacaaaaattagccaggcatggtggcagtcacctgtattcccagctactcaggagactgaggcaggagaatcacttgaacccaggaggcagaggttgcagtgagccaagatcttgccactgcactccagcctgggagacagagcgagactctgtctcaaaaaaaaaaaaaaaaaaaagcttgggaacaaaaaaagtaagtatgtagccatcatggtgtattacaaagtgcttaatcttggctttttagtgtttactgaccacacaacctaatcagttaaccttctcatctgaaaatttgggatagaaatattaacccaatattgatatgaaacatatgaaaggatgtgaaaaaattttataatttaagggaccagtgacccttcaaggtaagccttagtaatatacaaggcaagaacactaacataattaaccttcacctggtcattcaagcaagaaccccaaatctcccagctataaacactttccagtagtttaacttttcctcaaggcacgtgatatggtttagctctgtgttcccacccaaatctcatatcgaattgtaattctcacatgtcaggggagggaagtgattgggtcatgggggcagtctcccccatgctgttctcgtgatagtgagtagttctcactagatctgatggttgtgtaagtgtctgacagttcctccttcacatgctcatactctccaccttgtgaaggagcctgcttccccttctgccatgatcataagtttcctgaggcctccccagccatgcagagctgtgagtcaattaaacctcctttgtttataaattacctattttttttgagacagagtcttactctgttccccaagctgaagtgcagtgacagtggtgcgatctcagttcactgcaacctctgcctcctgggttcaagcaattattgtgcctcagcctcccaagtagctgggattacaggagcacgccactatgcccagctaattttttgtatttttagtagagatggagttttgccatgttggtcaggctggtctcaaactcctacctcaagtgatctgcctgcctcggcctcccaaagtgctggaactacaggtgtgagcaacctcacccagcctcaggtatttctttatagcagtgtgaatattgactaatgcagcaaattggtactggagagagtggggtattgatataaagatacttgaaaatgtggaagggactttggaactgggttacgggtagaggttggaacagtctggagggctcagaaaaagacaggaagatatgggaaactctggaacctcctagagacttgtggaatggtttcaaccaaaatgctgatagtgatgtgaacaatgaagtccagactgaggtggtctcagatggagatgaggaacttattgggaactggagtaaaggtcactcatgctatgctttagcagactggtggcattttgccatgcctttgagatctgtggaaccttgaacttgagagcaatgattaagggtatctggtggaagaaatttctaagcagtaaagcattcaagacatgacctggattattctgaaagctttcagttttatgtgttcacaaggagatagtttgaacttggagcttatgtttacaagaaaagcaaaacataaaagtttagaaaatctgtagcctgacaatgcgacagaaaagaaaaacccattttctggggagaaattcaagccagctgcagaaatttgcataagtaataaggagttgaatgttaagtgccaagacaatgcggaaaatgtctcctgggcatgtcagagattttggcagcagcctctcccatcacaggccctgaggcctaggaggaaaaatagttttgtgggccaggcccaggggccagctgctctgtgcagccttgggatatggcaccctgcattccagccactctaactacagccgtggctaaaaggggccaaggtacagcttgggctattgcttcagagggtgcaagccacaagccttggcagcttccacatgctgttaggcctgcgggtgcacggaagtcaagaattgaggtttggaaaccttggcctagatctcccaggatgtatggaaatgcctggatgtccaggcaaaagtctgctgcagggacacagccctcatggagatctctattagggcagtgcaaatggtaaatgtggggttgctgccccaccacctccacagagtccccactggggcactgcctagtggagctgtgagaagagggccactgccctccagagcccagaatggtagatccactgacagcttgcaccatgaatctggaaaagatgcaggcattcaatgccaacccatgaaggagctgcccaaggccatgggagccacccctgtaacctggaagtaaggcatgaagtcagaggagattattttggagctttaagatttaatgactgccctgctggatttcagacttgcttggggcctgtagaccctttgttttggccaatttctcccatttggaatgggaacattgatccaatgcctgtacacccattgtatcttggaagtaactaacttgcttttgactttatgggctcctaggctagacatttgccttgtgtcacatgagactttggacttaagacttttggcttaggccgggcgcggtggctcacgcctgtaatcccaacactttgggagaccaaggcggacagatcacgaggtcaggagttcaagaccagcctgactaacatggtggtcatgtattttttgtaaaaatacaaaaaaaaattagctgggcatggtggtgcatgcctgtaatcccagctacttgggaggctgaggcaggagaactgctcgaaccaggacccaggaggcagaggttgcagtgagccaagatcacgctactgcactccagcctgggcgacagcgtgagactgcatctcaaaaaaaaaaaaaatacgacttttgggttaatgctggaatgagttaagactttgggagactgttgggaaggcatgattggttttgaatgtgaaaagacatgagatttgggaggggcctggggcagaataatatagtttggctctgtgtccccacccaaatctcatctcaaattgtaatccctacgctgaggaagggagtaattggatcatggaggcagtttcgcccatgctgttcctgtgatagtgactagtcctcacgagatctgacggttttgtgtttgacagttccttcccacgctcacactctctcctactgccttgtgaagaaggtgactgcttccccttctgccatgattgtaactttgctgaggcctccccagctatgcagaactgtgagtcaattaaacctcctttgtttataaattacccctctcagctatttctttatagctgtgtgaaaatggactcatacagcatgtacagagaatacaaaaaatgaaatcagggtcagacatttaccatttttgacctggtacatgggtaaaggattacttctaaacttgcttttagatcttaaatcctttgtacttcacaggggtgcagggagaatcctgaggtggctctgagacctgctccctggtgtacctgctctgcactccctaggcctggggctgggatggattttaccctgtgcctaggtgatgtccatggcacagctgactccttaaagggggaacatctgggtgagcctggcctagctaggcttgtgaagggcactgggccttcttggagaaagatgtgaagcgtgacagggatttgacacagggccattatctgttgctgggttggaggatggagggggccacgtggaaaggaatgtgggtagcatcctggggctgagagcatccccgggctgacagcaggtgaaagaaaaggggcctccatcccacaatcactaggtgcctgaactctggcaatgacctgaagggccctcacacagattcttctccagtgcctccagaaaacaacgcagctctgcgacccctgatctcagcctcatggaatactgggcagagaatccagtcacagcttgcctacacttctgccctacaaactggaagctgataaatttgtttcattttaaactgttatgtttgtggttatctattacacagcaatatgggcttattccaaacaggctgtatgaattcaggtccctgaccaaatctggttgactgtaaaaatgaaaaaggacaacctgagtgccttaccttacgtaaatatttcctaactcctgccctgtgtctgtggcagacaccctgctccgctgagtttgggtgctattactccggaaaatctagtcatctgcagaaaccatttcagctaccttctgtcctgggatacactgtaacaaaccatttcacccaaggcattgtttcctctggttcagctcaggggagtatcaacatcttaggggtgttatcaagattgttaacaaaacaaacgcagcagctcttaccatggacaatggtgaatgaggtccgttatctgccttagtccctgcccatccccacattcccagcaccacactctcaactccggagtccagcaagctggtatgcatggcagaccttaaaacccagtgatggagtttatcatctcaaatcaggtacagtgtctaatacttagaatactatgggctttcttcttatattctgatctacatacatgcaagaaacacaaactaatgctaaccaaagcaacataggaaaagtaaatattcctaattagcatgtaatcacatgcatagtatttcctctgtgcattctgctcatactgttgccagtactgggtgccctctctccatttcctgctacctcatcccacatgtgtttacgtgaagacggtctgccacagtgggaagagtttcttgtgctcacaggttttgggctaggcccaactcaggtcctacactcctagcgcctcttggcacagccctctggtctacctctacgttcagctgcagctatggaagccagttctgtgtgcgctcattgggatgcacagagggtcccacctcacagccacgcctgtgtggctgtttttctggtcagagtattctctgaatctcagggaacctagccagcacagcccagttttgtggaattaaggcagttctcaaccaacatgtgacagaggtcagtgtctcaggaccctggtctaacatcctttgggtggacgattctaggaggcgttctcaacacttctcagagatcctggtacgacggcacatcctcactggctttagcagcttcctgcttttagcttcttttcctcgctgtctcactttccctgtccctcgctcctgcttcttggaatcgcctcccaaaggacctgcagctaaatcctcttcaggatttagtctcagactctttttccacataactgatttcaccagagttgcaacttctcctccatacaagtgcggtaaaaacacctatttcgtaaggttgttggcaggattaaatgaggtagcaaatacgaatcaccaagcatacaatgttggccaatagctggcagctaatattaataccagcattatttaaacaacagcctcttgaagagggagcaacaccaaatattaccaagaaccaggactcactatgcactgaaaatcacctgctctgggccccactcagatgcttaagaattagttacctttcagtactcttaataaatctgcaaggaatttagagtgtactcgtaagaaaaaaaaatgaactgaagaggatgtcttttcatttgtttcacttcagttgtcaacatatctgttcaaatgattcatggctgccaagtgcattagaataagtcaaccctaaaatacattaagtatgcttcaactgcttcaaagttcagctaatcttcttttgaaaaataattccagaataggcagctcaaaaccaaagatcaatgcagaaatcatcaaaggggttttaattaaagaatatcttgttttaacagaattaagattttctgtagatatataacataaaaaacatttttctcaagactacttctgctttaaaagtttgattctctcgtgttgctgaattattggcccttcagtttatctcagttttttctacatcagaatgaaatccaatcatgtctcgaccttcacaagggaggaggggttagattaggaaacttaaaatgacttttttcttttttgacatggagtcttgctctgtcgtccaggctggagtgcagtggcgcgatctcggctcactgcaagctctgcctcccaggttcacgccattctcctgcctcagcctcccgagtagctgggactacaggtgcatgctgccactgccagctaatttttttgtatttttagtagagacagggtttcaccatgttagacaagatggtctcgatctcctgacctcgtgatccgcctgccttggcctcccaaagtgctgggattacaggtgtgagccaatgtgcctggccttaaaatgacttataaaaaataggagaaaacaatcactgttttaagttttaaaacatgttcctcactaggtatctgaaacatccccagctgtccccaccagctccccacttcatttcagagccctttttgtatctcggggctaagcactaagccagcttcactgaggaccgagtatagttgcaccacaccagccactattcaggatgactatgaaaaagcacaaagcgggcatttaaaaataactttgctgcccaacagctaagagacatttgccctcagcgacgtgactgaatgaggatgttctaattgtgctgtgtgtactgaaatcatcaattgggcctgcatcaagaaaacaaccaaatatgggagaggtgaaatgatgggaggatatttgaaggaaaaatttcaaatctaggggtttaacagcatctgaattttagaatgaggactgaaaaatctaaattacagaacattttctacaaggaaaaatgaccccttgctcacattaagatgccatttattatactggggaaagccagacaaatacaaagatgttaagagcttcaacaaatggacttcagattaaaagaaaaaaaatcaaaacaagatgcagtagtttttctacgacgagtcaagagtaatcatttaattccattatcacctcaggcctatgtctttttatttcaactccagatcattgctcaagttttatctgactgcaacttccactttagttaccactatcaatttcaaatgcttacttactcaaaacaacaaaaaattccattaccagtgaagacggaataatcaattctcaattatacgttttaatggggcataagggtggcacaagatatatgaaattaaaaaaaaccaagttcatttcaggaacatattcaacatactctacaactaagccttttaaccgagataggtaataaatatagtgaggtgttaatgaccgaaaaaggcccccaaacctctgggagtcatgtatagaaaactaggataagcctctctcttaagagttcaaaatgttaaaagagaaacagtaacacttactacatatgaattgagaaaaattctagtaatctctctattaaagattaagagcattgttcattagagataaataagactaagaataaactttaaaaactaacttcaatatttacaattcaggtgtttttatattgagttaggaaatatgagttttgtgatattaaaatacatgtgacatgatcaagagagaactgtgaaatatctgtaagtctctaaacaattttctgaatacaaataaacatctcttcaagctgttttttgataaaaacaattgccaacagtctgtcaaattacataaccactagaagacattaaattctgtcaatgtgacagattttaaaaattgggacctatgatttgttttgttttttgttttttgttttttttagacggaatctcactctgtcaccaggctggagtgcagtggtacgattttggctcactgcaatctcggcctccctggttcaagccattctcctgcctcagcctcctgagtagctgggattacaggcacacgccaccacacccagctaattttcgtatttttagtagagacagggtttcacattgtttgacaggatggtctcgatctcctgaccttttgatccacccgcctcggcctcccaaagtgctaggattacaggtgtgagccatcgcacctggccaaattttttatgcttctaattatttgcatttttttctttttagacagagtctcactctattgcccaggctggagtaaaatggcacgatcttggctcactgcaacctccacctcctgggtttaagtgattcttgtgtctcagcctcccgagtagccgagtagctaagactacagatgtgcacaaccacacctggctcatttttgtatttttagtggagacagggtttcaccatgttggccaggctggtcttgaactcctgacctcaggtgatccgcccacctgagtctcccaaagtgctgggattacaggcatgagacaccgtgcccggcctatctgcatttatttaatagggtatttttgatgcatgaactatgtacactgaggaaaatttttagccataaaaaattatttattccacaaataatagggtgaaagtccctattttaggggacttttcctattatagatgactacaactagcacattttggtgtatacccatcagggatttttccccccattaggatgactatatgaaattgcaatactcaatttttaaagctttttacttcgaaataattataggttcataggatgttacctagaaatgtacatcctgaatgtccctcagtgctaacatcttacataattctggtataaggtcaaaacccaacaattaacatgggtacaatccacaaagcttattcagatttcaccagtcacacatgcgctgtgcgtgcagatgggcatacagctccatgcagtcttactacatgcatagccttgtgtaagcactacatcaatacagtaccaccgtaagactccctcaggttccccttgcaggatacagtaaattcctcttcaaagtttagcctgttaacttcctttaaaattcaagaaggagaaaaattgttaagtacaataagttctgagttcttcttcaaagaaccaatatgtcagtatgttcagcttccctgttctttgttctccattttaaagtttaacttcctcattctttactctccttgcccctagtttcagtaaatgaccccctcctagcctctgtcacctgttctgtccttaggcatccttagtcacctgttctgtaactgtcctttccaccaaaactactcaccctgccactccggctcatacccttgctctctttaaaagagacaattggaattagcttagactgtgcagtccaaccctagccaataggggaaagacacagcagtaggagctagcggcattaggaataagaccccttccccttccttgtctggtgtgctctcgccattgttccatccacaagatacacccttctatagaagtaaattgccttgctgagaaaacttttgcctgagtgtcattttcacttggtgacaccaagcatttacttccaacacctcttatagccatgccctccttccccaaacactcagctggactccaaatctataattatgttatttcatatgttatgtaagtggaatcatgtactatatatccttctgagactcgcttttttcactcagcataattgccttggggtttctccaagctacagcacataataatctgttcccttttattattgagtagaattttatggtatggatgtaccacagtttgtttaaccattcacccactgaatggctgtttccaacttttggctattatgaataaagctgtcatgaacatttgtgtatgagttcctacatgaaaataagtactttctcttgcataaatgcccaagagtgcaactgctgggtcatacggtaagttcatttttcggttttgaaaggaactgccaaactcttttccagagtagctattccattttacatccccatcatcactgtgtgagtcagctagtttctctgcatctttgccagcatttgctgggacttactaattgtaacacaggttgagtatccctgcgctgaaatctgaagctttttgagcacctacctgattctaacaggagatgctcatgggagcatttaggatttcagttttttgttttagccatgctcaaccagtaagtgcatactgcaaatattccaaaatcggaaaaaatccaaaacctgcaacacttctagtcccaagtatttcagataagggatatgtaattgtacagactgtttccttttctctctcttttctccagaatgtggatgcctgtcagaaacaagtttcagcttccttttaaatattttcaataattgctgtttccaaaggtacttttagttccctgagcttagtaaaatatattttagaaaaattttgttcagaaactgaggacttgttagacaatgacaaaatacacaatatttccttgcagttttaaaaaccacttttcctgtactgttaccatttttaacagttacattttttcttacctcagttttcaaataaggtatacacaacaatttttaaagtctcccaatctcctgcccccacttaaacaaatgaatacaaattttctcaggctggattaaaaaaaaagacccgtaaaagtattttcctggcattggttttccttatacatgaatttttaaggtatcaacttctgtgacctgtgtttctacagttttaaaaagttttatatccagccttcatcaataattagttttcaaaacagacatatttattttataccatacattatttctgtgagtattctaaagtattatagaacattattcctcagaattggcatttggaaaaacaattctgtgcatgctaaagttaacacacgttttcaaagaaagttaaatgactttacagagcttttcttaacccttgctccaacacagacacacacacacaccctttacacacattaatcaagtactatacttttacatgcaactaaaaaaagatgatccttacctaaaacacagtagttaggaataatggcagtttttttgcagatagtcagaataaataacttttacataacaaagaattcatggcaactactgagttggtcacaaaattaggtccttaggaacagctactggaaatgctgtttcctaaaaccatgctgcaggaaacactattctagtattctggaacagttttcgaattcctatcaattaccttaaggaaatgaccactatctagagtattaacaaaatgaacactgcaggaacaagatgtgtatgaggcttgttagaaatagttaagacagaatgctcaacaataccttagcttttatgggaagggcaaggcagtttagaagaccggggtctgactgcagggccagctcaggcaggcgggtctcagcacaccactcacctcccaccatgcaccctggaggcctcagatttcccatcgccaggagggtggagctggctgaatatggatcggaaggtcacctccagttcttttttttttttttttttttgagacagagtcttgctctgttgcccaggctggagtgcaatggtgcgatctcggctcaccgcaacctccgcctccagggttcaagcaattctcctgcctcagcctcctgagtagctgggattacaggcgcgtaccaccacgcccaactactttttgtatttttagtagagatggggtttcatcatgttggtcaggctggtctcgaactctctgacctcgtgatccgcctgcctcagcctcccaaagtgctgggtttacaggtgtgagccaccgcgcctggccccacctccagttcttaaatgctgagaatctatttttatttacttctgattggagcaggaaagggtgatcccaaagcctatcttgtttttagtataattatatgaatatcagattagcattaaggaatctaagaccttttgagttagacaatgacatttcaagaaaataagatttaattattaacaaaaacctgaaggtatttttacattcattttcctggccatgtgattgattgaagaatgataagaaccagaaagtgtaagataaatggatcagtaagaaatgcacttaatcataaattattacccttgttcaaattcacaggctcagactaggaggttaagggtacggtgtggtggcttctgcaatgagtacaggtagcaccaagaaggctgcttcctgtaggagatcgacaaatacctacatggatgagtcacagttcgaaggaatggttcaacgccatttgaaaatgctcttcagtgatatgttgacaaagatgctttttacagaaacactatgctaaaatgccgcatgaaatagcagctttttctttctttctttctttttttttttttttttggtaagactaaaaagaacttcagtctagaagctttgtgttatggatatttagacaaaagcccaatttctagaatttttaagccacatctgacatgttcctgaattttaactatggaattggcctacttattaacagtttgaggggaaaaaatggaagaagtttagatcactacaggaatcttttcaaaatcaaaggctttttttaaaacgctgcataaaagactttagaaaaagtagtataaaccaactgccagcgtctgtgagtgaaaattatttattaaagagtccattcaaaagggttgtacagacagaaaaccagtggttctccacatttggcagcatcaaaatcacctacaggactagtgaacagagattcctggaccccatatccagaatctgattcagtaatccatttgggccaaagatttgcatttctaaccaaaccccaggtaatgctgacactgcttgagaaccactgctctagacgaactacatctgtgcaaccactgcattacttcatttacattttgaccttgtataaatatttatacaatgggaaacagacgaagcagctggtacaatccatagaaatgacggaaatgttatctccttaactcttgaaaatatctgtgaaattatccagaacggaagagctccagcagcaaccaaaatgcataatcacagacaagaattgcctgttgtcaaccttatgggtgacaataacggataagccccttaaggcaggctttcctccttagcaactctgtgccattctgtggaatccattaccagtccctgtgcttggtggcttccacacagaaggaggcaagatcccctgtgaccagatctgtgctttgtcctgaactccagatataacagagtgggttctcatcctctccattttcagagacaacatacagaagttttcaagccatctgcatttaattttcccataaacaatataaaattatatttgtattcaaagctaatagacaaaactctggcaaataaaaattttagagaagaaaaaatacatacaagcaaagtgagatgtgagaaagtgaatatggcaacaaatgctgaagagatgcaaaatcaatgttaaccataaatttctattaatcgaaactctcagactccaacagtataacaaagctaatcacaatgataacctaaggtattcaaagatttaagagatttctgaattattaaaacattttatagtatattctaactgctttgaaaattggtcatctttgacagactggtaaatatcaacagataaaaggtttgaattaatcaaaaacttcccaaccttgataacctggtatgcttgttattcaacataaataatcacacatttaaaaagttttaaaagcgttctacctgctatggattcatggccgttcaacacaatctatgtgttaaaatagatcagacccaggattcaggtcagcatttgctattcttaatctctaagcttaaacacacacagacacacacacacacacacacacacacacacacacacacacacaccacaattcttcccatgtataacacatttggaaggcaggaaggacgttttttgccaacagaaaactcttaagaacacaaaaaccaaaagcatccccttgtttccaacattttgatttcagtatataaatgatgttgatggaattttctcagtaagacaattctcatttctatggttatagtgatttaaattggctgctatgttacaaaagaatcttgagaaatatctaaaaactaaactcatataaagaaattttgacatagaggaaaaaaagaaggcagttaatatgtcagcacatctaaacataaggcaatgttaatttaaaaaacaaaaagaaaaaagcctgttgaatagtgattgaacataatattaaaatctatggtttgggttttgttatttgttttaatcatgagagaaaaatccttcagatgtaaaatttaagttttcattaattattaaaaatgtatatttttctatcttattcattcaagaacaagcaaccacttgacaaatgtggactaattttgacagtaacccctcactaccaggaatggagaaatacacaagcttcagttgttttctcatgatccagactgcaaataaaatgcagttgcaaataatatcacctacaattttgtttaactccaaagatctgagggtctctaatttgagcattacaatcagaaaaacaaagctgattttcttctttttaaagggaacctgagaccgggcatggtggctcatgcctgtaatccgagcactttgggaggccgaggcaggcagatcacaaggtcagcagttcgagaccagcctggccaacatggtgaaaccctgtctctactaaaaatacaaaaattagccaggcgtggtggcgggtgcctgtaatcccagctagtcgggaggccgagacaggtgagtcgcttgaacccaggaggcggaggctgcagtgagccgagaccgcgccattgcactccagcctgggcaacagagcaagactttgtctcagggattaaaaaaaaaaaaaaaaaaaaaaaaaagggaaccgaaatatcgcaatccagaaacaggctggatgtgggtggcaggtgcagtggacgtggtgtcctggcagctgccctttccgtcagccctcctagccacctctggcacccccgcagcaactctgggcctcccctgttgaggctcattgtcctgtcctcactaggttgcattatctttttttctagcattttatactaagctagctgtcgaccaaaccgaagccttgtgaaaagttttaacaagagaagatcctttcaactcttcagagccaagattcagtatttttaggtttagtgtttcccagggacatttgcattttcataggacactacagaatctgaaaggcctttgaagctcaaggaaaaaagctacagcaaggaatcactttcaatctttttgggcagggctcttgccccttgacccaagccgtaccaccaccagagctagatcctgactacgccaatcccacctcacttcaagaacttcctgtccaaaggtgagggaacctgactactgatacctgcagctccccaccgtccatcagtgtagctccaggaaatcaaaaccaggtttaaaatttaccattagtgtaatgattatcaacattaattagaattcagatgctagatttccttggattttgaatgtcactgaagaacacttaaaaatgttcaaaacaatcacctttagagatgtttccactcatactgccttgatttcaaattaagtagtccaaaaattctaatctaggacaacgagtctcaaaccttttcaagtttaagaatgggtatacttttttggcaatttacgagatagtatgtgacaacaaaaatctattatgaattcagtagcactttacatagctttgaattttgtttcccacaacatttacatatatttcaaataaaatactgcatatacttgcaatacaaaatatttatccaaagctcaacatgcttttgagttcaaaggcctcttgttataaatatcctcatgccaccagttggaaatatcctgcctctaaaaggttcagtgacagccaaatctcagcatgcttgaaagctgatcatatctgctggaaacctcattatttccagaaaatatttttgaaatggggacatatcactttcaattataagctgttgaaggcttatgaataagtgacttatgaataaatcagtattatgaatagctgtcttggtcccctccctccttccaccaggagtccttcactgccagctaatgagatggggatgagaggcagattctgcccctcccaggcaggctggtgttgcagcccacagggatgacggaagatggacctggagaagttcctgagtccacaagctgaggaagatgctgcatgaggaaggtcggagcaggggagctgtcaatgtgggggcagcatgctgagtcatctgaattttgtcacctttcttgagatttcaccaattagagattacatgttttaatatgtccttttcagtatgaagaatactatattcagggggctctgagaaaactaacattcaaagcttaacatgaattagtttatcaggacctctcccttactgcttctctaagattaactgctctatagatgaaggggtaaatgagcagaaagagaggtgatgtgaaaaaaaaaatgcagcagctgggagacaggacacccctgcttggggccctcagcaggagcttttggcaaacctgaaggtatcaatgccttgggacaaggacgtgcaaaagacaagtatgagatgctgaagatgtgctacttctgattcaaaatagtgttcagagattttacccctcactcttcctgttttctactggctacaacaaccttacgctcagtaaagacgtataagaatagctttgcaatgaaactgctattcaggaagtatccctaggaagccgcttttccagctgcggaagaaggacacacagccaacacctgatggttctccaaagaagccatgccctgacttgtaattgccttgaccctttgctcagacgcctgcactcagccaacttccactcaccctccacatctcagctcgactgcccccttctctgacaggccagggagacccaggctctctttcctccacgctcccacatagctggtacctctccattgctaccacacacttgccccctatagttccactggatgccacgttcctcgagagcaagcactgtgtctttcaacatggaagctttagtgcctgtcatggagttggcgctcggcaacagtctgatgaaggtactggtagcaatcactaaatggggactgcacagtaaacgccagatatcaggagcagcctcacaagtacacaggagtaggccttcaactggctgcttgatcgcaaagccacagccagcagtcacagcaggccagacgtttgaggtgcagtgatgcagaagataaacagcacacagctcaggaaacagcagcacagctgacgggaaacaccagcatgccattctatgggctggaaacaaacaagtacaatcctcatggctaaaagtgggagcaggaagtggctacaaggggctctcaggaacaggcaacggacaatgacatcagactggtccatggaatcagtgcaggaggtatccaaaaacacctgcacttaagattcagttcaataaaaagtgacgttacccaagggctatggaaaagctggccaggaaatctgtaatgcattaaaaatagcatgccaaaaataaatcacatccaaatgatcaataaaatacaccctctgaactcctcccccaaattcatactcacaaaatgatgccatgaacctttctttggggttgaccacacctgaaagtaggcagagaagctgaaggaatattgagggtttatttagaatagcacacaacctataagctgatattatttattcaatgaaaggtttaacacatccaagatattacaggattcccttacatgtacccaattagtatgacagcacagctgggtgcagtggttcattcctgtaatcccagcactttgggaggtcaaagcaggaggactgcttgaggccaggggttcaagaccagcctggccaacatagtgagacctcctttctctattttcttgaaaaaaagacagcaagtcatatacaagaagcctattattttgtaagaaaagtataacttataaactgagctaacattcctaaaataagacccatatggttttgaaaactgtgatgtgataatgtccttttcatgaactctcctgataacacatgttgatattccttaggatgaagatttgcccatcaattcaatacacagaaataaattattttcatggaatactttcaggtcttctatgttctaagcacaaagtagaaactcaaaagtgattgtgaaatgagtgaacaacgattaattaaaaaaataagagtaagagggtataagattcaggaaatacccccttaaggaaaaagtttcatctaagctcaaacaatcattttatttcattgcttagttttttggtgtacgatcatcaacaggagaggggagaaaaatccaaaaactcttgccaacttatgaaaaaagcagtttgcctgaaaatcaagtaaaacaagttgatgaaatgatttgtaaagtcaggaatactgccctgttatatttgcatttcctttgtttctcatgaagggttgcagcctgtagggtggccattctgacaggctgggaagcacagcctcaggccagaagccagacacaaacactttgagggaggggcagagggaacagaaatagcatacaaaaaaggtcctggatgaaaatacaagatttttagacatttgaaaacataagcttcatattatgaaagacggtaccatacaagatagatattgttttaaattcagataaaatggaaccacacagcattccagagagatggtaagtggtaagtgacttgattagcattttgacataaactgttttaggccttccaaagtcttttatctatctttcctcacatgcagaggaacaacttcattctattcttcatgtgcaaagcagttcaatgctcttgacaagtgagcttttttttttttggcctcagacagctttgccatttcttaaattttcttataaaagcctatgtaggttccttagaagcagacccagagcctgaaagctaattcttaagtcgttttcatttttcttttttccttcctttcctaagcctaattccttttatttatgattttgggtgatggggttcaggacacaataccccaaaatatggcactgtggcgtattagatatttgaagctgaaagaatctgagaaaactgcagaaacaggaggatcgctctcaccttccccttgcccttctcccctgaggcaggcataaaacctaggaaggatcttctcattttctcctgaagcaggacacaagatcctcatgtgagagacgccaaccctacacatggagagaaaggactctatctcaaataagaagaagatgcagggacacagagaggaatctgaacaaacagaacttgctaagttccccccagttgactgctattacatcatactctttgtccagtcatatttctacacagctgtccactcttcatcaagcctagcatgcaaatacatcaagtttctgtcgctttgggtcttcatttctgaaggctcccatgtcacataaaacttatattaaatttgtatgcttttttcttctttttcttcttcttcttattatttgagatagagtctcactatgttgcctagggtggtcttgaactcttgggctcaagtgatcctccagcccctgcctcccaagtagctggaattacaggtgcataccactatgcccagtggcttttttcttattaatctgtcttttgttataggggtcttaaccatgaacctaggatgggtgagggaaagatatttttcctcctgtcaactgaagaatgaggttcataaatctggaaagaagagctttatttctcatgaagggttgcagcctgtagggtggccatcctgacaagcagggaagcacagcctcaggccagaagccagacacaaacactttgagggaggggcagagggaacagaaattgatgctaagcagggtggccacatgtacatattcaataaactgtaggaggagtcatgaatatttatgaaaggagaaaggtgcacacatgcaacggagcttcatgctccttcatgggactgatgtacaaaaaaatggtggcattagcaagatccaagggtggattgctgccctctgatgtcaaaaggtgaagaagaccagaaaacccttgctgtgcagtctctgtagactggcccgaaccattccgtggtcggtggtctcttatgggaaaaaatgctggtcagttatgcgaaaaccgcaaaagggagaagcagtgtctggtggttggttgaaatcagcggtggagtcttttgaaagggctgtttgctccttagcccttgggtgagaaagcctaatcatggttagccagggaggggggcatatgagaggcatgtctgacctcctatcccatcatggctgtgaactcagttttcaaggttactctgggtccccttggctaagaggagatctgttcagtcagttacggggcttaggattttatttctcactcccctacataaatacgcacacaagataaaacactttcctctttgctggaatctcttaatgttgatggtcaaaaggtcctatatttaccatttaggatgttaagaatctaaaatgatccagcaatattgtcaaaggcattagaaccagagcaactccgtcttgaatagaggctgggtaaaaggaggctcaggcctcctgggctgcattccaaggatggttaggcattcttagtcacaggatgagataggaagtcagcaggactgttatcacaagatacaggtaataaagaccctgctgataaaacaggatgtagtaaagaagcctgccaaaacccaccaaatccaagatggggatgaaagtgacctctggttgtcctcactgctcattatacactagttacaatgcattagcatgctaaaagatactcccaccaatgctatgacagtttacaaatgctatggctatgtccagaagttactctacatggtctaaaaaggggaagaaccctcagttccaggaatccccacccctttcccaaaaaactcataaatagtctaccccttgtttagcatatgaccaagaaataaccataaaaataaccaaccagtagcccttggggctgctctatggagtagcttttgtttctcctgtaataaacttgcattcactttactctgaatttgccttcattcttgaacaagatccaagaaccctctcttggggtctggattgggacccatttccagtaacatcttcctggcaaaccaccaagggacaacactggagaaaccccgacccaaaagaatagactgcagcactaattggccaactttgcgtaagtagtattttgtccagggtaaagaacagaattgggttagaggcccaacttagcagggttagaatccctcctaagaaacaggcagttaaaggtctttgggttaatccccgggttaaaatgcccaatttagcagggttagagtccctcctaagaaatagggagttaaaaaatctttttttttttttttgagacggagttttgctcttgttgcccaggctggagtgcagtggcacagtctcagctcactgcaacctccacctcctaggttcaagagattctcctgccccagcctcctgagtagctgggattacagccatgcgccaccaagcccagctaatttttgtatttttagtagagacggggtttcaccatgttggccaggctggtattgaactcctgacctcgtgatctgcctgcctcgacctcccaaagtgctgggattacaggcatgagccactgcacctggcctaaaagtctttggattaacttgccttgtgctctttgctgttggctgtgggtgacagaattgggcatgtacagaagcacatgggacatggggagacttttcttctcaaaggagaaacttaagagctcatgaagatgctggagatcaagatccctttgtggctgacaagcagccacctgaacttttgattcagtgtcaccgcactgggtgggtctttccctggcctccctgagctcctcgcctgcccagccccatttcaggcaatgctattttcccttccctccttcccttcccttctctctctctcttgcaccctttttcctttcctatcttttctgtcactcagggcaactgtcctctcttccatcctgcccagggaccacatgttgaaactcctggtcagaggtcattccatcccactttgaatggattaaatgctttaaggtcataaactgcttctttgacttgaaaattgttcagcttgactgctttggagccattagattctagataaggcctggggacctgtggagttggccatgccccttgggtatgctggaaagcatcataccttgtctgcacttctgtctggtgtcctaggcttcacacctggtacctaccaggatttttaccaaaaataaaagttgctaagagttaataccataacatacgtaactgagactactggctaaacagttttacatgtaaggtgtgttaaaagtagaatgtgtttttggtaaaatactataagaaggcatgggggtgggaatttttttttttttttttttgcctggtttaaaaggttaaaggattgttttaagttagatatgataaagctgaaggtttgagcaaattgtgaaaggtttgtgaaagactaatcttgtaaaagaaattctgtgtgtaaacacattggctaaagttaaaggggtaatattcagtttttacataaattgaatattgaaataaaagcactgcagggttttcttagaatattaatcttttatttaacagaaaattttaacagtttataaaaggtttacaggaatcctaccttatggtcaaactgattaagactggacaaatttatctaagggttttactaagaattgggtttaacattcatagtacacaaatacaaaggtgaaatctggcccatgaagaagaatttcatgtaatattaaaagacaatgaaagatttttgtttgcctaagctacaaaaaagaggcaggaaaaaagagattgtttggaaagctaagttctcctgtattaacaggtaaaggtttttgtctttttaaaatctttatcattttggctaaatgacttattgtgacctaggattctattttataatatcaaatgttttaaacctttgatatttgacaaactttccaaagtaaaattataaatcatgtctttttcttaattaatcttttagatatcagtcccctaaagtaaaaaatgatatatttggcttatttggtatattaaaatcatacaggaagcattgttaaatatgaagttgtgtttggctttctttgggttgtatctatataaatatattattggtatgtgttccaaaaatactggaaacacctataattttgatatgacttagtgtacgttatcagtaattatattatgttaaattattgtataccacagaagcaaccaaatttccttgtcaattgcatctttgattatggctgcccaaagacattttgtcatccacaattgtcttgttttgatcctcttcaaaggatggtttataatcaactataagattctgatgagtactcttttttttttttttttgagacggagtctctgtcgccaggctggagtgcagtggcacaatctcagctcactgcaacctctgcctcccaggttcaagtgattctcctgcctcagcctcccaagtatctgggactataggcacgtgccaccacactcagctaatttttgtatttttagtagagatggggtttcagcatgttggccagactggtcttgaactcctgacctcaggtgatccacccgcctaagcctcccaaagtgctgggattacaggtatgagccaacatgcccggcctctgatgagtactcttaaatgcaggtctctgataactttgaaaagtatgccaataaaataggaaagaacttccaacactctcttgaaaaactaatgtattcataaatattgagcaaaatgggaattgcataaactgaataaaacactgaaataatctgtttatgactttctacttaaaatgttgcccatcctttctgttttgtttttcagagtcaagaaaacttttcttttgagctatttacagtttttattaggttgatgcaaaagtaatttctgttttgcactgctggaatttgctgtttgatattgcagtacattcttaaataaatgtcgttatgttataggtcattttaatgggcatttctcactttatgtgtttttgctaatgacttactacttgctgtttatctttattttagactacggaaatgacattagacaaaaagcaaatttgagcgattttcgtatcaaagttcgaaatgggtcataaagcagtggagacaactcgcaacatccacaatgcatttggcgcaggaactgctaatgaactgacagtgcaatggtggttcaagaagttttgcaaaggagacaagagccttgaagatgaggagcacggtggccagccatcagaagttgacaacgaccagttgaaagcgatcgtcaaggctgatcctcttacaactacacgagaagttgccaaagagctcaacatcaaccattctgtggtcattcagcatttgaagcaaattggaagggtaaaaaagcatggtaagtgggtgccttatgagctgagtgaaaatcaaaaaaattgtcattttgaagtgtcatcttgttttatcctacacaacaacaacaaaccatttctcaatcagactgtgatgtgtgatgaaaagtagattttatgcaacaaccggtgacaaccagttcattggctagactgagaagaagcttcaaagcacttcccaaagccaaatgtgcaccaaaaaagagctcacggtcactgtttggtggtctgctgctggtgtgatgcactataggtttctgaatcccagcataaccattatatatgagaagtatactcagcaaatcaatgagatgcccagaaaactgcaacaccagcagctggcattggtcagtagaaacggcccaattcttctccatgacaacgcccaactacacatcacacaatgcctcaaaagttgaatgaattgggctacagagttttgcctcatctgccatattcacttgacctctcgccaactgactactacttcttcaagcatcttgacaacttttttgcagggaaaacactcccacaaccaggaggatgcagaaaatgtttcccaaaagtttgtcaaatcccaaagcatggatttttatgctacaggaataaacttatttctcattgtccaaactgtgttgattgtaacggttactattttgattaataaaaatgtggggccaggcgcagtggctcacacctgtaatcccagcactttgggaggctgaggcaggcggatcacatggtcaggatatcaagaccatcctggctaacagggggaaccccatctctactaaaaatacaaaaaattagctgggcatggtagcaggcacctgtagtcccagctactcgggaggctaaggcaggagaatggcgtgaacccaggaagtggagcttgcagtgagccgagatcatgtcactgcactccagcctgggcaacggagcgagactgtctcaaaaaaaaaaaaagtgtttgagcctagttataacgatttaaaattcatggtctgaaattgcaactacttttgcaccaattgggtaaagtgtactcctgtaaacaaaatttgaagcatatttctttctctctatctgatttctccagaatttggaaattatttgtatttgtaatttatggcaatataattatttgcataagtacagtaagaatctgttttcttttgtaacagggcccagttggagaaactggttattttaccaaggctttgactgaaatggcatgctttcaaatataaacaggcttctttaaggaatcaaagttgacttacagagccaataaaagctccttgggaaaactggcctcatgccttgtctacacagtccctgcatagggttcttgacctgtggtaagtaaagaatgtcactttctgacaggctcaggaggcccaggttatcttgggaccctgaaagaaggaaacaatttatccaactcacacaggtatttgcaagcacaaacccctggctgggctcaaacctttaataagaagtctactctaagattccttacggaagaaagttccatcaaagccaacttaaaaagagcctatacagcaaaaattattcttgctgcactttatacaaataatcaggccaggtataataagactaaagtttattttgcaaacaaatcaagcctatcatgctttgtctttagtaaaaatgggagactggagagagaaaaactatgtttcaataactatagtacacctgttactagaacctagccttgtctgttgtttttgagtttttccctgcaatttagactgacccagcttattcctgtgaaccaaccagtgacctctggatgcaagctcagaagaaacaagagggataggtaatgtaaaaatctggatcaatattgtaattctaggcacatattagaatcagccactccaagtctgcttagttccaacaattgcccagttcatggaaagccttcttatttagtttacttgagataattttacttattttgctttactcttgtggaatatactgtcattgtgctctttgtgtaagaatgcagaataagttaactcaatattttattaaattgaacacttattagtcttccaaatatcacctttggtcagaactcaagagttatgaatggccctcaccatatggatgctttctgaccaagcatctctctaccgtgaatacaagagatgctaatagttgggcgggaatatcatcaccccattcagcctaaggaagagaagatggatcttcctccctctacaacccttagaattaaaatttccttgtaaaagggaaggagaaaataagtcagaggtatttgaaccacagcaactccatcttgaataggggctgggtaaaatgacctgctgggctgaattctcaggaggttaggcattcttagtcataggatgagataggaggttagcagaactggtatcagaagatacaggtcatgaagaccctgttgataaaataggatgcagtaaagaagccagtcaaaacccatcaaaaccagaatggtgatggaagggacctctggtcatcctcactgcttattatacatttattgtaaagcattagcatgctaaaagacactcccagcagtcccatgacagtttacaaatgccaggactatgttcagaagttactctgtatggtctggaaaagggaggatgcatcagttccaggaaatcccaacccctttcctggaaaactcatgaataatccaccccttgtttagcatatgatcaagaaatgaccataaaaacagccaaccagcagtcctcggggctgctatgtctatggtgtagccattctttgtttatttacttctctaataaacttgggttcactttactctgtgaacttgccttgaattctttcttgcacaagatccaagtaccctctcttggggtctggatcaggacccctttctggtaacaatatcatgttgtgtttttttcataatttatagcagcatttacttatctgtttctctataatctaaattgagaaacctttgactttctgtatacttcagaaaatttataaaaagaaaatatgttcataggtatcacatgcacagaatggaaacacttagtaaacataataaatgttttagttttctgagcaagacacttctcaccattagcttagaaatcccaaatggatgtatggataagttgctttccattttttcccaaagtcttatggaagaggaggaaagcaatgaaaatatttaaattgctgtgtctaggctattaagactatctttttctggtaaggaaaactcaatgagcagaacaaaaaagagaagtgtgccggggaatggagtagaagccatagaaactagcataatcacccttattacaatctcctaaattatgcaggccataatctctgaccatgcagtattaaaggcaggcagactctcatatgtccctaatactcttaatctgcgtaattctcctgggtccaagctgccatcgtttctcactaactggccaacagcctcctacctggtcactccaaatccatactggccaccttccaagcctcttccacacagcagccagagtaatttttctagaaagcaaatctgatcatgtttccattgctcattaaaagccttccctgagactactgctgtagcaagattgcttcacatggcataaatgagtttcactgagaaccagaagatgcactgcactgcagccttcacgacctgcttctagctcttcagactggccatatcccacctacacatgctcttccctctagctggaatctcttccctcccatcttacctcctactcagctttcagatctcagctaaagtaccacttcctcacagaagaattttatgaccttcctaataaagtgaaacccaacctatcacaatacctcatttgaaactcctgaagaaaacaggagaaaatcttcatggcctcaggttaggcaaagggttcctgaatatgacagcaaaagcataactcataaaaaaagaaaataataaaatggacttcatcaaaattaaaaacttttaaagccatcttcacagggttaacaagaattctggacataaacatagttataattaaacattaattaggctgcatcttaagccacttccttataacctaatgccacataacgttagatactgaccatctgtatacccattgttcctatagacaggatctctgatgttagaatcataaggcttttgtttaagaattccttaagcaaatcctgaattacagtggaaaagctgaagccaaccagcttgaagatccccacagaagagccaaatcagcatgaaaatacagtttcttcatctctctgtcccatgacttcactctgcactctttgactaatcaatgatccctacactcggtccactccaaaacctttaagaatcctagccccagctgggcgcagtggctcacacctacaatcccagcactttgagaggctgaggctgggccgaggttcccgcggtggaacacctgaagtcaggagttcgagaccagcctgaccaacatggtgaaaccctgtctctactaaaaatacaaaaattagccaggtgtggtggcacatgcctgtaatcccagctactcgggaggctggggcaggagaatcacttgaacttgggaggtggaggttgcagtaagctgaggtcatgccaccgtactccagcctgggcaacttggtctcggaaaaaaaaaaaaaaaaaagaactctagccccaaactcctcagggagacccctttgaggtttcctcccatctcctcatttagcggctccacaagtaaacctttttctgctgtaactcggtggctcggtatattgacttgccatgtgcatcgggcaaggaacctactactgttacacttttgcccttcaaaatatattactgagaaaatgaaaatgcacaagttgggagaaaatactgtaaatcgtatatctgataaagaacttacacaaaataaattttaaaaaactcaactcaataataagacaaaccaattaagaagcagacaaaaaaaatttttcctttctttttttttgatttttttgagacaaggtctcactctattgcccaggctaaagtacagtggcacaatctctactcactgcagcctctgcctcctgggtccaagcgattctcatgcctcagcctcccaagtagctgggtttacaggcgtgtactacctctcctggctaatttttgtatttttagtagagacagggttttaccatgttggccaggctggtatcgaactcctgacctcaggtgatctttccgcctcagactcccaaagtgctgggattacaggcataagcccaccgtgcccagcctaagaaataggcaaaatattttaatagtcattttaccaaagaagatacacaaatggctaataaacacattaaaacagatgctcaacatcattagttatcacagaagtacaaatcaaaatcacatggctgggcaaagtggctcatgcctgtaatcccagcactttggtaggccatgatgggcggctctcttgaccccaagagtttgagaccagcctaggcaatatagtgagacacccaagtaaacaaaattagctgggcatggttgtgtgttcctgtagtcctagctactcaggaggctgaggtcgggggatcacttgagctcaggagcttaaggcttcagtgagcagagatggcaccactgcactgtagccgtgacagagcaagaccctgtctcaggaaaataaaaagacaaaattacatgggataccacatcacatctactacaatggctgtattaaaatagacaaacaataagtgtaggcaaggatgaggagaaactgaaaccctaatacattgctggagggaatgtaaaattgtaaaaagtcactctggaaaatggtttgtcaatttctttgaaaagttaaacataaacttatcatagaatccagcaattcctctcctaggaatctacgcaagaggatgaaaacatgtgcacacaaaggcttgcacaggaatgtttacagtagtacttttttaaatagccccaaactgaaaacaatccaaatgtccattaactggggaatggataaataaaatgtaatatatccatacgatgggtaccaccagaaataaaaaacaatgaagtactgatatagtctataatatggatgaacctagaaaatattatgctaagtgaaagaagccaaatacaaaagactatacgtaacataggattctggacatttatatgaaatgtctagaaaaggcaaatctatagagacaaagctggttatgcttatctggggctggggttgggagctgggattgactgaaactaggcagaaaggaatctttttggggtgatgaaatattctaaaactggattatggtgatgagagcacaactccttaaatttcctaaaaatcactgaatggtacacttagaatgggaaaatttatggcttgtagattatacctcaataaaactgtttgaaaacaaaaatctcatgtgaccatgtagttcgtgttagcacttattgtgaagtgttcagcatattaaacattcagaggagaaatacagagtactctgcaagcattttgcttctttactaagaggcagcctcatgcagtagaaagatcacaggctctaaagccaagactgaaaaacaaacataaaattcttcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaattctaagccccccaaatgattgaatggatccaccttctcaaccaaggggattccaaagaaacctgaaaggccagtttaggccaccatgggaagagggggtcaggcatgcctcatcataccttcttcattctggagtttagacaggctgaccagcactaactttaaaacacagatcctaagacagacagaacaaactctttgcagcaataagataccactccaacctgactctagcataacctcacatgacagataaagaaggaaataaaatattttatcccaaaatatgtttctttggcatattttgaaatgaccctgcaaagctaccttttgtgggggaaaatctgcatctggaatgaatctcctttttttttttttttttttgagaccgtctctctctatcgttcaggattgagtgcagtggcatgatcttgactcactgcaacctatgcctcctggattcaagcaattcccctgcctcagcctcctgagtagctgggattataggcacccaccatcctgcctggctaacttttgtacagacggggtttcgccagttggccaggctggtgttgaactcctgacctcaggtgattcgccggcctcagcctcccaaagtgctgagtttacaggcgtgagccattatgcccagcctgaatgaatccctattaacataactaggtctttccccttccagaccctcccaatcctgaagagtttaactgagagtatagcaccttttaaaggtctaaatggaaacatttgccatctattgtcatctttagcgtagccacctatgagtcttcatctaaacactaagaatcttaggctgagtgggctgagtgcaggggctcatgcctgtaatctcaacactttgggaggcttaggccagaggattgcttgaggccaggagttcaaaacaagcctgggcaacacagtgagatcctgtctcttaaaaaaaaaaaaattagatgggcatggtggcaaatacctatagccccagctactcaggaggctgaggtgggaggattgcttaagcctaggagtttgaggctacagtgagctatgattgcaccactgcactttagcctgggtgacacagccagattctgtctctcgggaaacaaacaaacaaacaaacaaacaaacaaacaaacaaaccttggtctccacaaccctttatcttaacccagatactcctttagatgataactccttcaaccaattgccaaccagaaaatcgtacaattcacgtatgacctgtaagccccctcgcttcacattgtcccatctttctggatcaaaccaatgtacacctcacatgtattgattgatgcttatatttccctaaaatgtataaaatcaagctgtaagccaaccactttgggcacatgtcctcaggaccttttgagactatgtttcaggccacggtcactcatatttggctcagaataaacctcttaaaatattttatggagttggattatttcaccgacaaaacaataatgttaaaactcctgcttcaccacttactagctgggtaattttggaaagttacttaaaatctctccaattcagtaaaataggaacaagaacattacgagttgctatgcggattaatgataatatatgtataatattatcattaagcccttgatggggttcaggacatgctgccccaaaatatggtacaccttggcatttgagaaaacagcagaatcaggaaggccactctcaccttctctgccctttccctctgaaatagtccataaaataattctctaactttcccctaaagtaggtccaagatcctcttcagagaggtatcttctgtatacctggaataaaggaatgttcctatccctgaagaaaagaatctgaacaaacaggtcttcctaagttcccccaactcccatttattactgagagaattttagagatatcctttcgtcctccaatcatatttctccatgcatctccactattcatcaaagttaacataaaaatacataggtgtccctgtttctttgtatcttcatttctgaaggctcccatgtcatgtaaaacttatattaaataaatgtgtgtgcttttcttttgttaatctgcttttgttttagaagtctcggacacaaactttgtcatggaaaacaaaaagatactaccattgacccttgaacaacatggatttgaactggacaggtccatttatacacgaattttttttttcaataaaagttataccaagtgtgcctgcctctccttccacctcctctacctttgccacccctgagtcagcaagaccaactcctcctcctcttactctatgtgaaaacaatgaggacgaagatcttcataatggtccacttccacttaatgaatagtaaataatatttttttgtccttataattttcttagttacattttattttctctagcttgctttattgtgagaatatagcatattatacttatgacataccaaatacatgttaatcaactgtttatgttattggtcaggcttccgctcaatagtaggctattagtagttaagtttttggggagtcaaaagttatacaaggatttccatttgcctttgggaatggggtcagtcccctcaacccctgtgttgttcaagagtcaactgtacttttttccccttacaaagccctttgagatctggtgaaaccatcctcacaggctaacaagaattacatgccaagttctgggcagaaatatagttataattaaactgtaatcaggctgcactttgacccacttccttgtaaccaaaagtcatatagcactagacactgaccatctgcctccccactgttcctctagataggatatctgaccttagaatcataacgtttttgtttaagaatcatttgcatccccactgttcctatagacaggatcgctgacattagaatcataaactttttaaagaattgcttaagatgtgcttcagaccctgaattacagtggtacagctgaagtcagccagttaagacccccccccgcccgccccgacaggaacgaaatcagcgtgagaatgcagttctatctcccgtcctatgacctcaccctgcactcttcaaccaatcaatgatccccagacatcagcccactccaaaccccttaaaatctctagacccaaactcctcagggaggcgatgtgcggtttcctcccatctcctctttcagctgctctataattactaaactccttctccacggaaagccttggtgtcagtgtagtgacatgccaggccttaagcaacagacctgttagggtcacaccggcttctgctaacttctccagtctcgccacattccagccacagaggccttctttcagttttctcacacctgccaagctctgtacttcctgagaacctctgaacacatagtttcttctgcatagaaatttcgtgcccactcgttactcatattggttctctcctttttgtcctttagtctcagacttaatagtcaccacgtcaggtagtccctgccctttctatactccttggtaaattatgtccctgtaataatgctgattattgcttgtaaactccctcttctcactagacaaaactccatgaaggtgtccgcccacctcactcttcccttctccctccctctcaccccttctctgtatatgtgcatgcgtatgtatacctgtgtgtacatacatctatgtgtgtctgtacacatgttaaaatgtatgcctactatacaggggtagacctgctaaccagcagagtgcctggcatacagtggacaatcaacaccaaattctatgatttactttttgttaaggtttacagaaaaaaaaaaaagaccatttacccacactcatcaaagcacctttcccaacactcccaagaggactgagagactcatttctgttccaaaatgcataggtatatattctcattaaagcaactatcttactgtttttctgtttcttccttgtagactgccagcttcttgagggcaagaatcttttcaatttaatacacagccaagtggccgtttcctgactagcagtcacacatgtactctgagttctccaaaagcccacacctctgttcaactttgaaactttcagaggtcacctgaacgaacccatcagaactcagctatatcaaccagctggaactaagcaagtttgaatcctgcatttgcataaataaacctggctgggaaccagggtgaaacttttgttataaaacccaaaccccaccttcgttttacaccaaaggctgtgtctccctgtactgcaaactgttcactgcaataaagtcactttccttcaaatttcttttccgataatttttgtttacagtactctgttcttcctgggagtgcttaaaaataagctaattatactcacagctttttgtaaattttcacttaaagggggtaaaagtttttgataaaaaataatatttgaataatatttgaatgtaaactaaggtggtatgctaactagacaacaggaaaataaagaccaattcaaaaccacatacttagaaaataaaaaattagtaaactaggtattacagaaatataacatatggtttaacatctatttcactcattaatctaacaaacctgacattaaaatatctatcttaatggcattaagaaattatgttatttttaagaataataatggtattctggctatgtttaaaacagtcttattttgttagaggtatacatgagatacttacagaggaaatgacatggcatatggaatcagctttaaaatatcgaggtggaaagggcacaggcagaggtccagaagaccttccactggccatttgttgattgctgaatctgggtgatggggacatggaggttcatcgtactacttattctctctattgtacatatttagaaactctcataacaaaaagggaaaataaagcttttaactgcctatacataaaagaaaagattttggctgtcacagttcaagttcattcaaagaactgtcaatctcaattaaaagactgaacaagtatatcacctgtcacattaaacctcacattaatctctttaaagattgtaaatcacagatccatgaagaattttccctccttctgttcctctctcccgccctcttttagttttactataataaccactgctctggggtttcagtagccaagtgagatcttttgcaagatacttgtatattcacaagacagatgcacagaattccacaggtttactgacaagtgactgaaggatgtccaatgcattacctctaggcactgttcacttctggcaggcctccactggaacccagtatcagcccaagcaaaccccaggggtcaattcatagtattgtcactattgactgtcttccagctgcactgtgaacttcctgggggctagacacttggtcttaatctttacatcctgcacttagacttagcaggtacagaataaactttgaggaatgagggaacaaatctgtaaatctcaaagttagtgctcatcctaacactaaatatcttcaaatttttcccaaaattactttaattctactattgcacatttgttaataaactgtttctgaaaccacagtttgagttctgaagccaatttccatgtgaataactaccttaatttataagctaataaattatcttaatttattgttttcattaaagaaagtgacaccctgtggctaatcaaagatttaggagtcacataaacaggaattataattagcatgaattcataattacaaagaccttaacatttattccatatttattgtatggctagcactgttatttcatttttttctcatacaaatgagaaaaaaaacatattgttcccattttatagctgagcaagtagacttcagaggttaggttacttgcccaaggacatgcagctataagtgataaaggtgagtcaaacccacccagtgtgtctaacagcttttcagcagcctgagtgatggtcttcctttcatggttgtagcagacttctccccaccatatgtattttgcacagaaaactcagttctgtaacatggagaggtttcaacttgatttttctgttgttcctatatctttatatattacaagacaagaaaccaaacaatggaaaacaagtcacttaacctgtttgccttgtctctgtagtaataatagcttactcttatatacagcacttctacgtaaataccaggcacagctgtaaaccctttatgtgtatcaatgcagtctttaaagcaattcaaagatgtaggtcctattaatcattttcatttttcagagagggaactgaggctcagagaggtgagataacatccaagctagcatttcagcactcccagtctggctctagattccatgttcttctttttctctttctagagacagagtcttgctctgttgcccaggctggagggcagtgatgtgatcgtggctcactgcaccttcaacctccctgacgtaagtgatcctcccacctcagcctctggaggagcttggactacaggtatgcaccaccacaaccagctaattttttaattatttgtagagacgaggtctcactctgttgcccaggctggtctctaactcctaggctcaggcgatcctccagccttggcctccaaacatatggggattacaggtgtgagccaccacacctagaattccatgttcttaatcatctgctacactgcctaatatgtacacatatatttgggttaatctaaaatacatggtttaaagattaaaccatgtttatcccctaaatagtagcaaggctattgtccacttacttttttttaggtatgttttatagtcaatatcaaaatcaagaaaattacaatgatcaacattagtttactgaagtagacattgttcttttacatctttatcaccatatagaaaatttttgatacatgatatatactgaaaaaaactcaaagaccattttaaactcaataattagatttatcaaatcaataacatttctggggctaattaactctaataagagattatataaattacagtaaagagtccattggaaaatccttaaaaatgaaaaacagagtatggtcagtctataaacaatactaactttaacaacaggaacagaggctcccagcactattttaaaagacaaagaagcagcctttgtttaaaagacaagggcgcagtggctcacatctataatcccagcactctgggaggctgaagcaagtggatcacctgaggtcaggagctcagcctgggcaacaagagcaaagtctgtctcagaagaaaaaaaaaacaaacaaaaggagaagctctgctcctttgttttctgttttgttttgttttcgtttgtttgttttttgagacaaggagtcttgttctgtcacccagactggagagcagtggtgcgatctcggctgactgcaacctctgcctcctgggttcaagcaattctctgcctcagcctcccgagcagctgggattacaggtgcccaccaccatgcctggctaattgttgtatttttagtagagatggggtttcaccatcttggccacgctggtcttcaactcctgacctcgtgatccacccacctcggcctcccaaagtgtcgggattacaggtgtgagccaccgcgcccagactctcctttgttaaaagaaaataaatacagacggttaagtatttcacaggtacaaacagatcatgtctcgggagatgctcacatcttcaaaatcggaacagatacacacaccagaaccccatgtggattctctgcatcaccacaaaaacacaaagagttacaaggagaaaatgcagaggctccataaatggatggtttccacaagcactggctgagggcctactgtgtgcaaagtggtacaacagctgctaaagacacaaacactggtggaggcatccttattcatctcacatccttagcatggggcagagtagacagcaagaacagtaaacacaagtctttcctagatggatcaccggatttcagtatatgcaggagttgcctgggggaaagaagactctcctagacagaagaataagtgaggctgagcagggaaggacgcactatcacacgagggagctgtcaaggttctgacatctaaaggtaaacacagtaccatccatataattttagatgccttgttattcacttatttcagtttgctctgagcatattgttttcaccaaaaattattcgaagtgaatctattgtcacactctccagtgtgcacagaaataaacattcctcagcacacagagcactgccctcagcaagctgttccgctcaaatgctcaaaaaacttttgtgggggaggaggaggaggacagtgaagtgtctaatcattcaaaggaagagtttctctggaattacttggtcatgaaaaaaacgcaaacctacttattagctggtggtaggaccctctaatatttctctcaattaaaacaaagtgtcccagctttcccaatattcttcaatccaaccctaaaacaagagtgacaggtttctgagtatggtcgaatgttttccaccagttattagtactaattttttctgaacagacagttgaaaacagatttatttcacaaacataaacataatttcctgctatatgttctctgaatacagagcacttgatactgccatactagcccaaactgtcctattccagaaaccagtgatgttttcactctgttccttctacacaaaccgaatccactacaggaaagccaagctgcgtgtgactttcatgaaaaccttttttaaaaaacttatttgggctattccagtgttaaatttgaaggaaaaaaaggtatacagtaatataatataaacctacttaccacaagtctgaataaacaaaacaaatttgttatttagggtgtaatacaagacaaaatcctctgaaggtaattattaatgctgaaacaagacaatctgagaacagactgaatatgagagaaactaacaagtaaaaaagaaaaccaaataacccactcttccctaccacgttgccaccattctccaaaatcacttgttatgggcaagagaccacagaacaacttctctttaattttatggtaacatttccagttgtaactgacattttgtctcacaaaggaacaaattaatggaatcagcaaaagttgcagggaaaatgtcgctgctgaaaagtgacccctggaaaagaagaagtagctaccagagctgtgggacctggaggccaaaacagctttcagtgtgacatatgttttctctttgagttttatgagaaaaacacttttcaaaatactgtctggtccaagatacactcagcaaattatactcatggaggggaaaaaacactgtgcagataaccacaacttaataggatgaatagatgtgggaggtgcacctcatgagcttttgagggggacctcccagaagagggagagatggggcagtttcagagggaaacaggaaatagccctgtgaggtgaagagcataaagaaatggactccatgaagaagggtcagtgtgcacaaaagctgatgcaagatgttgcgctacgtgctgctggcccatgagctgtgagacacagaggaggaggagacacaagtatggccctcgggatgacttttgtctactatggtaaagagcctagacttaatcctagaccacagttttctaagatattataggcgagaccatttaggtgggcaaggacagttttatgtgtttatggttgctattaacttctttttccttttttttttgagacagagtcttgctctgttgcccaggctggagtgcagtggcactatctcggctcactgcaacctccacctcccgagttaaagcgattctcctgcctcagactcccgagtagccgggattacaggcacgtaccaccacgcccggctaatttttgtattttttattagtagagacagggtttcaccatgttggccaggctggtctcaaactcctgagctcaggtgatccgcccgctgtggcctcccaaagtgctgggattacaggcatgagccaccgtgcccggcctatggttgcaattaacttctattcatgtcaagtgatattggttttccatttataataataaatgtattttaggctggtagcagtggctcatgcctataatcccagcactttgggaggccaaagtggggagatcccttaaggccagaagttcgagattagcctggccaaagtggcaaaaactccatctgtactaaaaattaggtaggcatggaggtgtgtgcctgtaattctagctactcaggaggctgaggcacgagaatagcctgaacccaggagatggaggttgcagtgagccgagatcacaccactgcactccagcctaaatgacagagcacaactctgtctctaaaaaaaaaaaaaaaaaaaaagttgtgaaagtgaggctcaaatgactgagacatcgctgtaagaactggagagccactggaagaaagcaaagagatacaactctgttacagaactccatccacacagacgacatgtattgggtgctatgccaatcactattctaggcccaacagatagagcagagaaaagccagataaatgtatgttaggtttacattttagacaaaaaagaggatccaggtcacaaataaaataaacccaggtaaagagagagagagaatgatatacaaagtaaaatgtggagagccttgagaaagcagcagaagggaacgagccaggccaccacctacaggaagagcaggacaggcggtgggaaaagctggaggcctggttgggcctatgggcctgctggagggagcaaaatggctgagagctgcagcagaggagccaaggccagagagggagcaaagggctgggccctgcagggcctcgcaagccaggactcgggaggtattccacatgtgatgggaggccacagagagtttggcacgaggaggtgatgctctctctggagggtaagtgcagaggcaggaagcccagggaggatgcccgcacggcagcccagaggagagacaacagtgccgagtgtaggcagtagtaggggaggcaggaagaaacggtgagaggcagtttgtgggcagcactggctggatttactgaagaactgatgtgtaaggcaagagaggactcatgcagcatttttgttgatgtctcttatagcctaagcctggggatgaacagcgctatcatctaatgaaatggagaagacagaagagccaagaagcaggcaggatgagactcaagactgcagattttgacaggttgagtttaagatgccagtgagcaccatcacaggactcttgagcggagagctggataaaccagtctagaatttaggggtgaggccaggattggagccaatagcattgggtggtatttaaagccttgggactgaataagaatgcaggagagaaaaggcccaaggattaaccccagaggcacttcaacatctccggtgggaaggtaaagagcttggactgaatcctgaagtgtagttctccaagtgtagttttccaagatattgtagccaacataatttgggtggtaatgtcagttttattagtcatgtgtttacttttacaggcaaaagggattaaggaaaagaatagtgaagtatgtggacagtacgaacaactgccagacgattctgcagagaggtgagcactgatggtgcagaagagagaggacaacgctgccagagcaaagcccttaggcaggagagaaggaaggagtccagcgcctacactgaggggcttgctgtggaagcagggacagtccccacggtgccagcgaggaagccagagtaagccgacgctgggaggagggggtgttagtgcagggagcacagagcccttctcttctgactgcttccagttcctcagtgaaatcagaggaaagcaatgaggaatgggatcagggaggggatgtcccagtttgagaaaagagcattctcctagtgcgcagaggggaatgtactaggattgccagcctggatgaaggctttctagtgaattgtggacaacatctgaagtgagaactcaggaaaggatgttatgttttcttctagctacattcagctgctcgggggcatacaccatgcaggcaggatggaatttaaccaattacattttttccagcaacagagggagagaaaagtaaggaattattgcatagtactaaaaaaattaatgacttatatggcaaaatattgagtggtcatttcatgctgtaaatcaaaataagttctagattaagtagagttaaagtaataagtaaactataataaaaactggaagaaataacaagctaatatttatttcttaggattgggagagaatcttccatgcagaaaagcaatggaaggtatcattaaaaatattcatttgatgcccaaaaggtatgtgaaaaaaatgctcaacatcactaaccatcagggaaatgcaaatcaaaaccacagtgaggtatcatctcctacagtcagaatggccattatcaaaaagacaaagggtaagtgttggtgaggatgtggagaaagggaaactcttagacactgttggtcagactgtaaattatctcagttgttatggaaaacagtatggaggtgcccccaaaaaactaaaaatagaattaccacgattcagcaatcccactactggatatttaccaaagaaaagaaaatcagtattttgattagatagctgcactctcatgtttcttgcagcactatttacaaaagccaagatatggaatcaactaaatgtctatcgacagatgaatggataaagaaaatgtggtatgtatacacaatggagtattattcagccataaaaaagaacaaaatcctatcattttcagcaacatggatgagcctgtaaaacattaagtgaaacaagccaggcatagaaagacaagtattgcatattctcactcatatatggaagctaaaaaacttgactgcatagaagtagagactagaatagtggttactagaggctgggaacggagagttaaccagatgttggttaacaaatacaaaattacagagaggaggaacaagttcctgtgttctatagcactgtagggtgactataacaatttattgtatattttcaaatagctataaaagtggattttggccaggtacggtggctgacgcctgtaattccagcactttgaaggccaaggcgggcagatcatctgaggttaggagtttgagaccagcctggccaacatggtgaaaccctgtctctactaaaaatacaaaaattagctgggcatggtggcaggcgcctgtaatcccagctatttgggaggctaaggcaggagaatcacttgaacctgggaggcggaggttgtggtgagctgagatcgtgccactgcactactccagcctggccgacagagtgagactccctctcaaaaaaagaaaaaaagaaaagagtgaattttgaatgttctcaatgcaaagaaatgtttgaggtgatagatatgctaattatcctgatttactcattacacattacatatatgtatcaaaactttacagtgtaccacacaaatatgtacaattatgtgtccatttaaaataataaaagcaaaacaattcatttgaataaaaaatattacacttctgtgtgtaataaccacgcaaaattaaaaggcaaataattagttgaagataaatatctgcaataaatatgacaatttgaaacccttaatatgtaaccccttcattcaaatctacaagtacactaaaactgcaactgaaagcagccagaagcaaaaacagttcataacaacaataaaaagccgataaatcacattttacctcccgtcacacctcaaacaataatcaaattttatttttgctttcatattagtaaagacaagaaaaaaatactcaggtgagggtctatgaaatagataaagtcacagacattgctaatgaaagtataaactggaacaacccttctaaaaagctaacgatgaatacacaccaagagccttaaaaaatgtaatacacttaggctgtaaaaaattgtggccctatctatgtacgtatagagatgcttattacagcacaagttatgcttagcataaaactggcaactacctaaatttccaacaataggaaaacagtatgttaatgacatgaggcaatgctcatttcataaggggaaaaaacaggaaacaaaattgtttgtatgctattccaattttggatgatatgtctatatatgtgtgtgtgtatataaacctcaaaaatgtttgaggctattgcagactagtgattcaatttttttcccagaagctttttaaattttcctgtcttcaatggggatgcattgcttttacagttattttaaaaataaagactaggggcactttcatgttaaaaagatctgggcattgtagttaaacatgagctgactggcagaaaaggtgactaaaaagctatagtcacagtcaccgtttctagaagactgtgcaggtacaaacaccatttttatatggggtattggaaaactagcatgggtctagacaagaatgaccaggagaataaagcatctacaatcagctaccacgaaaagaaaaggtcaaggaactacaactctgaagccttagaaggttggtagagagtgtgaactgtcaacacaccacgtaaacaccttcaggactgctcataaacggactctacatgggacgaggtgttggatgacaggacttcaaagtttttctaagatacaatggctagaaagaagtagaaaaggggagactgccagaaattctttttctgttttctttttttagacggagtctcactctgtggcctaggctggagggcagtggctccatctcggctctctgcaacctctgccacccaggttcaagcaattctcctgcctcagccttccgagtagctgggattacaggcacctgccaccacgcctggctaatttctgtatttttagtagagacagggtttcaccatcttggtcaggctggtcttgaactcctgacctcgtgatccacccgcctgggcctctcaaagcgctgggattacaggcatgagccaccgcgcccgactgttttttttttttttttttttgagatggagtctcgctctgtcacccaggctggagtgcagtggtgagatcttggctcactgcaacctctgcctcccaggttcaagcacttctcctgtctcagcctccagagtagctaagactacaggagcataacacgcctagctaatttttgtatttttagtagatacagggtttcaccatgttggccaggctgttcttgaactcctgacctcaggtgatccacctgccttggccccccaaaagtgttgggattacaggcatgagccatcgcgcccaggcagaaattcttttaaaactgttacgcagaaatcagcatctgcaatagagaagatttgactttaagaatggtcaaatatttcctgtccaagggggacacagtgtgcagaggggagctagaggccttactagtctttcttctaatcctgccctgagcttcaacccacatctcaaattcagaggaatctttccagggttctgcagcataaatcagcatcttttttttttaaacactgggttttattcttagaatagccctgtattaaaggagcattacacagcaagaccaggaagcagttcaaatacagttaaagatgaaatctcaatatgctacttagctattcaaagtttgcggtatagaaagagaatgggggaaagggactggatataaatgcaatacctaaagaacactgaacactatggaaactcaaaacttgtctaaattctattgtttacattttagcacgtcccaggaatgactgtggtgaagtgagaaaaacacaggttttgagggcagacgttcctgggtttaaatccctgctgaaatgcttactagctgggtgacttgtttaactctctaagtctcaattttctcatctcacagggttgttttgatactacttgagatactgtggtactaactatgaaatgcaaagtacagagctaacacatgtacatgcctaataagtagtttcttttcactaatttattagagttttaatagaaataaacagaattatacttatatacctataatggtatgactgatattctgtgccacattaattttactaaatgaaagaaaaaaatcctggtggttatttattttttgatcacatcattgcaattactacgataattcttattacatatacttttattttcagttaaaaataaacataattagaactgatgagtcatcttcatgtagtaagtttctgactgttcaattccattttatctaccatagtatttatttcataggttttcaaaactggaattagagacttgaaagtgaatagcatattattaagtatcctatgctactcttttatacaacactttaaatgattcttaagaatacaaagggatattaaatagttcaatattattccaatgcttctttagttatttcccctatcttagggtaaacaccattttccttctcaaataaaaacaaattagccaaatttcaaatgctgattcattttattttattttagagacagggtcttgctctgttgcccaggctggaatgcagtggtgccatcatagctcactgcagcctcaaactcctgagcctcaagtgatccttccacctcagcctctcaagtaggtagggttacaggtgcatgccaccatgcccggctaatttttaaatttttttgtagagcgggggtctcattatgttaccctgggctggtgtcaaactcctggtctcaagcgatcctcctgcctcggccttccaaagtgctgggattacaggtgtgagccactgctcccacccatatacttatatttatgctataggcatacctttacagggaaagccagatgaatatttaagtaggagtgagagtttctcagctcagttggccacttgacttctcccctactctagaagtttataaaaaccattaggcaactaccaatcttctgagaaaagtacaaactccatcccagttgccttcaacagtttaatcagcagagctacaagatcccacaggttattttccagcacacacctctaaaaagctaagacaaaatcatgaagctccatatgaattcaacagacaaagtctcttgttaaggctgacagctaaaattttcaaagatttctttttgtggttttaaaatttagttttctgaaaggtataatttttgctgtcaagttataccatgttccagcaaaaaggtaatgaaacagaatagctgtatttattcatgataccaaacatttatgatagacaacaaaacgttgtcctgattcacttctaaaatactctattgctataattattgatcatacaatggtggtatatgatcattacaagaaatcccagaaaagtaacatttaagcatcacaaccctaatcttgatgctctatttttatgtagtttaatacctaaacaagctgttaaagtgccaattccccttcaatatagaacatcgtcttagagaatttcaggtcatgcccagtatgacaacttaagacatggtattagaataaacaatcaactccgtcttagaaataaactgtcttagagccaaaattaacaaacaggatataaatattttggtattacaggatatagatactaactttatttaaacactgttacataaatataagccagcttttaaaaaaacgaatatacacttaacatatattgacatatgagaaaaagatgagcagacacctcaaaaatcttgccagtatttaccaacaaatcatgattttcaaggagcaatttcttagatgaatgatctaaaatattaaaattgaatatcagattatacctatatgcagatctttactcttagaaccattatttaagataatgactgagagaagagaaaatatgtcatttatcatacattccctataagtaaatactttaaaaataaatgccaaagttctcactgataagttttttcctgaacacttaataatgaataagaatgtggtaaaacctctagttagaatttgattccattaatgctccaattttataatgaattcctgagctatcattttacttctgttaatatgtctatctaagcttgaaaggttttgctatgttatacatacacaggcgtgagagagggacacaaagaaggaacttttctcttaagtttgatataccttattcaaatttgtaatattaaaaagagaataaccttgatagatgagagacaacatgtatttctttttttttttttttttttttttcatttacagagaagtggcttctacctgacaaggcatgatgtatataacatgccataacgtatgccaactaaaagaaataacagggagttttaaaaaatgcaatcactattaaaaattattcctcagttaccacccccatggatagtacaataaattactcaacaaaaaatgcacagttaatttttcaggtattttttgcagtaagttccacaacttcaatatccttatatatgtatttatatatatatataaataccacacagagatgtcattaaaaccacagcctctggctaacagataaggaatacactgaagttatatgaaattatgaaaagaatatatatatatatatatatatatatatatatatatatatatatatattcaacctgtatgaagcattatgacatttttcaaaatccatattgaaaatcagccattttagataaatccatatagtaccatagaatgaattttaactttatactatctttggatatggctcacatatttaactctattaactgcctcttggaaaatgaacatactagcagcaagggatgccgaattagttttatggagctgtaccagcctcattattcaaatagctagtattattttcctggtattttatatttatcttttaatacaaatattgcttcataaaaaatgtcagtttgattaatttcacctgatgcatgaaaagacacatattgtaaaaaaaaaaaaaagtcctacatttccatgcaacattttaaacttattttaggtattaatttagtaattattacttgttggtaatagaaagaactaataatgctctcataaaaatgtactacttgtaggttcaagtcaagttgaaatttaatttctgctttttaataatatatcatctgcataccatgcaaatacagcaatgtatccaggcatggaaataaacatttcaaaggaaagcagcaaaggaaaaacagaaaataaagttccacctacagggatccctctgactattttcggtgagtcctggagatgacatggatgtgagacctgaaggagtgaacagaagctcagtgctggtcaagtgaagcctccagttaccaggcagctgccctcacgtgcatcttctgggatgtagaacaaaggaagtgaggctgaagccagaagcaggtttttccaaagaaattgtagtaagcctattagttttttgctgatggcttaagcagatatacattggaatctactgcctctataaaagcaaaatgcaagctctcaggggctctagtgtgcaaagatgtatgcaccggtctgggaccataccaaatgcagctcaaaatggaggggagggaaggctgaaaataactaaatccaacagaatttgtcatctaggtacaaagatgctttagtaacacagcaaaagagagatgaaatcttgctgtttgaaagtagtaacataaaaattaaaaatatagttcatttcataacacacaaggcatctataattttcccctacctcatttttaatgtagcattagcctaaaggttttttcaaattcagcaacactaaccagtggcttggaatgtgctatatatttttaataagtatcttaagtcatcaattctaatagttacaaacacttctccacaaatttttcctttttgaaaatagtatggtctaaatcccactcccgctggtcccctctgaatcacagctccatcaatcagccactctcactgtatcttcaacctctccctctctatagcttctgttcctttttcatacaaatatactcaacttcctcccaaaattaaaaaaaaaaatcctcccttcaacctaactctctcctctaactattcttctttccttcctttagccttagcttttgaaagcattgtctctactccctcattcatttaaatatttaataagcaccaaagtgccaagcacctgagtcacaatggtgaacaaggcagaacagtccactcattccaatcctctgccatctggtttctacccccagcacccccacacacaaacccatgctgctgaaagtgtcctcattaagatcaccaattagcttctcaggctatatttcagtttgccttctccacaacaatatgacactgcttcttgacatgtccttgaaatgttctccttatcacattttcctctttgcctccactatgggcaactagctctcttctcgtgcctgtctggtgaatgttggtgcttcctagatttctatgcattgtcaactttttttcattctgccctgttgtttgtgggcaacgtcatccaaaccccgggcttccattcccacctacatgctggctactctcaaatctagctcagatccttctcctgaggttcaacagcccattggacacttccacctataatgtcttacagatactgcaaatttaacatgctcatggtgaaattcactcaataagaatgaaatattaaggaataaatttaagactcacatattgaaaacaacaaaactgcttagaaaaactgaagatggcttaaacaaacatggatacattccatgttcatggattgaaagactcactatcattaagatgacaattttccccaaattgatctatacatgcaacacaaccatccctattcaagtctcagtaggctctttcctttgttagaattgtcaaaatgatcctaaaatttatatgaaaagacgaaggaccttaaatattaaatagtcaaaccaattttaaaaagtagtaggttggaggacttagacgtcccaatttcaaatcttactacgaagctacactagtcaaggcagtgtggcactggcaataaggaacaaagttgagagttcagaaaaaaactcttacattatggtcactggtttcctacaaaggtgccaaagcaattcaatggggaaaagaagctcttttcaaaaaatagttctaaggcttgtgagggagacttcgggcatggtgcagcctagagccccaaggtctgccaaaaaatggttctgagacaactgaatatcgatacgtaaaaaaatgaaggtagacttttaactcacacgaacacaaggcttaactgaaaatggatcacagacctaaatgtaagagctaactagtgttgtcaaggatgaggagaaactgcagccctcacacactgctgataggaacgtaaaatggtacagccattttagaaaacagttcagcagtttctcaaaaagttaaacacaaacttgtcatacaatccatatattctagtcttagctatatacccaagataaataaaaatgtatgtcaacacaaagacttgcataagaaagttgatggcagcattattcaaaataggcaaaacctggaaacaatccaaatgtccatcagctgctgagtggataaacaaaatggggtatattcatacaatgaaatattaattcagcaataaaaaggaacaatatagtgactttttattctactcagtttcctgaatctgtgtctttccctccattctagcaatggctgaattcaaatctaatagtttcccaactgatcttttttagtctagacctgatcttctctaatctatctcctatatgattccagaaaacttgctttaaaatgcaaatctgatccttctaccctgattgaaacccttgggaatatcctactccctatccggactctatcagctacaataacctttgagctctttttaatcatgcacccctgacatatgcatgaattcctgctctaatttattacataatatacagaaaattgacatttaaaaggatgacataaaaaaacaaaaattccagtttcctctctcctcctaatgctctgcatgcccacattcctctttgaagaccactggcctaaagggaaatgtccaagttcctgtgtatggcattcaaggctgggtaccagttgttccttgcctctctgtccaacttcatccctcatcacttcaccccacacaccatatgcttcagccaggcaaattatttgtggctccttcaataaataagaaattaaattttaacttgtattcttgaaataaacatatatgcatctttacaactgttctttcctcttcctggaatgtctttgttatcctttctagcccagtgagtactcgtcattcagatcaagtgtcatgacctctctctggttaattactcccaccttagtgtacttatttctattatttctatattatattcaaattatatatttgcctttctaatctataagctttgccacagtcctttagctccctgaggacagaggacagtaacatcatccaacctgagtcacttaagtattgttcaatggcagctgaatagttttgtctcacacgttaagccaactcttgaagtgaaccaacaaattctactgaagtttaccacctagcatcatcatccctatctgtaacatgctaagggctgccaagccagtaatatgcataagccacatccacgagtcatccaaacaagtgagactcctcacagcctcagaagtctccaagtcagatgacttggtgccttctatttttactcaaatttagccatcatcatcactgggaattgctccccttctaagatttcaaactgaaatctcttctttgaccacaagatccacctcaaccactaaaagtgttcttcccctttacggggtacctcacctgtaccattcagcctgcttattctgctggtctggtcaggcctcccctctctctagtcagaactccacagccaatcatttcaatcatagtctcactagcatccatggttaccatgcctgctggcccatcttacatgtcttcccatttccaactctgtgttaaccaaagcatatttgttttgcttttttatttctgcttctgagcctagccctgaaaattcagattatcattccttacgtgaattctcaaaaaattatttaatccttccatgtcaacttttccctatattatcagccatcctttccttctctaaggtcttaggaaaagagacatccctggatactctccaaggataacctatctggataccacttctttccattttctttggtatcataatgactccttcaatatcttcaactatacctcccctgactttgacccggatcccatctcattacattttcatttttttctaccattcatgattgaatagttagttcatgtcacctttatttcctaactactcatacacttctttttttggagacagagtcttactctgttgccaaggctggagtgcagtggcacaatcttggctcactcactgcagcctctgcctcccaggttcaagcaattctcatgccccagcctcccaagtagctgggactataggcgcccaccaccacgctgggctaattttttgtatttttagtagagatggggtttcaccatgctggccaggttgttctcgaatgcctgacctcaagtgatccgcttgcctcagccttccaaagtgctaggattacaggcgtgagccaccatgcccggcctattcatacacttctgattttcaattcggattcaacctttacaaacagctctttcaggtcaccaatgacctgttcattgtcaaatccaacaggctctctccattcagctcaacttctctgcattacttatattatggataaccacctttcctcctttaaactctcctctgtagtttttttgtcactacgttgccttagtcttcctgtttctctgaccacttttgtcctacctcatccactggctctgctttccagagctaagtcttcaatgtcttatgtctttaaagactatgaaagcttatgtactctacatgtgcttacaataatggaattccttccccattaaaaatataaaataaggacttttatgatcctatcctctttttctgctgtctaatatttgagtgatgtcactaaaaattttaaatgaatgcagtatttggggaacacagaaaaatttcctactgccaatattaaaataagaacaacaactggtttcaataatcttgtagagattggccatatgcaccagaaggtgaacgtaactcatcaacctcaatggagtattagaagggagaatccagaacatggtggatgatattaatctacattactaactttgagggttactaatttggtattttggttctcaaaagttagttttcccccaatttagaaaagagcttctaaatataagttgaataaagcaattggaggaagtaacaccttttattttcctgcaacctgaaaaggaaaaaggcaatattcaaaaaataataaattgccacaatatgttcgaacaaacttttacaactttttttcttcactaatactttggaagagctattaaatttctgtttttcttgttatagggtacttttttttttttttttgagacaagagtctcattctgtggcacaggctggagtgcagtggcataatcttggctcactgcaacctccacctcccaggttcaagcgattctcctgccttagcctcctgagtagctgggggtaccaccacgcctgactagtttttgaatttttagtagagatggggtttcaccatgttggccaggctggtcttgaactcctgacctcaggtgatccccctcggcctcccaaaggaggcccttccaaagtgctgggattacaggcgtgagctaccatgcccaggccacgttttaaaaatattagcaaaacactcaagaagaaacaattttgaatgaacactgataataaaaatctagatataatgcaacattcaatttagggtttgttcatatttgagatctttaattggactgtgggtggatttgatgtgctgttaattgtacataattaggaatgtgtgtataaacaagatatttcagcctaaattgaattattctatcgggtaatatacaacactacctaaccttttgcaaactgctattctcttctttttctctgaatattgtcacactaaaaaaagtacgcctcagcactgagatgcaagtaaaactgacattttacataatctgtgtccctgccctgtcttttaatattaacttgattgtttttttcatctcttactgttatataagaagatactaaactagtcaaccaaaagaaaagaatgagaaggaaaaggcattttataaggatttcaaatcttattttaaaccactgattgaaaaaagaatgtatacaagtagtggtttacaaattgaattaagaacaatgacagccatgacaacacattgtatcacatgatcatttaacattaccttcaacaaactggccatgaacttaatcatttactagagccgtagtaggtcaaacagaaatccagccaaacaaagctgttcaataatagctataggaggaatatgcctttataccttttatcttgagaatttgtcattttttctaaatccaaacagatcacacatataaacaattcaaccataaatgatatacttggaaatctttaaccattcggtaaatctaaaggacaatgctggtttatacgtgaagtataataagcataaaacaacaaaatcagaagtgatttaataagtaattcaaaaagttttctcagttattgaaatgaatctctcgagaataggatttctactacttaattgctcatgagtaattaattgaaaaatgggaaactggaagaaccttgagctgctggaaagtttgtgtttttttctgtttttcactagtgtttctccatgaccagtaagggtcaacataaccaagaattattctctagcgtccctccttcaggcattccctaaaagtaaaaagtaatgctgggtgcttttggaatctcagaatatatttcatctgagcctctaattttacagatggagagagaaactgtgcctgaaaaggtaagagactcatccaaagtcacaagacagcagcagagcagggcccagcactgaagacctctcaggaggttcgagtgactgcaaggtcaattacaggggcacctcttgatctttgtcaccattccctttccacatggcccagactgtacaagagaaaccagaatcttcttaaactatgattctcaacaacctcaaagttagcactgcaccttcctaacacaccacttataaaggtcattagcaggaactctcacttggtacatgtgctaaagagaatatcaaaaccacctgtgattaagcaaaacctacaaaaaacagtattaagttttactgttttatgtaaactgattttaaaaaatgagtttgttcatcattgtcgagagaacatctgataccaatgaactctcaactactttaaagtgaagaattaacacaaaattacctttgaaggtttcaagttccttcctgtaggaaaaaaaaaaaaaagacaagacaatgcaaattaaaaatctccccaatgaaaactgttcttccatcataataaaaacttatgtactttaaatgcccacagtggtatttctggatcttcacatatcagttatactttactgaaatgaccagtacaatgagcctaaaccaactattttcagttatttctgctattttctattaatggctcaaaaaagttccaccagaatccaaataataatctaaacaatttcatctaaacaataaaacaattataagaacacagacagcattttaatcccagctatgaaccatctcatacatgtaagaatcagtttataaaaagcacttaacacaatttttccttgatggataaatattcaatactggatttttgagatcgttagttaagaattatccaaaatagaagcagttgttttccctttcaacagcaaaagagaaaagggggaaagtgcatatcaaaggattgaggtgcacagctcatgccacaaagggccaagcctctaggaatcttctggtttattattttgtcaatattaagtaaggatgccaaaacacaaagtttcctgggaagtgtacagtggggaaacatagattaaaataaacattttgtgacaaagaaagcaaagcaagttgttttgaggctttccctcacaattttgcagttacgtattttttttcctcattatcagtactaatgagtaattttgaggaaataaaggctggttatcccagttaaaatatgagacatttattttgtacttgcagtccaggttttactaaaaatctagagatgttttgaattcttaaatcaattttctacacacctaattacaatacccctcatgttccaaaatagctgactacactcaacagctgctagaagagactggcaagctgcctactgaaaggccaagtagataatgttcttgcaacagccaaagtgaaggttcttaaatcagatggtcatcccactccgttttttcctaacaatatctacttataataattatccagcaccatggttcataaactatgcaagaattttcaatcctattttttcaaaaacctgtgtggctgggcgtggtggctcatgcctgtaatcccagcactttgggaggctgaggcaggtggatcacctgaggtcaggagttcgagatcagcctggccaacatggtgaaaccccgtctctactaaaaatacaaaaaaattagccgggtgtggtggtgggcacctgcaatcccagctactagggaggctgaggcaggagaatcacttcaacccaggaagcacagttagcaacaagccaagatcgtaccactgcactccagcctgggtgacagagcgagactctgtctcaaaaaaaaaaaaaacgaaacaaaacaaaaaaacaaaaacaaaacctgtgtaattgtttcccttcagtcaataatcaacttcattcttaaaagcttagctaggtacaagctaaatatgcctaaaacctgctttataccccgataataaaaaccagaatacaacaggaaggcaatatgtatcacaagagaatctcaaaaagatatcttcaatctacttcttagtgacatcctcacattagcaattccccgacgtggggaaagttgacagaacactcagttcaatattctaatgagtaattctttttttttttctatgattacaatgtttagagagcttctaattttcttcttttagaatgtgtgactgtgagcagaatttctaaagggctctcttgttttaaaaagctgaaactcagaataatgatttcacagacactgttattctcctacccccaaatactaacaaccataaaaacaaggaatccagcaactactattaaatacattaatgagtgagtgtgcaattgaggagggcggttttcctgtggactcatcctgctcaccctgcaaccgtctgtctgctgctgtgaagaggacaagcccagcatcttctgggcatcctctgtcacacagcgtcatgacccacaactccacaactgtcagcgaaatttccaggaaacttcccttcagaaaatcattcctgtacccaattcctaaaacagatgactgcttgaagtagtggtggtacaaataattggtttaaagaaaaaaatcagtattatgcaacttttttttttttttttttttttttttttttttgagacagagtcttgctctgtcacccaggctggagtgcagcggtgtgatcttggctcactgcaacctctgcctcccgggttcaagcaattctcctgcctcagcctcccgagtagctgggattacagccacccaccaccacatgcctggctaatttttgtatttttagtagagatggggtttcaccatgttggccagactggcctcaaactcctgacctcagttgatccacctgcctcggcctcccaaagtcctgggattacaggcatgagtcatcgtgcccaaccagtattatggaacttttaaggaactgatgaggtaaagcagcagcactgaaagccttgaaatttcacaattgttagggtgtactccaccatctgttagaggtactcagcatttggaaatatagaaaatgtaagagaaggcagggaaaggcatgtcagtcacaggcagcagtgactgtgaggtcacagaggccaaagacgacgcaggttatatttaggaaacagacttcagaacagcaatacttcagcaagtacttgtcctggagcaaatacttcagaacagcaggctgaatgaagagaaagtaattcagataaaaaggtagagagttctcagtgccaggctaaaatattttgttttatttttagcaggagaataacatgagcaaagctgtattttaggaagaacgttctagctgtgatggatggatatactggcaagggagagaataaaagcagtgagtacacaggaaactcacgttgggggcacgtggggaagagctaattaatacttggcaagagcaatgttaagtggtaatgacaatgaaatgaaggattccaatttgaaaagtatcataaagaagactcaacagcccaaggcatctgactcaatggggtaaggagaggaaggagacaagcatgctaaccggggcagttctagtctggatcataagaaggaaaagattttggagggcaatgcatgagttcggtttggaaattgctgaaacaggaagactgaaagctgcagacaggattcccatccccttcagcctactcgaggatttaactcctacagattcctactccctcgcttcgcattcactcttgaacccattccaatttggcttctggaccccccattacacaatcaacaccaccaacaatcatcatgttgccaaatccagagaccacttctctgttttcatcctaatccttaagcagcatttgacccaactggtggtttcttgaaacagttccctctagtgttctcccacctcctcagtttcttttgctattgtctccatcccttccagaccaccagatgctggagtgctgcaggcttggttctgggccctcttctctcctcagcttacattcgctcataagccaatttcatccctagctttaaatgccatccatatgctactaacttcctgattacatttcctgtcttgatctcttctttgagctccagactcatatgcaactgcccatttgatagctttatgcaaaagtggagtaggctactcaaacatttgcaagacagcctgttcttctccagtcgacgtcatctcagttaatggcattacccggctcctcaagttttggctcatccatctccctcattctccatccaattcatcaataaatcctgtcaattccatctcaaaagatagcctgaattgatccacttctctccatcgtcactgccatcaaccttatataaatatccattttcgtatactaaatataatcttggttgagttcaatcattcattcaacaaaaatttactaagccttagacactatgataatgttaggaatagcattaggaataatgctaggtttggaatagacatgttccataacctcaaggaactttagtgggagagacagagaaataaagcaataattagaaatcaatgtcatagattatagtgctttggtaatgacatgctgaggattctctaggaataaagaagagaggacaactcatacacttaggtttggtaggaaaggcctcctggagaagcaaggactgagctgatgcattttcaaggacagtataactgatgatgatgggcaacatttatcgagaacatggcagatattttactcttaagcattaagacatactctcagctaaccagatgaaaaagcatgggtaagcaggagttttaagttccagtcactctccttcaaactgtgttattagcataaaaatgctaataataataattagtgtaaaacagccttcaagttcatcttttccaagaagacttcattgacatccaatcagtgatctctcctttatcaaaaattctgtagcactaaactctatcaatattatacatttcatgtgctgccttgtaatgtggttctgttcatacaggtatcgtctctacagttcctgaagtgcagagactgcatctcttccatcctgcatcacatgcgtgcccagagttggacccaacagacactcagcaaatcatgattaccaagtactgaggctgcaggatgactaagatctgcttcttcaaagaggccattgctgtaataaaatatagattttatttttgataaagtttgatcaaatattatctcatttgaaacaacttgtttgttgcttgcattttctaaaaattgagtttatttccatagtttaatagtattttcagaagatcaaacaaaaaattgaaatgtctcattttaaatgttaacatatttcaaaatttactcaattcagctaatgcctttacaaaatttagcataaccctaaaactaaaacattcaaaaaataacagcaggatcaaaagctaataatattccaaagggtgaaactgctattatttaatcattttctctccagggattgagttataaagaataaaaatgaaagaaagaatcacattaataagcctatggaatgttacaagaagtatattaaatctatatatatgagtagaaatcaactagctcagactgaagatgaaaacttaatagacagaagctactggataaatgcctccataaacacagataaagcaaactctctctaaatcctaaactgcctccctaggacaaatccatgataaaaggctaacacaaaataccacattcaaaacaccaactgcaaattgcaccctaacatttttcttcatgtgtagaaatgtttaggggaaattttttttaagcatgatcagcaatactcttttatagaacattcctgaacagtgtccctttgttatggctgatggacagaacctattactgtgactacttgttcctgggaaagatctcacaggcccactctcaagaaagaagcatctaccattcatcaccaacaagtcagaggtctgttgttttccggcagtccacagtcctgtggtgccaccctacaggcttggtggggttgagggggattgggggtgggtggtgggagggacctccttccagcttgagatgaattttctcaggactctctataccttaaaagtctctgttgtcatttattcttatacaaaaccagcaagacattctcaacattatctttaaaataaaacctcttaaaaagcagccagttcactgtaaaaatggcattatatccttatttattatgctattaatataaattgtatatatctattttgggcaaatacagccaagaaagtaacaagatgataagattccaaaatcttggaatttaaagttgaaaaggatctgaaggatatggtaacaaagcctggaatttaagaaaaatggattccaaaaaagataatgaaggtctacgcaggttggcagcactaagttatacatggattacattccatcccaccttgcaagaatcatttccctaaacctattttacatgaaaatctatttgatttagaagccatgcctggataaagagaggttgaagcaagtaggataaggaaagatgagacaggggtaagggatatttattgagttcctactgtatactccacaatatgcaaggcactttacacatactgtctcctataacttgtaattacctaactgtaggtatcatcaccctcacttaatacatgaggaaaatggggcttgaggatggaaggccacacagatagtaagtgacagaactgggaataaaacccacagctgactctgcatgtgtatcatcttcagcatccagaatacagttcaagggtcaagtttagccctaacagaaagttacttaagtagatcactaaatctacagaattccagagtcagatatgtgaaactcagagccaccccaaaacatccaggcaacatctgggtctacctagcttggggaaagtacattatttttaggaaactaataaaaactaacgttgaaagccaggatcgttgatgtatgcatgaggtaaaatccccaacatagccctgaagacatgtcgtggttttcaaaaataagcctgcaaaaaacacttttattttcactggtgtactagtgtttaatgactagtccacagcaactaattggctaaaaatctttattacaaatttaaatttaaatttttattacaaatttaaaaaatttatatcacctttgtgttactgatttttttattcaaaattcttagtggctagccaattccttaaagagccatcctaccattaattatcaccaaatcaatggtttgtcatttattagctgtctgcagtcatgccccaccacttgaaactgtatatccttacaggcttgttgccatttatagctgatagggtagaaggtggattttttttttttaaactcatgcatcccacatacaaatatattcctgatcaagcggcaccaggccctaaaatctcaatccatccttacattgagtcacccacagcagtccatacacgcagagaagcaaggtcctttccatactccatggcacccaagcacagagtacagatggctttgtgtggaggcagtttactatcaaagatatgaggagactttgaagtcaggaaaacattggttctggcccagcaccgctacttccaactcctgacaagttgttttatctcccctagtctctcttttcttattggtagagaagagagtacacctactcaaatggtcattgtgagacttccatgagttaatttggagtttttaagcagtgtctggtacatattaagtgttcaataaaggctactgctatagtcaccatcatcatttaattttttttatcttgacgatcagaaatcttaatatctacatttgggaaaaaatgagcactctaacagtaatataaatgaagggacacaagactacagacagcaagactaattaagaggctattagtgtaactcaggctacaaagacgtgggctagaactccggaaaggatcagtgaagacagaaaggcaaggacagagtcaggaaatattgggctggactgagaactgagcaggtggtaggagaggaaggaggagattatgaagactcccatatttgtggcctggataaatctgtagtgatggtatcttattagaacagaaaaaggtcaggttttgctgtggaagacaattttgggcatggtgctgttgagaagtccaggaatagctgtgtaggtggcaactggttctgcaggtaagaagagagacctgcactgaatacagtggtttgataatgatcaccttatggctggcagatgagccaaggatgtagaagagcatgcccaaggagggtctgcagaatgagaggaggcaacaaccaagaccagagcacaagtgaacaccagcattaaaacatttacaaagaaaactaaaatgaacctgaggcagagaagaacatctgggatactggtgttgaagtcaagagaggacagtatcaagtcaggtaaataaagattgatttgtcaaggaccttagttacttaaaaagctaagaaaaacataggttaaacacttcaaatgaatcatggatttgttctctaacaatgttttcatattatacaatgttgatgcaatctttctttttcgacaatattttaactgtggtatgccatgtaccttgcccattcattttaattaagaaatattcttaaaagttcattatgaggtaaaatcgtgttttaactttccccaaactagtccaatgttaagaattttaaaggatactttttagcttttaaaaacccatgtacagcaaaaatattgggatcaactaataaattctcaaatctacctgaattaatccttaagaactgtaacttctattttctctgcctcaaaagtaacgtgttattttatatgacaataatgcacttctctgatatcagttataataagaattggtcctaggccgaggcagatggatcacctgaggtcgggggttcaagaccagcctgaccaagatggagaaaccccgtctctactaaaaaaaaaaaaaaattagccaggtgtggtggcgcatgcctgtaattccagcttctcaggaggctgaggcaggagaatcacttggacctggaggcagaggttgtggtgagctgagatcacgccattgcactccagcctggacaacaagagcaaaattccatctcaaaataaaaaaagaaaaagaaaaaaaaaaaaagggtcctaaacagaacataacatgaaacttccagagaggaaggaaaatgttgctatctttgggggaaaatgtccctctttgaaatccagtatcaaacctctccagtagcattagccgggcacaataattcaaacctgtaatcccagctacttgggaggctgaggcaggaggacctcttgagcaatataccaaaaccctgtctgaaaacaaaacaaaacaaaacaaaaaactatctccagtagcaattgtttcaattcctttgaaacaattatagtgccatttttttttctgagccagaatgaaagactagtaatagtaaaaggcaggcaagaaaaagagacctgcttcttagccatagaaaaaacggggccaacacagccatgctagagcactgcccagagagggtagagaagggctgcagcagagaggaggagcactgttttcttgttgctgacttcaccatggttcttgcttaccaccgatgtcagagcaggtatggcaggctgccaggtgtgcctctgcctgtcccagctctcatatccgtcaagaaaaccagaaaagtgagaaaagcatagggtaatatcatggttttagctacattcaactgaagactaaaataactgataaattttatacttttgaaagtatctttgaaaaacacagtaactgatggaacataaactccaacacaactatgggtcataaaaaacataaaatattattccaaatgtaataaatgaattctaaaacactgaaagttattacagactctaaattataatgtacaaactataatcaatctaactttggaaaaaaggattacctacttttcaacccaggataataataattttgctttgcttaatttcaaaaaacttttctcgagattgctatatctttagtctctgctcctctccacctcaaagatacactttaggttttcatgcctcttaaaaacaaaaagcttgaaccccagcgtgtcatttgcataactggaggaaagagataacgaaaagaattttgtaaaccagttagagagacatttattatttaaaaatggcaaacagatactcattgttcaaaataaagctttatgaacttaaatatcagtcctaaactctatttactgtcaacccaaggatctaataaactgttaaatattctagctacatctgttctcgtgactacacataaagtctgaaactgccaagatttattctctaacagacactttagagcaaaaattttgttaagttcaattccttgccaactcataagcttaggtttaattttaaaagaaaatgtaaggtgtgattacacatttatgaagccaacaaattcatagctctcagtctgttttcaagaggtcattggcctagtaaatgtgattacattataataaatacaataaaataaaaatgtcaatttactttcaattaaccacctgggaaccatctaaaatctagcatctaatagggagaggggggagtaaaaggagaaaatggagaaaagagatacaagtttcagccttttttatattttccatgtctctacttcactttttgaacagaatacagttacaataacaatttttactgtccttgtcttctaattctaatatctgtgtcagtttttaatggctttgattgactatcttcctccatatgttttcctagtaatctttgattagataccagacattgtgatttatcttgtttggtgctaggtatttttatattcctataaatactcttgagctttgtttgttatacagttaatttacttggaaacagcttgattcttctgatgcttgctttatgatttgctaagcacgtcttcagcagtattcagacaaaagccaattacacatcctactgaggcaagaattcaccgagtccacttcccaatacctcagtaattatgagttttcccagtccgactattgggaagaggctctgtgtgagtgccaggcactgttagctcaccctcttggatatttttttccctcctgccttggatagtttcctcacctgtattatcaggtgaatattcatggagaccctctcagaaactctctcctctctgggactatgtcctgtaaactccagctgccttgatctccccagatttagctcttcaactctgagtctgccaggctctgcctgggtccacttccctgcagtgcaccctggaaactctctctaggcaggatgcagaggcaatcacagggctcacctcacttgtttcctatctatcgggtaccatcacatctcttctttgtccaaaatccagtgtcttaaaaacattctctcatttatttcacctggtttttcattgtttcgggggagagaataaatctggtccctgttactccatcctggtggatgcagaagtctgctccctttttgtaaagtcattgcctgcggaaaagttctcctgctccccttttcattcagcatccaaacagacttctgctgcagaactgcagaagctagttactgccctgctgcttggctccttcagagaaggtgctctcgatcttctcttttggttccagaagaaccaaaagagatcgtttttggatctttaccctggagaatgctgttggtttcttctctcccattctcagctccgcaaagccaggcctgagggccacactcctgccacacctccccttctccccagcttgccagtctcttggcaggtgagcttgaacactcatttcttgaagctcaggaatttggcaagttagtctctagaacatacactggtcaaacgccactacagatacgccataatctcttaaatatatctgttatactttgttctaaagattttctaaatatagtccatagtccaaatgttaccaaaaaacaaaacaaaaaaacacaaacaaaaagaagggcagagtcccttggcattaactatagtagatatataaacataaagcaaaaagaatcaggacccttaaaatatgcataagcactaaatctcatcagaggcagcagcgaccaccacttctaggaggtgggttccaggagacaagcaaatttcaaagtctggataaatcagtgaaaaatgtttctggagtcagtatgcccctaagcaggtttcgagtccaacagaagactatgttaaaattatgagtcacttataattaacaagaattgctaaaatcactgttcttcaagatgttactatttttggagaaattctgatggtatgctgtgtactgaaggggaaagcataagtactgaaggagatgcataagggatctagaaacttggaaataagaaatattttaatcaaattacacacttatggatgatttcaagtataactaattattgtgagagaacttcaataagcactctaaggattatggtggcactggaaagattaaaaatctagaaggttgagattctatacttccatttagctctatctctaaacgtacctactgttcatgactcggggtctttgttcccactgttccttctgtttggagctatacagtcctagatcctcatatgactgccatcttactcaaacctcttctcacatatcttctcagaagagcctgtcctgctcaccctagctgaagcagtcctcccctgccttaccactataccattactccattttatttcctttgaggtttatattattgtctgaaattattctttttttctttataaatttatcatctgtcttcctccacacccctaagaatataagctgaccctcaaatctcaagcccacttttctaattgctagctagaaaaatccatgtaaatggttttaagttctttattttggctcctatactaaatattagctcttctttctttacgaaaaatgtatttcctattggttacaaaagcttctgccaggggtccatgaattagactcgtatggctgtagcactcatcttctgaactatctgacaacttagctactggtttgagtacctgtctttgcctatagccatattctagccactacacaatgttttgttgtttatcaaggcaatgtccgttccagtctacaaaggcactggtaacagtaatatcattttacatgcagaaaaatatttagaaaagcaatttatgggtattttccccgtacaaccacacaagtgtcttagatggcacttttctcagataactagctaaagagagatgtcctactttactgcacaaatgaagtggattaaaccgtctattcaaatgtttctcaagggtaggtaagagctatcagaaccatccctaggctgtatatttccctacccactgggagaatcccctgactaggaagccactgtcacgtttattttattttgtgtttatttattttataatgggtcacagtcctgtttttgtaggggcaggaatgtattctctctgctgggaacgtccgtcaaatgaatgacaaaatatcatatatccatttgaaactacagatgcactggtataaacatctgggactcaatcagtttgttccaacttaacatcaaaaaagaagacacatttgggttggtgtggtggtgtggtgggagccttggactgaagactctggttctgatgctggcccctaaatagtctgatgacttaatgcaactcaatctccttctcaactccaaaaattgctgccctgcccacactacaggctctggtgggagctgaatgagaaaagccataggagcctattgcagagcctattagcactggaggagtgtgaaaaattatctttcattctcccactctccccaccttcatccagtgttctggcccggatttttgggaaagctacagggtgtgcaaacattgttaaaaaaatgcatgcacataagcatatcacatatccaactttttctatcacatattatcgttttcttcagagtaagaaaagtcattagtgtagtttgcatagcatcttgttaaaaaggaagaaggtttatttttaagcgactcatctcttatgaaccagaaaattaaaagtttttcactggcagtatttgaaaatttctcaaatggtgttatgtagaatactaagtcacagaatgttaatatgtgttacatgcaaattgattctgtgagcaagtaagttgtgaaatgctgagtcaaaaaaaaattttttttttttttttttgagacagagtctcactctgtaacccaggctggagtgcagtggtgtgagctcagctcactgcaacctcccggtcctgggttcaagcaattctcctgccttagcctcttgagtgtctgggattacaggcacccactaccacatccagctaatttttgtatttttagtggagacagggtttcaccatgttggcccggctggtctcgaactcctgacttcaagtgatctgccgctttcggctgggattacaggcatgagccactgtgcccggccaaaatatttctttgtttttttgagacagagtctcactctgttgcccagactggagtgcagtggcacgatcttggctcactgcaacctccacctccggagttcaagggattctcctgcctcagcctcccaagtagctgggattataggcatgcaacaccatgcccagctaatttttatatttttagtagagatggggtttcaccatgttggccaggctggtctcaaactcctgacctcacatgatctgcccgcctcagcctcccaaagtcctgggattataggtgtgagccaccgtgcccagcaaaacatttctttaccacaggaattctcagaacctttagcacgctgatgcacactgcaaagctccgtgggcaaatgcaaagtgtttctggagcttatctgatcacatactgttttatcaatggcaaccttttcagtctagtattccatgcagaagaattcagggaatgttatatggaattaattaaaaaatgtttaattcaatttttgcatgttgatagtacatacccattcctgaagtcaaagagcacccaggagatgtatttatagtgaagacaagtagtccctgccccagctctctccacctttctgccctgtttttcacaagcagccatgttcaattctttcagttatttttcctggcatttacctctgttatttctaaataatatgcaaatattaatatttattcttttttcaattttaaatattacttcttgatttcctgctggagaagatgaggattagctattttacacctctaattcccctcaacacaaatatgctttttctcccccatctccccagcaagttttatcacaattctgcttttaattattccaatatcacataaatactgtttgtgactgagccatgtagcatattatttctcttttttaaaaactgtttcccctcagtgttaatatctaccttgttgttgtttgcttggtttaaaaaaaaacacacacatttatctctaattcctcattaaaccctccaccagagtttaataattcaagttataaataaataaataaataaataaaggagtcataaagctcctctcaatattgccacgccgataagacaatgcattagcttcattttttcccccttggaaacactacttagaattctccagaaggccttcctgtcccaatatgaattgctctctaggattgctgaagcttctcaccacctccctagaaattcccttggtgtctcttctgaacagaatgaatcctcctggagtgactcatctctgctctgtgcaggctcttcctcctcctgggttactcccttgtgtgtggagcacatcctccaggagcttcctgacaaagtgtccacatccaccacactggagcccttggctgcctggaaatgactttatttcctcatgcttgatgaaaattttgcccagtaaatattcttagtaaccattttctactttcggcattgttgctgaaaagttgatgttccttttgattcctgatccttaatataaaagccttttttgaaggcttttatgatctttattcctagtgtagtgaaatttacaaaaatatgtatttgacaacagatctttctccactcattttgtcgggcacttcatgggctcttttaaactcaaacattcatatccttcaattctggacaacttccttatgttatttcctcaataaatttgtctctcctccttctcactcctttatttctgaaactcctagtactcaaacatgggacttatgaattatcttaacattcttagtttttcctcagactttttgttctcttagaggtttaacattatcttatgcttcaggtgaaattttctacttttgctaccttctttttttttttttaatacttttaagttatagggtgcatgtgcttctaaaagctctctcttgttccttttctacagcatcttttcttgtctcataaatacaaaatgggctcttacaagatgttcccatatatctgaagctactaattacaatttttcttttttttttttcctgagacagtcttgctctgtctcccaggctggagtgcagtggtgcaatctcggctcactgcaacctccgcctcccgggttcaagtaattctcccacctcagcctcctgagtagctgggattacaggtgcaccctgccatgcccagctatttttttgtatttttagtagagacaggttttcaccatgttagccaggctggtctctatctcctgacctcgtgttccacccaccttggcctcccaaagtgctgggagtacaggcgtgagccaccacgcccagcctcgtttttaagttttcttctgctcctcagtctctcgttcttctgcaggttttaaacaatattgtttactagcttatagtctacgtatttcagttgttttcattttggaagctttcttaattgaatatgattcctcagctgtctatttgtatttgagtgaggcaacaaaagttgactcgaagttatgcagagtgtgggctcagcatcagagggtggtaagagcagacctagctgtttcaccacatacatacaacctaaatatccatatctgcaggccttttcttgtgggctggtcaagtgcagttttgcagatgaatgctccattcttccgcacaggggatgtgagtttggctgccggagttctgggacctactggggaaaagggcctaaacagtcttattgtttactacgtaggctttcacttagttcctctgttttcaatacatttgtatgtctacctgtcctcaagtgtgttagagtcaagtctggagcccctcaggtgaaattccacattgcctgatgagctagggatagggtgatcacctggctaagcggaggatcaagggatcttacttcacatacgtgctttcaacacaccttatctttcaagatcctggtgccttcaattcctgagcccttctagaattctgtggtacacaccagcacatattgttgtcattgttttggggtgccacaagccccataaatgttgtatgtgttctgactgctccactgaccagccattctccaatttctcttcctctccttggacccctctatttcctgagacccaataatattgaaatcaggccaattattaataataaccctacaatggcctctaattattcaagtgaaagaaagagtcttatatctctcacttgaaatcaaaagctagaaataatcaagcttagtgaggaaggcatgtcgaaagccaagacaggccaaaagctaggccttttgcacaaaatggttaggtaggttgtgaatgccaaggaaagctctgaaaggaaattaaaaatgctactccaatgaacacatgaacgataagaaaacaaacccaccgtattgcttatatggagaaagtctgagtggtctggacagaagattaaaccagccacaacattcccttccttaagttaaaacctaatccagagcaaggttccaactctcttcagttctatgaaagctaaaacaggtgagaaagctggaaaagtttgatgctagcagaggttggttcatggaatttaaagtaaggagtcatctccataacagcaaagtgcaaggtgaagcagcaagtgctgatgtaaaagctgcagcagcttatccagaagatctagctacgataactgatgaaggtggctatgctaaacagcagattgtcaacagacaaaatagacttttattggaagaagatgacacctaggactttcatagctagagagaggaagtccatgcctggcttcaaaccttcaaaggacagtctgattctcttgttagggactaatacaactggtgacttttaagctgaagccaatgcctcatttactactctgaaaatctttggaggcatcctgaaaatccatagaattatgctaaatttactctgcctgtgctgtataaatgtaacaacaaagcctgggtgaaagcatatctgtttgtggcatagtttactgaatactttaagcctactgttcagacctactgctcagaaaaaaaaaacaaattcctttccaaataatattgctccttgacaatgcacctggtcacccaagagctctcatggagatgaacaaggagaacaacgttgtttcattgttgtgaacgcaacactgattctgcagcctatggaataaggagtcatttcaactttcaagtcttattatttaagaaatacaatttgtaaggctatagctgccatagataatgattccttcaacggatctaggtcaactgaaaacctctggaaagggttaactattccagatgccattaagaatgttcataattaatgtgaggaggtcaaaatatcaaacattagcaagaattttgaagaagtggattccaaccctcatggatgactctgacaggttcaagatttctgtgaaggaaatagctacagatgtggtagaaatagcaagagaactagaattagaagtgaagcctgaagatacgattgaattactgcaatctcgtgatccaacttaaacagatgaggagttacttcctatggatgagcaaaggaagtggtttcttgagaagaaacctacttctggtgaagatgctgtgaacatttttgaaatgacaagaaaggacatagaatgttatgtacactgagttgataaagcagcagcaatgtttgagaggattgattccaattttttaagtaattctactatgggtgaaatgctgtcaaacagcaacgcatgctgcagagaaatctttccaggaagaaagagtcaatcgatgtagcaaacttcattgttatcttattttaattaagataatgccacagccatcttaaccttcagcaaccaccacctgataagtcagcagccattaccatagaggcaagactctccaccatcaaaaagattacaactcactgaaggctgatgatcatcagcaataaagtatttttaattaaggtatgtacattgtgctttaagacataatgctagtgcacatttaatagactacatactgtataaacataatttttatatgcactaggaaagcaaaaaaaaaatcatgtaactagctttactgcagaatgcagtggactggaacagaatccacaatatctttgaggtattgctatcatatgtttccaacaatcacatttcaacatatcttgatagaaaaatcacaatattcatatactttttgtattatgtagctaaaaagcaatgggctatttaaaaatatagaatacccatttctttatagctgcacaagtaataatacgagttagtcagagctggcagccactgacagagcacttagctggtgccaagcactattccaagcactttactgattccctaaaaccctataatgtactgtactattattatccccatttcacacacgagaaaaccaccttctagggtcacatgacctgtacccaagctgtccaacctcctgcaaaaatttcctctcaaaattctaggccttcttaccatgttccttgaaactcttgttgcattataaacatatttccatgcctaacttcttcacaacagaatgtctctctaacttttcatttaacaatgaagactagcctgaccatttctacctctgctatcttcctcttaagggaagttcctcttttcccacacccacatatcagtctggaaatgccctgggtcacaaggctcacccactcattcaaaagtcccttctctaggccaggcgtgatggctcacgcctgtaatcccagcactttgggaggctgaggcgagtggatcatcagaggtcaggggtttgagaccagcctggccaacacggtgaaactccatctctactaaaaataaaaaaaatttgctgggcgtggtggtgtgagcctgtaatcccagctactcgggagacagaagaaacgctttaacccaggaggcggaggttgcagtgagccgagatcatgccattgcactccagcctgagcaacaacagtgaaactccatctcaaaaaaaaaaaaaaaaaaaaaaaaaaaaatgccccttttttgacacggaccccatttttttttttttttttttttttttttgagacggagtcttgctctgttgcccaggatggagtgcagtggcgcgatctcggctcactgcaagctgcgcctcccgggttcatgccattctcctgcctcagcctcccgagtagctgggactacaggcgcccgccaccacacccggctaattttttgtatttttagtagagacagggtttcaccgtgttagccagcacagtatcgatctcctgaccacatgatctgcccgccttggcctcccaaaatgctaggattacaggcgtgagccactgcacctggccaaggactccattcttaatgctgccaaatgccctcctacaatctttgtgggacaaatgaaatgtacagaaagcacctctggaaaattcgcacacatacaaccttttgtgaacaatttgatccatggcctccctggagctcttctgaagctcttccatttacagcctgcacacaacccaatctcccatccctgcctggcagtctctcaaactatggtccacaggccacccatatcagaattacctagaatgcctgtttcaaaccattctaaatttaaaccattctagaggcttgtggaataaggagtcatttcaactttctccactggaattaactttagaatggactccccaaggatgaagcccaggaatccccattttaaatactctccccaggtgactcttatggctcattaacatttagtgcccatctctaaggacacatgaccctgattgagaacttgtgttctaaaatactcatttctattcatttctgcctcatcccttggcctcattctagaagattttaacatcaatacaataatccacctcacctatgtattagcttcattgggggtaggggggtggtggtatattagtgaccagctcctcctgtccatgatagcaacccactcctgttattgtcacatcctagatccagaacagctccactcatcaacactcctaacaccaagagtgtactctgcccaacctatccatctttctctccaccaaatctgctcttgggccacagccagacccaatcccatgacttccgcttcctcccaactagcaaagcccgcctccagcttcagttccagaggcgcccagcacagatgacagtctgtctcatgtcctctgagactgactccccacggacttcagaaataccaaccctgtaccttccttctctgagatggccactgcaggacttgggatgccagagctagtctagcaggctgttacccttagactccttttccatctccagttcaggttggcctagtgataacagccattattataactaatatttacaaagcactaactgaattaggtaacaattaattcatttaatccttataacaactctatgataggggtacatcattatcccatcataaatcagtgacattgaggccaagagagataaaataatttgcctaaggtctcaaaggtagtgtgtgaccgagctgagatttgaagccctccagcccctttccacagcctgagctcatgctcctttccttctgctctagtaatggaggagaagagcaggaaaagaaaagagcaacccagtcatttgcctcttggagaaaactagctcagggctcctattttgctggaaaactttgccctgtgctccactccttcatctttatatttgggattcatgttttaccttctcctgagttttttataactcatctccaaaagatggcaacagacagtggtttttaaaaaaagttttggaaagcttatttatcagttttatgttgaaacctttgtcttttatcagccgggacttctaaagagtagcatgtaaagtaatatggaaaacttcgagactggaatgaatactgtggcaaacttttcaaactcacctcttatttttcttgtaattctccagttgctgggactgcatatgtttgcatctttctaattcacactgcccacataagtcttccagatgcagcaggttgttctctacctcctcaaaactcgcctctaaatgagctgaaagtatataaaaataaacagacctcaaaagtcagaatcctcaatcatgatgaatacaaaaagtatcaaaaaggtaaaagttcacattgttgagattgttttgcatttttaatgttttttattaaactttcttgaagcaaaataaaatatactggccaacattaaaccataattcaaattacttttttgactacatttcaagcattttcaagaaataactttcctaaacacttattaaccaggaagacaaagaaatggagaaacattatcttgattaacgtaatgctatatcctaatgatcccatataccacatgtgaataaccaattttcacataagaatatggtaaaatataattaacacaaattatacctaccttaacctaattacacctatacttaactaacttaatatctgtgtttctaaattacgttagcatttgttttgcctctggcacatcacatacacaaatcttcaaggcacagtagatatgcacaaatacttggtaagcatgagttaccaggctactcagtggttgggtgaggaacagactttgctctgcctgtcaggtgactagtctttcactactccactctgctgctaggccacagagccttgcagctgtattggaacatgaagatcacccactcaaacctttcactgagaagattcaagactaaagcctagaaaaacaaatacagtgccttgcccaggcaagctagtgaagggccacacggccagtgaagggcagtcaggaatccaaactgaatccctctcacattacactaatttccaattgacagggtgctaagtaaactgagattgtaggggcaaggattagttgttttcttatacgaaagaaaagctttcgaggtcaaagatttgagaactcagagcctcataactagttatctattattcactgacatatgccagtcactgtgccagtcactgtgatacaaagatgaaaaagacagtcctggagctcaaggagcttacaggagaggggaggtatatttcaatggcaacagagcatgacagagtaaggcatgaggtgccgaaggaactcaaaggagtggcatctaacacagatgagggaaagctcagccagaaatgactcccaagtcaggaagtaacagcgatccagtggggaagggagcagtgaagaacaagttggctgtgcagccttccagtcttgggttcacttaaacggctacaatataattccttcatttacgtactagctttttacatgactttctaaactagctttcatagcatttaggtttgaggcaaactcctcaaatttcaacttacaattataggtttattgtaatgcaaatttttgccgttttttgaagtcctagagagagcaattaggcacaagaaagaaataaagacatccaaataggaaaggaggaagtcaaaatgcctctgtttgcagatgacatgatcttatgtatagaaaactctaaaagcgccaccaaaaaaactttcagaacttgataaataaattcagtaaagttgcaggatacaaaatcaatacacaaaaatcagtagcatttctatacaacaacaatgaaattgcaggggggaagaaatcaagaaagcagtcccatttacaatagttacaaaatattacaatacttaagaataaatttaaccaagggaaggaaagagccaggtgtggtggctcacacctgtaatctcagcacttcgggaggctgaggcaggaggattgcttgagcctaggagtttcagatcaaggggatgaaagatctctacaagacaaagtataaaacactaatgaaagaagttgaagaagacacaaaaatgaaaagacatccccatgttcatgcattagaagaatattgtgaaaatgatcatgctgccaaaagtgatctacagattaaatgcaatccctatcaaaacaccaatgacattcctcacagaaatagaaaaaaaaaattctaaaactcatatggaatcacacaagaccctgaatagccagagcaatcctgagttaaaataacaaagctggaatcatcagattgtctgacttcaaaatatactacaaaaagctatagtaaccaaaacagcatgatgctagcataaaaacagacatgctggaacagaacagagaacccagaaaacccacaaataaatccacatatttatagccaaccagtttttgacaaaggcaccgagaacattcattgggaaatacatggtctcatcaataaacgatgctgggataagcgaatatccatatgcagaagaatgaaactagacccctaacgttcaccctatacaaaaatcaactcataatggactaaagacttaaatgtaagagctgaaaccatgaaactactagaagaaaacatatgggaaacatttcagaacattggtttggacaaagattttatggagaagacctcaagacacaagcgacaaaagcaaaaatagacaaactagactgtatcaaactaaaaagcttctgcctggagaaaaaaaaacatcaagactgaaaagacaaccagcaaaatgggagaaaatacctacaaactactcatcccacaagggattaatatcctttcctttgaatatatccctagtactgggactgctggccatatggtgttctattttcgttttgttttgtttcagaggaacctccatactatttttcataatggccctataattaaaattcccaagaaattcttacacaaggaacccaaacaatgcaacagcaaaaaataaaaattaaaaaaaacctattaaaaatgggcaaatgaactgaatagacatctctcaaaagaaggtacatgaatggccaacaggtatatggaaaaatgttcaacatcactaattataaaggaaatacaaatcgaaaccacaatgagatatcatctcaccctcgttagaatagctattgccacatggaaataacaggcactagggactccaaaaaggggggaagcgtgggaagggacaaagattgaaaaactacctactgggtacaacgttcactgtttgggtattgggtacactacaagcccaatctcctccaatatgcaatacagccacacaacaaacaagcacatgtacccccttaccccctaaaactaaaaaaaaaaaaagaatagctattagcgaaaagaccaaaaataacaaattctgtcaagaacgcggagaaacgagttctcatacgctgttgtcgggaatttaaattagtataaccactatggaaaacagtatggaagttccttaaaaattcaaaagtagaactaccatatgaccagcagtcccactactatcgggaatacagccaagggaaaggaaatcagtatgctgaagcattatctgcactcccatgttcattgcagctctatacacaatagccgagatatgaattcaacctaagcatccatcaatagatgaatggataaagaaaatgtgttatatataaacgatggaatactattcagctgtaaaaaagatttaagtactatcattcgcagcaacatggataagcctcgaggacattatgttaagtgaaataagccaggcacagaaagataaatactgtatgttttcacccacatgtggaagctaaaaacgttgatcccagggaagtagagggtagaacagtgtttactagaggctgctggggaggtgggcagtagccaaaggttggttaacagatacaaaattacagctagataggaagaataagttctagtattctatagcactgtagggagagtataacaatttactgtacatgttcaaatagcaaaagagtggattttgaatgttcccaaaacaaaaaaatgatgtttgaggagatggatatgctgactaccttgatttattacacactgtgtacatgtatcaaaaatcacactgtgccctataaatatacacaattatgtgtcaattaaaaataataataaaagcaaaaaatatacgtaaatacttaaaaattttttaaaagaaaagaaactgggagaaaatcattgcagaacatacatgataaaggactgttatccaaaatattacaaagtactcaatttgcaactgagggacagtctacaaaatatctgatcaccatgtctcaaaaaattgtcatggtcatcaaaaacaaaaaatgtttgagaaactgtcagagccaggaggagcctaagaagacaagatgactaaatttaatgtggtctcctgaatgagaccttggaactgaaaataatattaagtaaaaaaaaattaataaagtatgaatttttattaatgaagattttatttttaattaatctttgtttgatccaaacagctattagataatccagaagtgttgacattttctctttttatcctcctctcaagcatttatcctttgagttagaaacaatccaattacattctttaagttattttaaaatatacaattaagttattattggcaatagttaccctactgtgctataaaatagtaggtcttattccttttttttttttgacactttctaatatcctaaattttaactctattaaatatttgtgcttataaaaactccctctcctctctgctagggtgtaaggcttaaaaacatgaatttggtcgggggggaataacattttattcaaaagtgaaaatttgatgacaagcagtttagcagttttcttcagacattttaggtactgacttttatcatattaatatatcacggtaaatctggaaaaggctaataataatgtagttcatggtgcttttgaatctagcttcagggaccacatcaaacagctactatatgtgattatggaacgcttaaatgaaacaatttgtaaaatctaaattttagccaataactgtatttaagattttaaagaatgtcataaatggtacataaggagtttatatgggggaatcaggcaaaatgatgtactgccatttatatatatatttttttgtagagacgagacctcactatgacctggctggtcttgaactcctgggcttgagcgatcttcctgcgttggcctcccaaagtgctggaattacaggtgtgagccaccccacccagcctacattgttttttgttttattaaatgaaaaactgactaggagattcagcttgggagctagtactcctagtactaaagaagcaatattcagctcattctgttataactagtctgacatggtcttaaaatgtataaaacactatcatagctaataggattatttaaaaggctgtttcattttgattagtgataaaaactagaatagttaaatttaatatagactccatttaactctaagctacttggtgcattcagtatcgtgcatgtatgcttagcatatgggggacgggttaagagctaggctttgaagcacaagcttaaaaacccagctctgctcctgccagatgagatgcaatgtgatacctcgtctgtgaagagagagctaacaacacatatcttgcaaagctgttaaaaggattaaatgagccgaagtacctaaacttaatacttgacagtaaataattaatgtttgaatataaaaaatagagaaaatttttagattagctaagttttatatttaataaaagtgattgaaaactaataatttcattgaccagtaatgatcatgatgtaaacaagatctatggatctattagatcaaaatgtcaacaacattttcatttttatcttacaaacttacacacctataagttattttccaggctatagtcttagacttaagatctcctacaggtaaaaggaattaaatttcaaatgatttttctgaaaagaaactatgtaatggagccaacaattattctatgctggaaaatgtgtatgttctttttacctctttaatctttatctggacagatggcaatttccatttagattctagctctgttggttgactacagagctaatgaggccaggaacttaaatgaggttgatctctaggcaggccaattaatttctcacagacagaaattctgttctaggtacaaattgtacttgctgccctagtcactcttttgttaataacgtggggaccagatgaaaacatgtgagtggtttatcaacctggaattcctaatgagaaacaaactgtacatacttctgaataggacggcctcatgctcttgtgctgaatgacaaatttagactaaaaatgcttgaaatagtccgtggtcattttactgctaacaccaaattcatatttatgttctcccctttaaaaagcttcacaggctccccagccctttcaagttaaactccttatcattcagagagctactgctctctggccacaaactgtttacttcacttctttccttcacatattctacattacagcaaaacaagaggagtactgagcgttggtgcctcctcctccttgcctctgcctgtccctaaccccggcctgtcttttcaggcttaggccagtggcagcccgccctcctcccacagggctcccttcctcttctgtgcttccccagacctttcagcctcacacaggactcacattctgactgatatcatccaaccagttgtgtactctcatatctctcaggaatcagtaagggccttaaaggtgcagactgtatttttgcttttttgctatcccctaataaccctgtctgttgaattcaataaagaataatttctggtgatagaatgattttattactctaacatgtaaaataactgagaaggcaaaactattcatggtcatctagtttaaatattaagagactatgccaaattttgtaaaagaataaacatgagcagagaacttagaaaacattaaacaacatgatgatacttttagtatattaaaccaggtcacattatcagtgacttaaaacagaagaaatgatgaaaattttccattttaacacttagcagacttgaaatcagtaacaaaatataaaataattgcattgaaaaaaataaaggttcatccccttatattaaacttaaaaaagctcttcatataataatgacaagtacatacgtaatgtgtattccgaatattttatgttgaatttaagttagcagaaatttaatttccctgtcacagcctgctcatttcctgttgcaaaacaagttgcatatatgagtacatttggtaaccaacttaggatgcatatacataaaatactagcaggcctccatggacacaaatatacctttacaagaagctcaagcctcaccattttgctcgctataacaaccgcatatgtctcatttagtgatcagtgaaagagataggtagaattttattgtgaaaagccatttgggaatgcctgacagctgtgcaaaaaagagcttcacaaatttttgcaagaaggccgtcccagaggaaaagcaattctgtttggaatttttctttgtgccatttgtttcaaatacatatcatctgtagtgtaaccactgatatataaagaatgaagcagcacactaaaattatttcccacttaatgagttattttctaacaaaataattagccttatggaacaaagaactctccttggctgcaaacccataggtcacagaggccaggtactgaaagaccacaagactgttcaaatgcttacgttacacttttatgtactaaggtaataaggtaatgatggtatgaataaggaaactttaagaagtacattaacttgcaaaagccattatggaacaaatgagatctatgtagtagcctaaaaggtgtctaagagaattaatgtgcctcttgaagggtctagcctcagaaaggaacctggacatctgataatctagtccatgaaaaactgacagagctatgataatctctttgttagatgccctctaaaattctgtacagaaaaaagcaaaataatactgtatcaggctaggtcaaaccaaaagaaaaacacaaactcagtatacggctgctattctcttatatctaagaattcttatctaagagttaacagcatcttctggctgggtacagtggctcaatcctgtaatgccagagctttgggaggctgaggcaggaagatcgcttgagtccaggaatagtctgaggctgcagtgagctatgatcacatcaccatgctacagcctgaacaacagagtgagactctgtctcttaaaaaaattaaaattttaaaacaaaaacaaaacccagaatcttctgttctagatgaagggaacagtcttttaaaaataggtcatataaaataaactaagagaaaattcaaagacaaggctttaacattttgaacttcaataaaggaataggattatactaccctctagtggaagttcaagataattcagtatatacttttcaaacatatttttccagttttatgattaaaaagcactgtggtttttcacagaataagaaagtgcatagaatctggataaaaatattccattgtatgcttacacaccttcaatgtacagaatactaatatcaccacattgaatcttgtggttttgcattctaaactgttttgcagcacaagctaaactgcctaacatccatccaaaccctcgtgtcacagaataatggttttgtgaattcgcaaaggctagagaggcccccattagaacgtcagcatcttgatggcaggtgcccagccttgttcactgctgtgtgtccagagtctgtacgcagtgcgtggtgcgtggcagatgcccagcatgtaccaggcactgtgctaagtggttacgtttgtcatctcctttaatcctccaaatacctacaagacaggtatgctcatcgtcattttgcagacaagaaaactaaagcttggagccattgagaaatctgcacagtttttaaagtgaggaagttggattgggagccaaacccgatctgtcagttcatagcccttgttttccagttcccagcatacccttattacttatttttaaaacgacaaaccttaccagtaagtatcaattaaataggctcctgtaagctggactgaagccaatatgaatggatcatctgttgtaacttaacaattcccaaggggctaggtaccaggagccatattaatgaagccatgggataacacagctaaaagcatcatcaaaagtccaaattgctcacataacataaatcctttgcccttcaataaaagcagggcctctagagagcaaagtaagaccaaaagagtgaagcagcctggaaaatggagggactgacaggatatggtgttacatttgacagtgaaagggcaacaagttcaaagaagttagggggaccctgtgactaaatataatcggttaccattttcttctaagtttgtttttattttttattattgcttaactatttaagctttgtaatattatgtcaaggtatttgggtaataataggagagattttgaggcttccaaaaaaaaaaacccagtaaatgagtaagcatttaaaacactaaatgtttccaaaatctaagactgatacataaatgcatcaaaatgaattcataaagtacattaatggtacagatacatgtttacacaactcactccatcaaatttggcttcaaagtgtttgttttcctactgtaaagaatatcgtcagcaatgattctataaagcttaaattgcttagctaaaagcctcatgattttaaaacaactctctctgggcttattctaggccaacaaatactaactaggtctctaaaattccaagttttgatatgctatcttccacagtcattcattactaattataaatatcaggcaaataacagcaatagattaaaacccaaaggaagcatgtatttcaaaggctaacagataattcagattggcaatatatatgaaaagcaaccatccagacataccttctaaaaaaaactgaactaactctctaaaaagagctcaatatcggttagacatagatgagaggaaaaaaatgactcaaattaatttagcagtgattaaccagaacagtatatcagataatgttttagctttcatttgtctttagtgttagatgttctcagattactaaaaaagagaggattcaagtgaacatttggaaggcctaccttgtgcatttaagaagccaaaatgcagtttctgaagaataaggtcatgtgtcactaaacatcaaacatttttcaggatattagaatcctaattgggaacgaacatacaatatattctatgaaagacttatagagactgcattttctaaacagaattgactatgaaaataatgagaactgtggcagaatgcatttaatcaatagagtggtattaagcaaacaacaactatccgtaaacagatttactctcagctggggaaataaaagaggttatcataagagaacatgtctgcaaagaaacatacaaccaatgaaaagcaagtgactcaaagagatacaggaagatgagctgaaagaaagtggctaagaagaatgttccgaacatcttaaaggctatgtccaaggcttgggaaggaccattactatacctgtaagaggaaaccaatgcagacggcaatcacagccattttacacttttctaagacccagaatctcttttccatgccctgccttcagaaataacaaaacactgaccctgaaaggcatggcaacagccaggggacttgaagaatacagttcatagagacctactgagagctcccatcccactgcctcatcacctcatcctactgcctcatactgatattgaggatatcatcaatgtggttggaatcctagatgcatttataaattttatgattctgagcaagttgcaacctctccaagccttagtttatctgtaaattgggaataataaaagctacttttgtggggttcttgtgagaattacagatagtatctgtaaatcatctaatcatctctgacatacagtaggtgctataaacattagctactgttatcagcaacagcactccaaatactacgtatctattttgttcacacacaaaaaactgtcttatgacttgccaattacttgccttgtaaatcagtcatgttttgctttgaataaggcaatattaaaaacaggaggagataatagggtatctttagcttcccacctaaaagactaaaacaggttattagctcatacagacagctcctacctcctactttactaagatcttaagcttgattaggaaatagtaagctgcaatattatccttagatgtggcatcatcaaacataaaagataattttctgaatataaacccaagaaaaaaagaataccaacataatccatccaaatgaacaacgacaaaaaaataaatttccacagagtataaatttagccaaacaggtaccctaatttactttgttgttgttgttgtttgagacaaggtctcactatgttgcccaggctggattcaaactcctgggctcaagcactcctcctgcctcagtctccagaatagctgcaactgcaggcacgtgccaccacacccagcacaagtaccctcatttaaccaggtttgtttgatctccaatccgtttgaagagaaaaaaatacactacaagacatgaagttctagcatatctaaattttaaaagcaacaatttctggaatacattctacagtaaggacaaagtcacctaatccattttctatatgtatgcttttaaacagagaccaaatgtcaacaaagacaacctgagtcactttaagaatcaacataattataattatgtgtccggagctgacctgaggcagaaacagaactaatttctacactttacatcattttctgtggaatcctcaactaatcaaaatatgaaatcatgattttccaaaaaatcctgttaacccagaatttcatgtgttcctgaaaagctctgaaattacaccaaaccctgcccaagttgttttcattcctaaaagtaatgtacaatgaaaacattggacttactcagatttgctgtcatggattctaagtctgcgattaaagctgggagctgctggagctgctcttgcagctccacgaggcttgtctttttcttctcccagtgcgcagaaagcatgaccacctcgctatccaccagctgcagcacacaagaaggggggtaaagtgaaaccaggttttaggcacaaagaaagtacagttaacgtaatgagatttaatgttatctttaacaacccctctactcagtagagattacggtacattctaaaagagactgaagttgttttcatttttagaaaagaaacaacttaatattcagtgcaggaaacctccaattactgcttgtatcagtgcatcttaacccacagaagagaaagtttaaaaatgacttcagaagtcacttctaagtataccctgttttaagcagaccatgtatttgaaaagctaaatctagaaaaaaaaaaaacaaaaacaaaaaactaccactaacaaccaaaaagaaaacaaacataaaacataattaacgggtaattattggctttacgaaaggaagtcttcaaagaaaagttccctaatacatttagaatataccatgtttcaatttacatttaaacaggaatacttattgcataaagtatataaaggaattttgaggaaactggccaattccagaattccagaaaaagaggaaatgatttaagttaatgaggaattcagcagatgtaaagggttcctaatagcaaggttgtgaaattctagaatagcctaagataattctaacttcttttgctaaagactataaagaaaatgacagacattagtttctcccagacaattctgttttggtcttaacatagtgggagggacaagggcctagaaagacttagaaggagcaagaagaggtgatcttttgaaaatatcaacatgaataagcaagaactgtggaaaaaactccataatctgtacgataaaaaataaaggtaacaaaacccattatatgacagaagaaaatgaatttgagtattcaaaacagacaatttgtacatctcaagattaaggttcttttttttttttttttttttttttgagacgaagtttcgctcttgttgcccaggctggagtgcagtggtgctatcttggctcactgcaacctccgcctcccaggttcatgcgattctcctgcctcagactccccagtagttgggactacaggcacctaccaccacacccggctaattttttgtatttttagtagagacagggtttcaccaagttggccaggctggttttgaactcctggcctcaagcaatccacccatcttggcctcccaaagtgttaggattacaggcatgagccactgtgcccggccaggattaaggctctttaagagttagaatctgaatacaactgattcttactaagttccacttaataaattaagaaagaactttggaggaatgaatatatcaaagatacaaaattatttgtatgtagtactagattgtttttgttcgtacatttcactatagtaggaattctcatttgaaataaagaactaagctatgacacatctccctgtggtttctcagcccacgctggagggataaacacataatctctcacattcaagcctcaactgagctgggaggccacatcaagtttcacgcaaaccgcatttctcattatttttgtgtatttaaaaatgtctgttgccaactggtctttaaaaaaaatctttaaaagtagcttaaaacatactgaaaaaacagctaaaatgcagtaaggaaaccaaagcttgaaacaaggatctatgttcacaaaattcatttataatattccacaaacttccactgaccacccactatttgctaagccctattttggatactgaagatgtaatgattcctgccctcttattgtttatacttcagtggcagccctcataaattctcttaacttcagattttaaactctaaaaaaaaaaattcctatattatgggctattttggtttctaatttgaaaactctagaataaataattttagatattaaaaattacatattaaccatttcttactgaaaattaaagtgcaatgtttaaatattgaaatttaactacagtttagttcatacctgcaataaaactgaaaattaaattctgaatatagaatataagcatatgtagaaaaactatatcagaaaacactaaactatcatttaaaagaatggaagggtaaacagattctcagaaattatcaataattatcaacaattatacaatactaaaacattttgaacattttctaaataccagaccctgtgctaagtaatttacatatattatctcatttaaaccacacagcaactctatacactaagcaatattataacctccattatacagattttaaaaattgaggtgtaatgaagttaagttacttccttaaggaccacagtggacttagattccatcccagggaatttgacagtaagcctatgcccttaatcaacctactagggattgtgctataggggtatataaagggaagaagaaaagtaaaaatctagcaaaagaaacggttctgaaaaactgtactgttacctattcattttatcatgtgtaatttcttaatgattaaaaaaagctatctccggaagttcaatttttccacctcgaagtaactcagaataaaccaagattcacccccaggaaattaagtttaaggagcaagacaaacccatagtgctttattccaaaattctttctggatattgaggttaggagaaggaagaaaaagcacaccaatgatgaaaaggtacaccaatgatgtagaataggatcttagtataaaactcagcagttcagagttttaaggaacacttcattttatttgatttccacacaagtttgataagcagaataagtagtgttaagccattttatagatgagaaaactaagagaggccatgttatctgcccaaggtcaacaggtatttgtgcagcaaggagcagaaaccaggatttccaacactacgttcagttcactttctgacagtgaaacagtcaaattcaactggcttaatgtcaaactgttaaacaaaaccatgaatcttgaaagttcaatttgaaggcaagctaatatttcacaataacaggagaggcaaaacactgaaagtctaactttagaaaactgccctcagagtttaagccctaagtattaactatttatggtatttttttaatacactgctaaaggagaaaaaaaatcgaaacccttatttagaaaaagcctagacaggctgggtgcggtggctcacgcctgtaatcccagcactttgggaggctgaggctggcggatcatgaggttgagagatcgagaccatcctggccaacatggtgaaactccatctctactaaaaatacaaaaattagctgggcatggtggcatatgtgcctgtagtcccagctactcgggaggctgaggcaggagaatcgcttgaacctgggaggcagaggttgcagagagccaagatcgcaccactgcactccagcctggagacagatcgagactccgtctcaaaaaaaaagaaaacaagcctaaacaacaaagttacctttgatcacagttgcttgttttataaactattgctctgaattctaagactatatagttataataattagctttaaagtagatgagtataaaataatttgttaaacaagatggaattgtccaaaagtatatttgccccaggaggttatgctggtaaagcccaccaaagacacatgagcggtctgacaaaataaatttacaaaatgacaagtttaatactatgcatactaaagatatacatttaaatatttacatatatctcaataatacaccacagaaggctttaaaataaactttcatttttaaggctgggtactgtttctgcaaagcaacataagtacttttgatgagctgtgggttttacaataaccaattatacaaaaatttaagatcctgaggtagcacaaattcaataacacatctgacaggaaattctttctcctgtatatattgttaatgcttctaataatcaaaagaatgattgttgttaaagctcctctataggacacagtcttcatttaacatgggattcatacatattgatacatataggtgtagtagttcactaattttcactgctgtatacggtatttattttatgaataataccacacttttccctgcagatggacttcggaactgtccaaagattaaaccaagcttgctacaaacattctggtacaaatctcaaggtgcacatgtgcaagggtttcacaaatgaattgcagatgtgtccaagatatccatctcctcattgcccagggcctagggtaatgagatccccctccccagcccctgcaggttggatgtaatgctctggaaaaattcctagaagcagaattgttgcttgaaaggcatgtgcaactttaacttctacttaatgccaactcattttttctaacgtgattgttctaatttatactcccaagttctagttgtttatcatcacatttcttccgaggaaagaaacaaaactgtcatctgcaaataatgaccatctgcacagaaagctcaagcttcttaaatttttggtaatctaatgagtgaaaatttggggtttcaatttgcatttccttgataccaagcaaggttgaacatattttactgtgtactggccattcctgttttctcttctgcaatatgcctgctgatatcttttactcacttttctcctaggttattttcatcctctttttattggtttataggggttattcatattttctgaacacttagcctctgtcttataaatcacttaatttttcacggtgttgtttgattaaaaaaagttttgacaaaaattatcaatgtacttatttatggctggtgctttttatatcttacttaagaaatctttcccaccctaaggtcttaaacatattctcttctaccattttccaaaaaatgtatagttttccttttcacatttaaatctaatgaagccaaaatgtgaacaaggtcttcaactatttttattcaacattatactagagtttctacccagtataagaaacatgaaaaattaaaagttgtatggcttagaaggaaagaaacaaacttaccatctacccaaaacaactcgcacccccaaatacaaagtaatagaataagagaatttagcaagatggccgaatatgggattaaaatactgcaagtcaaacactgcaggtttttggtagatatcaggacaaagaagctgtcttccattaaaaatttgctaaaactttttaccctgaataggtatttaattttatgaaatgtattttctgcatctgacgatcattttcacttttaatacttaagagtcaattgcatgtaaaagattttctaatgtcaagttaaccttttaattctggaataaactaagtgtattttgttttttatacattgctggatttggtttgccaccataggcatacattgaagaatgtctcccaggtagaatgccttttattatccaatattcataagccttgcaaatatcaatagcaagttttatatatataggaaaactttatatttaagcttgatacacattttaaaacaacgtgtgagtagattctcgaattgcatttcaaatacaattgttagaacatcataattgttagaaatttaaattgtctacacactgaggctgtatgaacagagtatcgacagctaatatgcatggcttatatgtgtccagcatggagacgccaagttactgcacacaagcaactgttaattaacattgttttcatgcccactaatgcaacatccattctgtagcctgtgaattaaggagtcatatcaacttttaagtgttattgtttaagaaacacattttataaggttatagctgccatagatagaagttccttcaattgatctgagcaaactaaattgaaaatctcctggaaagaatacactattctagatgccatcacacaacattcatgactcatgggaggaaatcaaaataccaacattaacaggagtttggaagaaattgattccaaccctcatggatggctttgaggggttcaaggcttcagaagtaactccaaatgcggtaaaaatagcaagagaactcgaattagaagtggagcttgaagatgtgactgaattgccacaatctcatgatcaagcatgaatggatgaggagttgattgactccaattttgaaagaagttctactatgggtaaaatgctatcaaacagcattgcatgctacagaggaatcttttgtgaaaggaagagtcaatagatgcagcaaacttcatcgctgtcttattcaagaaattgccacaaccaccccaaccttcagtaaccaccaccctgatcagtcggcagctataaacattaaaaaaaaacaaacaaaactctcaaccagaaaaaaggttatgattcactgaaggctcaggcaattgtcagcattttttaagcaatacagtattttttatttaaggtattacattgcttttttagacatacttaatagacaatggtatagtataaacataacttttatatgcactaagaaactaaaaaatttgtgtgacttgctttctggcaatattggctttattgcagtggtctggaaccaaattgacaatatttctgaggtatgcccatacattcaatctttctgtgtcctatgttctaggtgtttctcttgtcagtaacttataaactattaatagacttttcctcgtctttcaaaatatgccctttagattaatctagattaatcatttaaaaatattgaggctgcagatatattcacatttaccatcttattctgtttattctactgttatgcattttcctctggtttcttgtcatcttttgcattgactgaattctttctcattgttctagtttttttctactagtttagaagataaacagagtcttgctctgttacccagcctagagtgcggtggctcaatctcagctcattacaacctctgcctcccaggttcaagtgattctcctgtctcagcctcccaagtagctggaattacaggtgcctgccaccacaccaggctaattttttgtattttcagtagagacaggatttcaccacgttgctcaggctggtctcgaactcctgacttcaagtgatctgcctgccttggcctcccaaagtgctgggattacaggtgtgagccaccacacccaaccactttctattttttttgtatgtggttacccttgaaattctgccctccataattaacttttaaaagtgaggttaatcaatatcaatacatttcccccaaataatacggaagtgttagaatgcttgaacgctgataatctgccttccatcttacatgctttgttatctagcattattcttctatcattttaaccccacaaattagataactaatatatatgtcccactgtttagatttatctatgtttaccattttctctgctcactattccttcctacatctcagacccatcttctaaaatgagtttccttttttcctgaattacattctttagaagttcttttattggacgattgctgatagaaaaatgtttttatctgagtatgtcttgcttttactctaattcttgacaacagtttgaaaagtctgctgtggaactcattcatttataagtgatctatcttctctctagttaagatcttctcctctcctttaggattctgtagtttttgttgttgttgctttagacagtcttgctgttgcccaggctggagtgcagtggcatgatctcggctcattgcaacctctgcctcccaggttcaagcgattctcctgcctcagcctcccgaatagcttggactacaggcacacaccaccatgcccagctaatttttgtatttttaatagagatggggtttcaccatgttggccaggctggtctcaaactcctgacctcaggtgatccacccgcctcagcctccccaaatgctgggattacaggtgtgagccaccgagcctaactgggttctgtagctccagtatgaggtgtctaggaatggattattatcttgcttgcttgttgtactttctggatctgaggatttacatatctcatttatggaaaattctcagacatgtttttcctacactgtctttccctcatgctctttctagaactatttaggtttactggatatgttgggctaactcatatgaaactgcaattttacagataaaaattcatcgaatattggcaatctcacctggttcaacctaaagaccttttataagtattctctgcctatcaattcttctttcatattttccattttctttctgagatcctttctgtgtactctttgactctctcttgtacctcactatttcttcagctgcctcaaattgctgttaagcacatcttttgggtttgtaatttcaatgactttaaaatatttgatagtgccttcttccttactcacgtttaagtccatcttttatctcttgaaagattttatatataactatttaacagtcaatattcaatagtgcagtatctacagtcctttatgggtctaaatctcacactttggttctggtgactcaaacttttggtggtttacttgtgtgattgctaacattttgaggacagggagcctgatttaatctgtggaaatctgagggacctaggtttagacagtttcatccatggagaatttgcatttgtttttgttgggtgtcaaagaacacaaattacctgcacctttttttttttttttgagacagagtttctgtcacccaggctggagtgcaatggtgcaatcttggctcaccgtaacctccgcctcccaggttgaagcgattcttctgcctcagcctcccgagtagttgggattacaggcatgagccaccacgcccagctaatttttgtatttttattagagatggggtttcaccatgttggccaggctagtctcaaactcccgacctcaggtaatccacccaccttggcctcccaaagtgctgggattacaggtgtgagccaccgtgcccagccaactctttcatttcttaacttagaggttctttgatcaggcaggaaatataacttagaaccccatactcctatgaggccaataccatggtaacaaatcaagaaacgaggctatgccaacttcttaggaagccagacaggtttccttgttgactcctttagccaacaggtacattttttttccccctagcttaagctttcaccagggggatgtagccacctcaaagtccaaagagctttatcaaaagtctcagattcagatccccacagacaaagtctcctattcccacaaatctccaaagcttttgttttagtattttgatcccgacttccatgttttgttttgttttgttttaatgactctgatttcagttccctgttctgttttgttgtgttgttgttgttgttggccctttatgtttcccttaatttttgtgggcttaatgtatcttaaagaacttttaaaaaatatatccaacatttaagtgttttatagctgtagggcttttcaaagtatctattctgccttactaccagaaacctacattttcttcttatcagtaagttctaagagaaatgctagtgtctacatttcatcatatatattcctgtgttgtatataactattacagcttcattaatttaggtaaatggtaaagaaaatcagtctaaatttatttaaagtcagaattacagaaatcatttcagaaaaaaataaggtttgattgacatcaacaacattgaggagagtattcgattttggctatgtacatttaccaagtcatttaaattacaagacactagtgcttaaaaatactttgttcttctaagtgaactgaggatgacccctgaaatttttgtatttatttgttaggcaaattaataattttggatagactgagcaaagttaagtttttttgaccaaataataaggaattcttaaatagtgtagaaagagatgtcttatatagggtataaagagatgtcttataatttacatatattgcaaattcatcagactaaaattcagagcattatatctacataaaacaagtatttacctgtccttagaataaaagttataaactctcttgctcaactaaactaaattacttgacagagaaatgataaaaaggtgctttattcagggagtttcataatcaacgactagattcaatttcagatatcctgcaaaacattttgacacaaacaattataaattcaatttttaaaaaataccatttagcactgaaaaaggaaagtttgccacgagtataagattagtcaattctttacctctccagcacttgcacagtctttggctcttctgtgaagtgcagcccatgtatcctcatacctaaaaaaaagcaaaaaataatttgaaatgcaaaccacacattaaaaggaaatactatctaaagatgaatgtggaatatcctgtggtgctagaaaggaaacactcaaaaaataatggggacatgttgcaaggacacagacgtcaacttgacagagcttccagtggccaaatctgtgacaatttgagcaacaaaatacataatggtagtaacagattataactcaaagaatacaatatccctgagtccatggtgatgtaaataattgaataaataaatcaatgagagagaagagaaaaactcttccttataatagaaatccaattagtaattttttttttttgagatggagtttcactctgtcacccaggctggagtgcagtggtgcgatctcgactcactgcaacctccacctcccaagttcaagcaagtctcctgtctcagcctcccgagtagctgggattacaggtgtgtgccaccacgccctgctaatttttgtatttttagtagagatggggtttcaccacattggccaggctggtctcgaactcctgatccacccacctcggcctcccaaagtgctgggattacaggcatgagccactgtgcctggccccaattagtaattttaaaagaaatgatgagaaaaaaaatctccaattggtaaacacaatagtaataattgttttaaaaagaattttaatggatgatacaactagtgggtaaaagcacaaaaagaaacaggatatttacacagcctcaaagtatctgcccattggataatcattaactaaaagtgagaaaacagtgttaactgaggacaaacctggcagacacatccttaataaagtgatcaaaattaatgtcaacagtaatgagacacatcaacattatgtgcctcctgatgtgatgcactgggaaggatataacattactcttctggtattcttaccaaaaaagtactaacttacagttaattacaaggaaatagaaaaatccaaattcatagacattttgaaacataattggccagtactttttttttttttttttgagacagggtctcactctgtcacgcgggctggagtggtgtgatcacagctcactgcagcctcaacctcttggactcaagtgatccacccacctcagcctcccaaagtgctgaaattacagacatgagccacgatgcccagccttggccagtactcttcgaaagtactgaggtcatgaaagacaaagactaaagaattgttcaatgttaaagaaggtaagggagacattgtgactaaatatgatgtgtgatcctggattggatcctagtacagaaaaaaggacactggtggaataattgatggaatctgaataaggcctatggattaaggtatttactaatgttaattttctggtttgatcattgtactgtggttatatgaaatgctaacactgggaaagctgaaattgcttgttctatttttgcaatttttttgtaaatctgaaattatttcaaaatgagaagttaaaaaataaaacttctaaactactattcatttgattgctgatgtaaaacctgatttcccaatctaaaattctagctatccagcgaatatttctccaaacaggaatacatatttaatgagttcatactgcctcccctcatagtcagattcacaatttttctactgaatttaagtaagaaaatcaatctgaataatccaggtgatactagagtccacatgtgatgaaaattaaggtggaaggtcacacaaataatacagtcctgctgtcattgttgactaacagaaagctagaaaattttcttggatgtatcagattatgtaagcatcaattaaaatcaacaagtatttactaaatgctaagcactgttaggcaccagaactgctgagatataaattttacttttgcatctttgttatcctggtagttagcacagaacctaacaaacaagagacacattaaatgtctgttgagtgaggaaatagactaattataaattgaaaattcaggacttcgtggtaaaattttctatcattttcttaactcagtgggaaagagaaaattaatcctcacttgccaaatttagactccagatcacttttcctaacatctcaccatttccttttctccccgttattatgtatgcttttcacatccaccttgccattatacatcaccctccctcatttctactttcctagttcagcacctagttcattcatgattttcctactgttttcagcattctctaaacctagactatcgcaaccattcatattctctgctctacttttacgacatgaagcagtttggagaaaggcactaaatccattacaatgtatgctatccaacctcgcatgggccttagctgccaatcagcacttaaaaaaaatttattgctattagattgttccctgaagtacacacagcaggtattacacatctcatgccgccttgaaactcatccccatccaatcactttcaacagatggatgaacttactccattttactgagataaagacactggatgtaaactccttcaatttttctgtgttcaaactcaaacgtctttaaaaatcacaagtcaatgatgatgaaatgaagaagccacattcataatgtgtaattcttgcattcaaatcgttattgaatatattctatgtataccatgggaagactagtggaagtgttcacaatacagttaggaagatgaacacacaggtaaataattaccttacttggtagacaaaggaaaggactaattatatagcattagagctataggaatataggaaagtaactgtagactgtgttgtactacactctttgaaacattatgatttaggaaatagagagaagatgtcagagtaagaggcatctagaatctgtcaccctacctagaccacaatcacattggcagaatctgtctgatgtaactattttgggactctagaatctattaaaggcttgcagcttccaggggaaggtttggagggtaaactgaggttcatttcagtcgacttcaggttttagcacaatgacagctacccatccaccaccccaacccctggacaggtagccatgcacttgttcctgaagtagcttgtacacggcttatgaaagtcaaggtgggccaataaggaccctgtgctccaaacatcagggagtctgtgctctgatcacaattgctgcttctaatcagggagatgcagacacagaggcagctactgttgcaaacccctcctgctatggctagcaattttcagaggatttaaaaggccagcgtctggttttgtcccctttctttgttcccctttccctcttggagagccagacacttaaagactaggacattcaataacagatgcaattgttttttgttttgtggtgtgtgtgcgtgtttttgtttttgtttttgtcccaagatggcttactaggaatatcaaaagccagtttttctcaaaaaatagatcaaagttactggtgagtggacaaattctagacagaaaactgagggaagggagccaggacctgtcagagtgcccaagggaagaagctggggtgcagaaaaggaaagcagcaagactctggcagagattgaccctcaaggaccttggagccctgtggaaagggtaggtgggagtagttctctgctccccttacccctccaacaatctcctgaccatcaaactgttggagagtgctcctctgcccttgtgacccaaagcaatactattgatggtgacttgaaaacctcctggggctggagaatctggtggccaactcgtgtgtacatgcgtgtccacactcctctcaggtgccagataccatacttgtcgtgcgccagcagtgggatgctgccctgcccagggattctctgcccttgagtcaccacaccaccagattccctgcaaacacacctcacagaccactctaactttggcaagcacagggaaccagcagttccccaggtaactgtgagatctctggagatctaaccccctgcgtgggccatccctaagtggaagagagtgcagcccatcaaaagcacaccttgggacaaaggaaatgcaggcacagtgccaactgctacaagaggaagtatcattacccaggaatggatgtggggaaggggtcatctcctgcatccccctacactgttgctgatgcagcagtgttctctctgccaggggccagcacatgcactcggacacacagcgtatttcatgcatcttgtagcggctccacctctactgaaagtgagccctgcacagctcaagctttcaggaagggtagggcccaactccccttccctacacagagcagcaacaccccagcaagggaagacaagttgcagagttgtctgctcccatctggaggaagagactctccctgagcccattttggtggcagccctcagaggagtgtacccgcaacccgcagccaggaaccaaaggacaaaatctttatgaaatgaaggttgggagccttgtgacaggggcatgataggaagtggatcacgttcctgccagcacagaatgaggagtgggtgtacccacccaccttctcccccaagacctcagcacaccccacaggatctcttcccgccaccatcccctgcccactcagggcaggtgcttccacccaacgccagcctacctgccggctcttactcttaaatgccatctactggactgcagcctgaactgcatcaccaaataaaaatctgctaaaaaagggcttagtgctaggcagtccacaagatgagccccctgggatctccacaccctcagctccacaggagacaaggtgttaggtgtcagttcttagagccaatacatcactacagtaagcagcatctgagaaagtcactacacagaagctatccataaccaaggaccccatatagcatttggctctgtggaagcacccagaaacaaaggcaaatgataatacacaacatataccacagccatacccttaaggaaaaaaaagtcacatccaaatgatggcaaattcaaaataaaaagagacagcttcctcaaatgagaaggaatcaatgcaagaactctggcagtacaaaaagccagggtgttctggcatctcaaaggatcacattagctctctagcaatggatcctaaccaaactgaaatgtataggatgaccaataaagaataaaaaatacgtattgcaactaaactcaacaagatccaggaaaaaagttgaaatccaatacaaagaaaccagaaaactgattcagcacatgatagacaagatagctatattacgagagaaacaaatagaactgcttgaattctaaaatttactaaaggaattttaaaatatagttaataggctagacaaagcagaagaattacagagcttgtagaccagtcattcaaattaaccaagtcagacaaaaataaagaaaactgaatttttaaaaaatgaacaaagccttcaagaaatatgggattatgtaaagcaaacaaacctttcacttactagcattcctgagagaagaaaaagtaaggaacttggaaaacatatttgagggaataatccaggaaaatttctccaatcttgctagagaagctgaaatctagaatcaagaaattcagagactcctgagagataccatataagatgacatccccgagacaaacagtcatcagactaaggtcaacatgaaagcaaaaatcataaaggcagctagagaaaagggccaaattacccatagaggaaaacccatcaggctaacagtggacttctcagccgaagctttacagtcagaagagactgggggcctatttttagcctccttaaaaaaaaaattgctggccaagaattttatatcctgttcatctaagcttcataaacaaagaagaaatgaaatctttcccagacaagcaaacacaaagggaatttatcaccatcagactggacctacaggaaatgctcaaaggagttctaaacatggaaatgaaagaatgatacctgctaccataaaagcacacataagtacaaaactcagaccctataaagcaatcgcacaataaagaccacaaagcaactagctaacaacactatcaaaggaataaaacttcacatatcaatattaaccttgaaaggaaacagcctaaatcctccacttaaaagatacacagtggcaagttggattaaaaaaacaagacccaacctctgctaccttcaagagacctatctcacatgtaatgacacccataggctcaaaataaagggatggagaaagatctttcatgcaaatggaaaccaaaagagaacagaggttgctactcttgtatcagataaaacaaactttaaaccaagaacagttaaaaaaaaaaaaaaagacaaagaagggtacaacataatgataaagagctcaattcaataagaagatatcgtatcctaaatatatatgtacccaacatcacaagacccagatttagaaactactactagaaccgaaaaagagagatagccataaaataacagtgggggacttcaacaccccaccagcagcactagacagatcatggcacaaaactaacaaaggtttggacataaattagactctcaacctaatggacctaatggacatctacaggatactccacctaactaccacagaatatacattcttctcatctgtgcatcgaacagtctctaaaattgaccacatgctcaatcataaagcaggtctcaataaattcaaaacaatcaaaatcatatcaagcatcttctcagaccacagtggaataaaatcaaaataaataccaagaggaaccctaagaatcacacaagtatatggaaactaaacaacctgctcctgaatgacttttgggtaaacaatgaaattaaggcagagataaaaaaaaattaattgaatcaaatgaaaataaagacacaacataccaaaacctctgagatacagaaaaagcagtattaagaagaaaatttacagtgctccatgactacaccaaaacacacaaagatctcaaattaacaacttaacaccacacttttaagaactagaaaggcaagaacaaactaaacccaaagctaacagaagaaataattatgatcagagcagaactaaatgaaattgagaccaaaaaaaaaccatacaaagtatcaacaacacaaaaagttagatatttgaaaagataaacaagattgacagactgctggctagattaaccaagaaaaaaagaaaagagattcaaataagcactatcagaaatgacaaaagtgacatcataactgacaccacagaaagacaaaagatcatcagagactactaagaacatctctatgtgcacaaattagaagacctagaggaaatggattaattcctagaaacacatcaccttccagactgaaccagaaagaaattgaaattctgaacagaccaataacaagttacgaaattcaatcagtaataataataataaaaaaaatctaccaaccaaaaaaagccctagaccagatggatttacagctaaattccaccagatgtacaaagaactggtaccaatcttactgaaactattccaaaaaattgaagagaggagatttctccttcacctcattctatgcaactagtattatcctgattccaaaacctagcaatgacataacaaaaaaagaaaactacaggtcaacattactgataaacatagacacaaaaatcctcaacaaaatgctatcaaactaaatccaacagcacatcaaagagatagttcaccatgatcaagtgggtttaacccttggatgcaaggacggttcaacaaacacaaatcaatgaatgtgatttaccacataaacagagttaaaagcaaaaataacataatcttctcaaaagacacagaaaaggcattcgataaaattcaatatcccttcataacgaaaatcctcaacaaacaaggcatcaaaggaacatacctgaaaatactaagagccatatatgacaaacccacagtcaacacaatactgaatgggcaatagttgaaagcattctccctaagaactggaacaagacaaggatgtccactctcaccactcctattcaacataatactggaagtcctagctggagcaatcaagcatgagaaagaaatataaggtacccaaataggaaaagatgaagacaaattaattatctctgtttgctgacaacatgattacatacccagaaaaccctaaagaatcctccaaaagactcatagacctgataaacaacttcagtaacttttcaacatacaaaagcaatgtacaaaactccacagcatcaactcatttgagaaactaaaaaataaaaattaaaaaataaataaaaataaaatctgcagcatttttatacaccaacaacattcaatctgagaaccaaatcaagaactcaatctcatttacaatagacacacacacacacacacacacacacacatatacaatacctagtatatataaccaaggaagtgaaagatctctacaaagagaactgtaaaacactgatgaaagaaatcatagatgacacgaatggaaaaacattccatgctcatggattagaagaatcaataacattaaaataaccacattgcccaaagcaatctacagattcagtgcaattcccatcaaattaccaatgccattttccccaaaatcagaaaaaaaaaatctaaaattcatatggaatcaaaaaaagagcctgaatagccaaagcaatccaaagcaaaaagaacaaatctagaagcatcacattacctgacttcaaaccatactacaaggctacagtaaccaaaacatcatagtactagtataaaaatagacacacagatcaatggaacaggatagagaatccagaaataaagtcacacagctacaactaactgatcttcagcaacgtcaacaaaaataaacaatggggaaaggacaccctattcaataaatggtgcgaggaaaactggctagccatttatggatgaacaaaactggacccctacctcttaccatatacaaaaattagctcaagattaaagacttacatgtaagacctcaaactataaaaaccctagaagaaaacctagaaaaaaacccttttgggcactggcctaagcaaataatttatgactaagacatcaaaaacaattgtgacaaaaaatgacaaatgggacttaaactaaagagcttctgcgtagcaaaagaaacaacacaataaacagacaacctacagaatgagagaaagtttttgcaaactatgcatccatcaaaagactaatatccagaatctataaggaacttaaacaaatgaacaagaaaaaacaaccccattaaaaagtgagcaaaggatatgaatagactcttctcaaatgaagacatataagaagccaacaaagatgaaaaaaatgctcagcatcactaatcatcagagcaatgcaaattaaaaccaaatgagatacatacaatctcatgccagtcagatgtgaaaaatgatacatgaacaaaatggtaacatcaataccactaccgtttatatctaccaatggtagatataaaacagaaaggaaccaataagaaattctggagattaaaagtataataactgaaatgaataattcactggaggagttcaaaagcacatttgagaagaaagaatcaacatgattgaagataaaccaatttaaattatcaaaattaacaaatgtttacctagattgactaagaaaaaaaaaaagactcaagttactaaaaccataatgaagtgggactattactacgaatcttacagaaataaaaaggattatgagagagtgctatgaacaatgtatgctaacaaactgtataacctagctgaagtggacaaattcccacaaacacaaaacataccaagactgaatcctgaagaaatgggaaactgaatcagtaataaaaaacctcaagatgaaataccctggacttgattgcttcactggtgaattctaccaaacatttaaaaaagaaccaacattgaccattctcaaaatctttttaaaaagaaaatgaagaggaaggaataaatcctaactcattctacaagccagcattaccctgataccaaagccaaaggcatacaagaaaaggaaactacagaccaataccccttatgaatactaatgcaaaaatcctcaacaaaatactggcaaactaaattctgcactgtgttaaaagcattatacacaatttccaagagggatttattcctggaatgcaagaatggctcaacatatgaaaatctgtcaatgtaataatatgacagattggtagaacgaaaggaaaaaacacatggtcatcctaattcatggagaaaagttatttgacaaaattcaacatcctttcatgataaaaacactaaagtagaagggaacaatctcaacataataaaaattcatagttgacattatactcaatgttgaaagactgaaagcttttcctgtaagatcaggatcaagacaaggaacaagacaaggatgcctgctttttccacttcgattcaacacagtactggatggtctagccagagcaattaggcaagaaaaaagaaataaaaggtattcaaattggaatgaatgaagcaaaatgatttctattcataaatgatatgatcttatatgcagaaaaccctgaaagttccacacaaaaaactatcaggataaaggaactcagcaaagtatgatattaaatcaacacacaacaattaagtcagttgtttctatatactaccaataaataattcaaaaaaagcaattaagaaaacaatttcataaatgatagcatcaaaaaatacttaggaattaacaaagatgatgaaagactcatacaatgaaaactactaaacaatactgaaagaaattaaagaagacatcaataaatagaaaaagcactccatgttaatggattggaatacttaacattgttatctgtaataagcaaaatgaccagattcaatttaatcccaatcaaaaccccaatgacattctttgcaaacaatagaaaatacatcttaaaattcatatgaaatctcaaatgaccttcaacagccaaaacaatcttgacaagaaaaactcttagaagaaaacacaggggaaaatcctcatactcattagagtagctataataaaaaacaagaaaatagcgagcgttggtgaggataggaagaaattagaacctttatacaatactgatgggaaagtaaaatgatacagtcactatggaaaacagtatggtgtttccagaaagaataaaacacagaattaccgtatgatccagtaattctactgctgggtatatacccaaaggaactgaaagcaaggtgtcaaaaaggtacttgtcactcatgttcctagcagcaagcagtatttagaacagccaaaaagtggaagcaactcaagtgtccatcaacagatgaataaacaaaatatggtacatacttacaatagaatattcagcttttcaaagaaagaaaattctgacacatgctgcaacataaactttgaaaacattatgctaaatgaaataagccggtcacacacaaaagtactttataattgcacttatatgatgttcctagaatagtcaaattcacagagaaagcaaatagaatgatggttgcctgggatggagaggagggagtagaaatgagagttgttggttaacaggtacagagtttccattttgcaagatgaaaagagtttttgggattggatgcacaaccatgtgaacgtactcagcactactaagcttaagaatggttaagatacattttatgctatgtatattacatttttaaaattaaaaatatgatttaaacatttgctatttaaaatggtctttctcacattcaattttagttccaatgggaaaagactgtttcagtgcgatgtataaacacattattgacaccgtcttacggatgtaaattttctatattaactcctaaaatgcaaccctatccccaaaaaatgtaccacacaaaaagttgatagctctaacataaatttttcagtaaaatgaagttatttcaactaagtttctagagaaaaaataaagataaaatgtaaatagtaaacaatacattactgattaatttgtactacacttcctttcatgttcatttctgttcttcacacaacaaaacaaaggaagcaaatatcatattaagcacttttcacttcagagaagaaaaatctctagatttagcaaccataaaaagaaacctaatgaagaactagaaaggagaaaggaaaatgtaggtatcagtgattgtgtcataacaaatacagataaggaaaagcagcataccctctcccacatacatctttaccacacatctgtcaaatggcacattagtaagcacagaaatatgtataatgacatactttaaccatatactgtatttatttatttattttttgagatggagtttcgctcttgttgcccaggctggagtgcactggcacgatctcggctcaccgcaacccctgccgagatcgcaccattgcactccagtgattttcctgcctcagccccgagtagctaggattgcaggcatgcaccaccaggcccagctaatttttgtatttttagtaagagacagggtttcaccaagttggccaggctggtctcaaactcctgacctcaagtgatctgcctgcctcagcctcccaaagtgctgggattataggtatgagccaccgcgaccggcctcattgtggttttgatttgcgtttccctgaagactgacaacgttgagcatcttttcatgtgcttatcggtcgtttgcatatcttcttttgagaaatgtctattcaactcttttgcctatttcttcatggggttgtctttttattgttaagttttaaaagttctttatatattctggatacatgttgttcctcatatatatgatctgcaaatattttctcacattctatgttttgtcactccactatcttgatggtgttctctgacacacaaaagtatttgattttgaccaagtccattgtgtctaatttttatcttgttgtttgtgcttttgatgttatatctaaaaagaccatacattttaatattaaactccatgtcaataaaagaatggattggaaaagaaatgacataagaatcaaagcaaaaaaacaaaattattggggactcaaatccagaatcaattttcttgtaataaagaagccgtacatattatcataaagtattgacttgtaaatacaatagtgatctgtctgctcaaagtttgaatggactttgtactaatgagtgaaaagtgaaagccctcaaggaaaataatacataaataatttccaatcactgcattaagataaaatttagctgttttaaggcttttaacctacaaaattaaaagatatttttggtcagtaaaaaagtcagaagtataaccttcctctacaaatgaaacacttacctgctaagtaattctaatccagcagagtactttggcaaaaatggaacagtcctgcccaaaagaaacacttattaaaactgttcttgatttagccaactgaaaaaaaaaaaaaggtacatacaagaattttgacattgtcaattgtaatatattttaaaatcactaatgacaattattaaacttttagagaaatgtgttttatttcagagttaatgtactgtatgtaacacactatcaaccatcattttgccccagagattctcttcagcatacaataaattatttaatataatgttggataagaacaaatatgtaagatcacagttcatttctaggttgaaaatgaaatctggtcacatgctttactttattaaaaaaatggacaaacagcacaatcctggtgttttcatacaaaacaggtaacatagctgaagaggctcatttgccaagtagtatttcatcattaatttgcttttcaataattcaggacttttacttttgctcttatacaaattaaaaatgactaattgtgatcaaataatactcattgactgtcagagtaaaacaattatacttcaccattttttcaaccatttcacgattttattagaaaattttcctgttacaaaatttagaaagaatcgataaattattttgtagtcagatgcactcaacaaatctaaggttcattaatataactacacaattgtgaatacaccaaaagttgtatgaaatttaagtcacagttaagttaaaatcttagcacaagcttacctgggtttgcttttcacttttgcttctcttgacttgtcacttaaagtcttcagcctataattcaatataaaatataatatttttacaagtcaagagattattattatttttttgagacagggtctcactctgtcgtccaggctggagtgcagtgacatgtacattactcactgcagcctcaatcctgggcccaagtgatcctcccacctcatcctcctgagtagctgggactatagtcacccgccaccacgcctgggtaatttctttttttatttagtggagacggagtcttgctatgttgcccaagctggtctcataccccatgcctcaaatgatcctcctgcctcagcctcccaaaatgctgggattacaggcatgagccaccccacccagcccagagatttttcaaccacaaattttcacatgttaaaattttaggtcagataagctacttttttttttttaagcaagaattaagtacctcaaaagacaacaaatatttgagtgtttactatatgttagatactacaaacggaaaatctgtagcaaatttttttttaagagatggtctcactctgttgcccaggctagagtatagtggtgcgattgtagcttactgtaacctcaaactcttgggctcaagcaatcttcccacctcagcctcctgggtaacaaggatgacaggtatgtgccaccatgcccagctatttgtttcacttttattttggtctcactatgttgcccagtctggtctctatctcctggcctcaagtgatcttcccacctcagcctccccatagagctgggattataggtgtgtgctaccacgccaggccttattttcatattcttacttaccccaagccccttttttagaaaccaagattcctaaatgtgatcagaccacaaaaacataatttatctggcatctttagaaaaagtaatgttccacataggagaaatcgataggtaacaaagatatctaagcagcacacttcattaagtagatgctacccaggccttcaaatctctttaagcatccacagtatttgaaattttagttgagaaaaagctttttaaaatatattacaaacttctttcattaaagaggattttgtatatctcatttaacattttgtgatgactcaggatcagtattaagaatatcattgactacattttgcagcaaaacagtactctcccctgatacttctgagctagaaatgcatcttcatctattaacctgaaaccaatctatggtagttttgtgtttgtttgggctcttatgtctacctttcctaaattttctttctctaccattggtcacctggatgtcagctctcactcactgcttctgccagctatttaattctagcagtctcctcccctctacttgctgcttttaaattattgcactggaaaacagataaatgggctagagctgcatatatagaattaacagactcttttaatgtaaaatatgatgttcataaactgtacaatttattttcacttcactggcccagttttactttattttggctgtggactctgttacagataactgaggttgccaataagtgagtgctacagtatgcagtaatatcacataaaatgagatatcatgtacacattcttctcaatcacttcaacaagtactcatttgtaaatagaaactgaaaatataggccacagtactactgctagcccctacaaagtctttgtaaaaacagaaatagctgctccttcctccagacactttactgccatcagccagaaactgtcctaatacacaagttgactcttgcatgaatgcctcaactaatgcatggtacagtatacaatctgcacaactatgcatgctggttctgaaacaggattccatcttttctgtctataacgtctgattaagcaccatatggggacttctgataaactgcatttttttaaaaccaaattagaatgccaatgtcatacaaagagtttcatattactctatgatctttttcaaaaaataaaatattgacaagatcaattcctctgcaatattcaaaagattcagcaatctctttaatacaaaagtaattagtatacctctctagataagtctaggaaattgtgtaaaagtctaatataaatttctcagtttatcctggaaactagtaaatctggtttaaaccaagattaagcaaaacctagggaaaacaatttttatggccatgctctaccatttccactataaagtttgatcaaaatacttagttggaacatctcaggcaaaattatcctagttatatacagcagtgcctcatactcaaaatgattctcgcattatttttagtgattcaggagaattctatacagctgagtgtgaaagggaattcctaagatcctctttggactactctaattatatgatccagcaaatctctaagttggtatttcaactatttatttctaaaacaaacttttactttcttaattgtaatatgccaagtttggaattctcttctctgcccccctaccccatctcctccccgccaccgacaaaaagaaaaaaccggtttgaaatgaaagggaaaaaaggagtgttacagggaacagaaagtaaaattgttggaagattcaacaaaagattccccatgtggctctttaacagtcatctgttttaaaaattggtctttaaccaaatttaatgtgtgaaacttatctgatctggatttgaacaaaccaactgtaaaaagtcgtttctaagaacaaaagaagtctgattatggactgcataattgataatatcaaagaattagtgttaattttattagttatgacatcagcactgcatttatgtaatgtgtttcctttttagtgatgcaagctgacatatcacaggtatagtaggcaagtctgagatttacattataaataaagggagagacaaggcaaacgtggcagtatctgaaaactgttgaatctcagcaatggatatatgtggttcattgtgttattctatttgtgtgtgtgtttgagactttgtaaaatacaattttttttttgagacagggtcttgctgtgtcacccagactggagtgcaatggagcaatcatagctcactgcagcctcaagctcctggccttaagcgatcctcccaccttagcctctcaagtagctgggactacaggctcacaccagcacacccagctagtttttaaaaaccctttgtagagacaggggtctccctatgttgcccaggctggtcttgaactcatgggctcaagctatcctcccacctcagcctccccaagtgctgggattagaagcatgaaccaccatatccagccaaaaaacatttttaataacaaaaacaatcttttaggtattcatcttttctcaccacttcttctccaaataaatggccaatgtgccaaaatgcagaaaagaaactgttggagaaaacaaagtagctataggaaagttggaaatagtcatctttttccctgctaaaaaataaaaacaaagtaaaaaacaaagtagctataggaaagtaaaacgaagttaaaaaaaaaaaaaagtaaaaaaacaaagtagccataggaaagttgaaaatagtcatctttttgcctgctaaactttcttgattgtttccaactattattcttaagatgaaaaatataaaagatcagatatacttaagaaagtaacaaaaagccaaaaaggtattttctaaaataacatcctcaaaacccagaattcacctgaaattagcccactatttttattttaggataactccagtttctctggagaacttattctgtcctggaaacaacccacttataacgtctgtttaatgtcctacaatatcatgacatgctgtgaaggaaatactgacctagggggaatattccagtttcctcaaatgtaaaatggtagtattatactcaaccataaagatttgccatgagaattgaataaaattccaaatatgaccttaatggcattctggaaactacagagctaatttcaaatgaaagttataataaaggtgatccccatcaagaaagccgagaaaccaatgtactacattactgggctaaggtgaaataaagcagaggttcccaatgtgcctacaaaaggcttgcccagccctattcttggtcttctcccaagtaccatacaccccatgaacacataagtgctgtgtgagcatattaatatatagactaagtgagccatctgacaactattttctactaatgacaactttcaagttcaaagcactaaacctcaaattcgtcataaagttcaataattttatttttagatagctccaacgacttcaccttaatttgacaccagcatatttatgtctttgagctttgtagaaaatactaaaatgggggcttcttactgaaaaaggggggtgactcacaaaactgcttagacaaaaagtgtaaaaggatgtaaataagcctgggcaacatggcgaaaccctgtcttccaaatatacacaaattagccaggcgtggtggtgtatgcctgtagtcccagctacttggaaggctgaggtgggtggattgcttgaacccaggaggttgaggctgcagtgagccatgagcataccacagcactgcagcctgggtgacagagtgagaccctgtctcagagaaaaaaagaaaagaaaaagatgtagataaacagaatgatgcattgagtactacaatgactgctgagatctgccggtgattcaacagcgtgcggaacctgcatgacgtttcatttacttgtaactcaatttccaactgtctacatcattggctattaggaaaggtgaggacgattgctttaaagcaccacagaaatgtatgaattagcatattttgtcataaggcacatccaatctattacattttcacatcagtgttcatcattttttttctctcttaagcgagatcagggaaaagccaaagcctcaatcacacttaaaagtgcaaatggcctaaggtacaaagcctaagaaattcacacaaaagctgcacagactcaggaaagaaagatgaatttagactatctacatcctaatgcctttatcctaagtcccaaatacatggcttcaagttctcacttctcacctgagcgcaagagaaatttccaattgcttctcagctgtcaagcagctagctcatcacaaattcactgttaactgttccttctctctcaaacctattgttaaattctttaatgctggtatatgacaccatttatctaagatacttccaaattcacattctcaatttctgcacctttttcatctcccactgctgtctaatctgaccagtgcctaacacatctattccctcctttaaacttctatcagcactgccttatcttctctcatctggaccttcattacagcctcctaaataatctccctctaccccatcccctatcttcctatcacacagcctctcaagttattcttccagaaacacagaaatatttttccagaaatacaggtaggccatcttctccttagcctgatttttagccacagaacttatggccgtctagatattctagacagtctgctactagaacgagagtaaggatcttacttgctatctggtttgttctctgctatatccccagtacctaaaatagtgcctgccacatagtaagcactcaataaatatttgacaaattaattaagcaaagcattgaagatattctattattaggcactaaacttcctttccagcttcatctcccaggactgcttccatctctgaaatgtgcttatccaaatctatcgcaatttctcctcattattcaaggcctagttttagaaaccccttcctctttgaagccttctgtaaatgcatcctaactaatgactctttcttcggactcacataccacactatttgtatctttaacattctgttcattctgctttgctttatatcagcaccagtctagggcatctggtggacagagactgttttagacacctttgtacctgcaggatctggcccaatatatagacattgtttaggaaagactaggcaaacctgagcatatgggctctcaaatcttttttaagcttctatgaaaaaggacactttgagtgcctagtctaatgtctggcactggcacttaataggaactctgtagatatttatgaaatcaagttgaatactgagattattttctctttaagatgatgattaatcccggaaaagtcaacatttcaagcaacacttcaccatttgaccacattgtaatttagatgactggctccaaccccctttgtgtaggttttggtagatactacaaggacggaagaagacagaatgaggacactgggcaggggtgcaggtgggcggcaggggcagtgagggctttgagggggaaacaccctctagctgcaacaatagcaggtttttttatccccaaccacaggaacccagtgcatcacaaataggaaacaccagcctgtgacaggcagctgtaaacccgtcagtaaatctgattttcagttccctgaagggtttgcatgcctaaatacctcaatcctgaggcctttggtcgtaacagctcaaaaggtaaaagtcaaagaccagagtggcttcgaagtatgtactttggtatgtccaaaagtcttccccagagctcaagccaatctctgtaaaaatggatattttatgtgaactctccaaaaggctccaagaattctgactcagttaaatcaaattacaactcactttaggtgaggggaaaagatctttgagtgaagctcagaaccaatcctcttcagtctgtggcctaaggctggcccaccacccaattaaggcaggaagaatgtgatgtaatcactagtttttctcaaggttgacataattgttactacgcataaaaatttacaaaaaaggccataagtccatggacaacctagagctccccccaaaccaccagtaatctctacactgcccttaaagaacaatggtcttaagctgcactttttcaaagtttgaatggaatgtagaaatttattcttattggacatggtttcatcaccaaagtgacattctgagactgataaggaatcgttctattttactaaaaatgaaaaaaagtaaatttatctagagttagggccttcatatgagttttcagaaagtgaaaatgatcacagaagctccgaagagaggatgctgctctgggcgacagcgggagctgcactggctgcactgaaggagcccagaaatgcctgaggccttccattccatccctggggcagcctgcacacccggtgtttccaattattttagaaggcagctgctctggcttccacacaattgctctgccaccaagtgttctacagaaacgccaggtccaatgtgatagctctgggtggccagggccatgttttttcattttttctttcttttttaagagatggggtttctttctttttttttttttttgagacggagtctccctctgtcacccagtctggagtgcagtggtgtgatctcggctcactgcaacctccacctcctggattcaagagattcttctgcctcagccttccaagtagctggaattacagacgcacgccaccatggccagctaatttttgtattttttagtggagacggggtttcaccacgttggccaagctggtcttgaactcctgacctcatgatccgcctgcttcgggctcccaaagtgctgggattacaggtgtgagccaccgcacccagccaaaagatggggtttctttgtgttgcccagtcttgaactcctgggctcaagggatcctcctgcctcagcctcccaagtagctgggacaacaaaattgttggaagattccataaagcttccccatgtggccctttaacagtcgtctgttttaaaaattggtttttaaacagatttaatgtgtgaaacttatctgatctggatttgaacaaaccaactgtaaaaagtcatttctaagcacaaaacaaatctgattatggactgcataattgataatatcaaaaaattagtgttaattttattatctatgatatcagcattgcatttatgtaatatgtttcttttttagtgatgcagctcacgtctctttcatctttgaattccacattaccaacatataataaacacatgtgtgctgtgtttagcgtcatcttttctcctcaaggcaaaaataatcagttatgtaaaggaggttgatctcaagctgaatatggaaaagtttaaccgaacagcttaaatgtaggaaattgaggacctgaagaaagtgaacatcaggcactagaggtccgggtctactgggagactgacatcacttggagatgagttgtttctccaccaggtgacaggctaatggcacacactgacagtccagtggtttgtcagctgaaagtgacctgtacaggagaaagccaacaaaagacctaatgaagccctctcaggatgtctagctccaaaatggccccagactacggcatctttaagaagtcaagtcagtttccaaggggttctaactagatccctttggcatgtctctccttaactaactctaaacgtttagggttaccctgatctcccaggatggtttgtgccccagcagtccagagcccactccagaatctacattccggggtaaaatgccttcttacaaaggtcaggagcatgaatgcttctgaggcaaccatgtgacctagagttatagtaactacaagatgggctcttgtgccatcaaggaattccatgaagtactaacaggagaataatggccactctcatgctacaaatgggccatttcagcatcacaccaaaaagttttcaatacaataatttacgctctgaaaagaaggtacttttactaaatagggagaacaaaatgcaagcacgcaagcacacccatcagtgaatgactccgagcgtccataactttctaaacaccaaactaacaaaaatgattgacgcatggtaagtgctcaagcgtttgacagtttgttattcaacgcccaatgtgcaaatagtattaacatttttgtccattaagataaaattttggctaacatctttctcattagaaatttaaaacgaggctgggcgcagtgactaatacccataatcccaccacttcaggaagcctaggagggaggatctcttgtacccaggagttggaggctgcagcgagctataatagcgccactgcgctccagcctgggcaacagagcgagaacttgtcactttaaaaaaaagggggggagggtgggccgggaacggtggcacacgcctgtaatcccagcactttgggaggccaaggcgggaggatcacaaggtcaggagttcgagaccagcctggccaatatggtgaaacccgtctctactaaaaaatacaaaaataagccgggcgcctctagtcccagctactcaggaggtggagccaggagaatcgcttgaatccgggaggcggcggttgcagtgagccgagatcacgccactgcactccagtctgggtgacagagcaagactccatctcaaaaaaaaggggggtgggggggagaaatttaaaacagtatgagtggaaatgttctcacattcagtgcatcctccaacaggatttgtaagctaaagttgaaagatccttttcaaagacagatctttttcactttaaaggaatgaaaaaattaaaattaagcactaagtaacaatactgacatgatgcttgcttcgtgttttacacattaattcattaatccttgtaataaccttttaagtaccatcattatccccattttacggtagcggaaacagtacattgaggcaaggcagctgagtaactacgtttgatttagtggtcgagccaggatgcctaggcaatctggcgccagagtctcggcctgtggttcccaggcgttggtgcccactggaatcccctggggatctttaaaacgccgtctccaggcactctggtcaacaggtagggggtgagacctgggcatcagaactctgaaaggttcccaggtgattctaagcaaagtttgggaaccgctgggtattaaaagcattcctaaagttctgtcgcttctcctgcttaggagttccttcgccgaggcgctgagctcacggcaaaggtagagaaaggacgcaacggggaggggcggccagccttgccaagggttaggccggcgagccgggcgtgaaagccgagacgcggcgcggaaggctgtggccggagggtgcaggctgctgcgcggtgcgatccgactcggggagggtggctggcccagctccaggtgcgcacgagcaggtgtctgctgggccgaggggcgcaggccactgtgccgcgggggcggaagcggtgaggcgcgctggcttctcacatgacttccctccagggcccagctgatgctgccgggaaaggaccgcagggtcccacaccccccccgggcgctccgctgcgccgccgagcgcctcccggtcctggggggtgcgcgtcacaggcggcccgcagggacctaagttactttgcgccgcccgacgcgaggacgccgggaagttcgttactttcctcggcggggcggggcggggaggtgcgggacaggacggaccctggaccgtggcgcggggaagggagcgaggcaggggcatcccaggcggcggcccggccccctcaggtcccttttcgtcgcccaccgtatacccacccggaggtgaaatcctgctgcacgctcagcagccgctcgcgaagggtctccagcattgccgccgccgccggtctcctctcctcaggcctcgggctgctgctgcctctgtcgccccctgggtcccacgccgccaaccccgcgctgtcaccgcgcgccccgcactcccactaccggccccgcccccggtctggtcctcgccgccgcgccgcaaccccagccccttccgcgttcccgccccgcgcgcgccaggctcgcgcagccgcagtggactgcgccgggctcgggctgcggaaaaggggcgggtcttcccccgaccgagagggccagtagctcctcggctcattcctatcccgcaccaggccttctcgtttttttttttttttctttaaaatggaagcggcatcgtgaaaggatgatttaactcgaagcctcctttgagggaagtgttggcttttacgttttggaagagaattggatctctctcttcaataggcgatgtgcacaaatcattgcatggattctaggtccaggatctgaccccactggctttcaccttgaatgagacagtcaaatattgagcctcggtttcttcattcataaaatggcaataatagtcgactgtctcgacattcttactttccactctctctttacccccccaggcttttgtgccctacacaccaaaggtgatcgcctttcgcgagtcaccagtgacttccatgttgctgatgccttttattacttctctgccctgattttttctccacctctcagtggctttcaatgcagtttatcatccccatccttaaaacactttcttctcttgctaagcactccatagttcctctctcccttccgctccaccccttctcctattttaatagccactcccaaggctacagtccagcctccccagctcttctctcttctccagatgtgttgttccatagatggatagcatagagtctatccattaccacgctgtaaattctgtcaaggaaccgatgactcccacagctctatcttctgccctgtccttcctccctctccgtcaattcataccagttgcttactcatgtaagcatgtatacaacatgtatccaaaaggcatctcagaccaacatacacaaaattgaaaatttcattcattgcatgttcacctttaatctgctcatcctgtattttccgtttcagtaaatgacaccaccatccaccaatttgctcaaggtaagacacttgaaatcacctctggttcccctcttttcctcattccccatattaacccatcaaatccaatcaactctactcctgaagtatttctggaacctccttctctttctatatcttcactatatttatcctggtcgaaggcaccatcctctttcaatgggaacacagacagttcttccagattctactcttttgccatacacacccctataatccatccttgacacagcagccagaaagagttatttaaaagatcaatcggatcacgttgctcccctgcttaaaatcttccaattgcctcctgggcacttggaataaaattcaaactacttacccccttaaaaagccctaaaatttgaatgttttctagcactgtatccaaattgattactagtcacctatcatgtccttgacaattaagacataatagccttttttttttttttttttttggtgtgttcttagaaaattccaggtttatttccacctgtggtgttttcacaaacttttctccaaactgtcccttgtctggctccttataacataagggtcacatcctaaatagcatcacattagataggttttacttaccattcaagttacacacccaatcacttcctatcacgtagcctgtttctcaacttagtacacattagaaaatttattcaataattatttgctatttattaatttagttgtttacaaacatattttaaaaccacgacaaataaggcattcacctcaggtacaaaatttacgggagccaaaaagctcagtaatcaagataagtaatattttaatacaatatttaaaaaattcaaaattaatgaaaaaaaatctgtgatgaacaaaatatcaaaattttaaatacacaggatctgttagggctgggattggatgaggccagtgaggtaagtagcacaagtacaggcccagatgtaaactgctctgtcttattaagctttgcatccccagcaatgaaaacagtgaatggcacataacagacacccagtaaatgtcttgttgcaggagttaaataagataaaggacttagcttgtagctgggggaccacctcttccccactcttgatgttttcttccatgggaagggagctcttctgctaacataaagaagtacccagcctctcctggtggggaagaggtgactacgatgattagtgagctagaagtaaggagcttggtctcatcttcttttctttttgttgagtgaacacttccaacaaagagcattcattctgctgcctaaagacaggcttgaagggcaacccagtgctttttgtgactgggtactagaagttctgcttgcccatgaatataagccatgtgttccatcagtcttcctagatataaaagtgatattttggcctctttatgctgacactattgttttatttctcagtttgctcagacaagtaagaaagaggagtgctgtttattgagccttcttctacctctcagaaacagtgcctggaacaaagcaagtgatcaaatgatcaaatctacagacaggtcccttagtatctagtagatttgaaaaccacaagtactgggaaatattaaatttttttcttttattcaattaaactctacacataagctttcaatttactaagtttcatacattccaacaaagcaccaaatccactcaaaaaagactcttgcctgtcactaaaaaatagctttactggttgtgcctgatcatttctgtcttgaccaatgcactgtttattagtctatggcatgtttgtatttgaggtgctttctgaacattcttaattccatcatatctattaaattaaaaaacagtgaaagttttaaaagtgctaataaaaagataatttatgatttaaagaagtaaatattaaaaaaattagaaaataactactgttgtacatgagttgctcaggaggaatgattaaggaccaagagttgaagcatgtgacatgtcgtgtttacataagtaacagtaatcagccagaaactaggaagatggattggcaaaatgaaaaaaaaaacaaagcttttaagtacagtttgagaaccaacatcagtatggaagctattgacctaatcttaattcaggaattggttgagagttgattgttgtttgtttggggtttttttgtttgttttgttttaagacggagtctccctctgtcacctaggctggagtgcagtggtgcaatcttggctcactgtagcctccacctcctgggttcaagtgattctcctgcctcagcctcctgggtagctgggattacaggcttccgccaccacgcccagctaatttttgtatttttagtagagacaaggtttcactatgttggacaggctggtctcaaactcctgacctcaagtgatccgcctgccttggcctcccaaaatgctgggattacaggcatgagccaccgcgcccagcagagagttgattttttgagagcatattagttgcgcccaggaaaagctttggtgatacaacgtttggggtgagcaccaaagctgctaagaagtttcctgaaatagtgcttccctgaccagcagcagccgcatcatctgggagcttcctgcaaaggtagaatcgtaggccccagccagccctactgaatcagaatctgagttttattaagaccccccgggtgatttttattcatgttaacatttgagaagccctactcgttgatgaaagggggtttcctgtctcagcagattcttattggagacaaagtgataaatgaggatttggcggagttagaaccaaagagaaagatgctattaaagaaggggtggtacgaaagaaaccaccatcagagcgaacaggcaacctacagaatgggagaaaatttttgcaatctactcatcggacaaagggctaatatccagaatctacaatgaactcaaacaaatttacaagaaaaaaacaaccccatcaacaagtgggcaaaggatgtgaacagacacttctcaaaagaagacatttatgcagccaaaagacacatgaaaaaatgctcatcatcgctgaccatcagagaaatgcaaatcaaaaccacaatgagataccatctcacaccagttagaatggcgatcactaaaaagtcaggaaacaacaggtgctggagagaatgtggagaaataggaacacttttacactgttggtgggactgtaaactagttcaaccattgtggaagtcagtgtggcgattcctcagggatctagaactagaaataccatttgacccagccatcccattactgggtatatacccaaaggactgtaaatcatgctgctataaagacacatgaacacatatgtttattgtggcactattcgcaatagcaaagacttggaaccaacccaaatgtccaacaatgatagactggattaagaaaacgtggcacatatacaccatggaatactatgcagtgaaaaaaatgatgagttcatgtcctttgtagggacatggatgaagctggaaaccattattctcggcaaactatcgcaaggacaaaaaaccaaacaccgcatgttctcactcattggtgggaattgaacagtgagaacacatggacacaggaaggggaacatcatacactggggcctgttgtggggtggagggaggcgggagggatagcattaggagatatacctaatgttaaatgacgagttaatgggtgcagcacaccaacttggcacatgtaccctaaaacttaaagtataataataataaaaaaaaagcaggaaaaaaaagaaggggctgtagaacccagaaaagttcataccatttcattggcagagctcttttagagtaattggaaagggactatggttaattgctttgcaggaacctgacttagatttgtaaagatatttacagtgtgttgttattatttgtgatgtttttaaaaagccaacatgtaaatatttttgatatctttaatttttaagagtttaatggttacagaagaatccatgtaaaagctgtaaatgtttctcgtgaagcaatgagtatttttaagaatgaggtaagctagataaagctggaaaggtgatatcagcacagcattttgaaaagaaaagcagagacagaaatcagggaggtgaaggaggagagttccaacctcagagagtaaagattagaacgcagctgaagaacaggagagaagggggtagttagagaatatcaaggtcggaagacagaagctataataatagatctagacggcaagcactgtcgggagtgacagcaaggttggaaatgagtattttacctgagctgaacggaaagaacagtaaaaggatctcagctgcatctatttgtgttccaaaattgtatcccactgtcataaaatgactgggcacctaaccttatctttttgctcagatgaaaaaagaaggcactacactgttgcattaaaggaggaaaacgtttattttttgttaatatgtgtttagatctatataatctataaagatacattacaggaggaaaacttttattttttgttattctatggttggatctatatggtctataagatatccataaacgaccaagtgactccattcatcaaagcgtagggactctacatgagtaaaggaaaccacgtcctgtactcttacaaatagatggttcccccagagagaatacatctcagaaatcacatcttctgaactactgtgccatagaaatatatttgtgtgggaaaacttaataacaaactgaaactctttaataagaattagtggccaaaaaaaaaaagtttgagacaatgattacttagagctaactatcaggtcaatacatgctggtgggggagccgtaataattgatcattagtagttaaaataattgatgattataattgcagttaagtaatagttttcaagcctggctgcaccttcaaatcacatggggagcattttagaaataccagtgcctgacctcagcacccccagagcacctggtttaactggtctaaggtgatgtctcctccttcatgcggtttaaaagcttccctggtgattctaacatgcaggcagggctgggaaccactgagctaagcagagagacttaagctgccctgcaggggaaggcaacgatgacttcagaatccatgaacttcaggagtcaaggctgcagtttgtcctcacctttcccagctcattcaaacaggcactagccccatcactttattgtacccaaacccctgtagcctccatctctgctggctggttctgaaggcaacagtgtgaggcaggggcagaggagaaagctaaaccaggcctggataagtgaggcagcagctgagatgtgctcgggcttccccaggggttgtgttttgttgttgttgttttgtttgttttgttttgttttttcaaaaatacctactcagcaaagagaggaaatccaagaaccaactgtgcctggagacttagccaggccttctggaactggaagactcttgttgccagtgatggggttcagaacatgctaccccaaaatatggtaccctgggcatttgcgaaaaccacagaagcaggttttgtctgacacacatccccttctcccctgaagcaggtcctaaaaccccagaaaggatttcccagccttctcctgtagcaagtcacatgagcagtaccccatgtgaaaggtaccatccttatacatggaagaaaggagctgaagactaaaagatgccaagaagaatctgaacaaacaagtcttgctaagtttccctccatttattaccgctgagccatacctttgtgtcctcctagcaaacttctctatgactgtccattttttatcaaacctaaccataaaaatacacaagattacctgttcctttgggtcttcatttccttatgaaggctcccgtgtcacattaaacttaataaatttgtatgctttgctcttgttcatctttttgttatagggttcccagccatgaacctgagatggtaaggaaagctatttcttctccgctataccattggggaaacaacaaaccctctagtgtcctaacaggagctctggtagctgtcatttcagagaaactgtcttgtttcctctccaagtgactcctccagtcccatttatctttctgactctccctgcttctaccttttcttctttctactctctgctttcccatataacattggccacctcatggcttcagcttaacaactcctctctccaagtctcgtggtttctgccactgctaccaactacaccgctccctgggtgaccagaagaaggatctgaatgctttcaccagtcctcttttaccccagaatgcctcacataagcaaaatcctgtaccaggccacctcatgctgtgcatgtctgcctgtatgcccagtaccactccctggccaagtctacggtgaccagggttgcagagtcaaaccgtacaaaacatgtacaagaagtgcttttggccttttttctcccttagagggggactctgaggggctgtttctgcgaatttgcaagggggtgaataaacccataatggctaaattcgagataatgtattcagtgtgttacctggtaatgttttcacttgtgttgcttcaattcagaggtttagacaaaataaatggtaagttttcaaacattgcctttgtgatatgctgagaatctcaacaagggaaggagggaagtaaactagttcttatgtacagaaatattgggttcctttgcttctatgtattgtctctgtttatacacaaataaaagtgaacagatgtacctgttgtcttaataaaccattttttatgccaatgaggagcttgtggcatatactgaataatctagtcctctgctaccagaattctgttcttgaaatgagtgtgattactttcctcatgcaacccaaattagcaccactcaccacccactggtacctagggaggaagcatggcattgagggggaattagctgatcaatggaggacttttaataaaacctcaacttttgaaaatagtggaaatgtcaaaggtgaaacagtatctaagagcaggatgctcatccttcctcttacccccttgttccacctggaggctgcagtgaagagaaaacatgaggctgttaagcagagcacgacggggaatagggcaggggagaacacaggtgcacaccacatctcctgatttcccattgctccctattattcatccctctgtcaggcaaggcttttctccttatggttttctgcagtgtcacctactcaacaaaaccacattgttaaggccccacctatactgggtgctctactagatgctgacagtaatggtattcatattgtcttaaattattgttatactaatgatgatggctatgatttactgagacttccatagtgccaaacaggattctaagcactttgcacatatcatttatccccttttacagattaggaaataaagtactgtaagacacataccaataaggtactgaagagcttctgatctagaggtgagacaatatccacaaggtgattagtgttttaaatatggctgtgatctgctgggtgtggtggcatgtgcctatagttccagctacttgggaggccaaggtgggacaattgcatgagccagggacatcgaggctgcaatgagccgtgatcatgccacacacgatctagcctgggcaacacagcgagaccctgtttcaaacaagaattaataaatacatctgtgactgcccagatgaagagtgactcaccttgtctttgctttggaagaaagagtcatcaaagggggtccattgctgggacagccttcagaaatgtaagtatctcagcataaactcctggaaggtggctgcaactgctgtggtgaggtttaggcatctgggccagcctccaaagccagctctcggcaaatgccacctggttatgtgaaaatcaaggcagccgagccagttcagcccctcaagcctttaggcgggttagccagggcatcacctccctcacagactggcaagaccctgggggaggggagacagagaagacaaagagtccaccagagcaaggcaagagtgggcgatacccatgccaggcacccaagccaggtgctctgcctcctggaagagagttgggagagggttacatggcccttggctggaatcctgctgtggagactgagggggaggtgggcaggggactccccttcatgggagcaagaggcttcccagggtacacgggaatcagagacatgggtgcgtggagggtgagcagccctggctctgaatgtaaagaggagaggggctctggctgggaaatctgtccaccctgttggccaaatctgaataccctgcttctcatttagtcatagacatcacccccaaatcctcacccagcctcacttcctcaaatcagaggactaaggcactgcccatctgtcagctggtgaaacaggatagattgcatcttggaggttagctgtgggggagtggcaagtcagaaatgtgttactgtccccatgccatcttgctcatactccagcagggtacagtctgggagcatgggtcatgctattttctcttcttaaaatgccttgtctactcataaggaaccataaaccatcctgtcttcatcttttaatatagaatattgccactaaatgtttgtaatactttattgcattttcatgattgcagctctaaatcaaatcaaatctgggagcttgtgccacaggccaaatgacattcagctgaagatcagagatccagccttcaaactggtccctctttccctcctcactgtcatttctttatgttctttttgcatttgaggcaaatgcatttcacccaaacctgatgatgcgttctgagagggatgagagtttccattaactccctatttcacatccatcactacatttaacctctcatataaagtctcaagttctttgccctaaaaatagctaggggctgaaatgggaattgaagtgaggattagtgtcagctg

SEQ ID NO: 264 - DNA, 184312 bp, Homo sapiens
tataatcaaggaactgccaatagctctcttgttggatagcataatggattccctacgtgtgtcttccatttctctcctttattgaatgtctatagtggttctttttatgcctgtcccatcagttatttgatttgttggagatggggttgggggtgtggacacagataactatttctccttagttcacaggtcttcatattgagagaaaccctgttgaggggttgtccttaaggaaccacagtcaaagagcctcatccatatgtagaaacacaaatggttagatcttgtactttgatgatgctgtaaaaggagagactattgggtaccctgggaagggggaagaagtatgttttgcatgtggagaaacataaatcactggagagcagagtgaaaactgttgtagccagacttctagatggcacccagtgatctttgcctcctggtatttctgccttagggtgattccccgcacactgaattagagctgaccatgtgaccagtggaatattatggaagtaatagagtgtgatttcccgaatagcttgggaaagacacagccacttctgccttggtttttttggattactagccttggagaaagtgacaaaggctctctccttgactaagctctactctagtcaggctcctctgaaccctattcttaactaggcctcgccctatagacatgacagattcttaacacaaacgatttcatccaccatcaccaccatccccacaaacactaagagacctggacaaccatgtagacttttcagtttggcttcctttatttagtaatctacatttaaattatctccatgtttttatatggcttgatagctcatttattttgagtgctaaataacattccatggtctggatgtgccatagtttatccattcacctactgaaggacatgttgattgtttccaagtttcagtaattatgaataaagttgctttaaatattctgtgcaggtttttctatggacataaattttcaacacattcagatagataccaaggagtattattgctaggtcagatggtaagagtatgttttgcaaggaactgccaactatcttccaaagtggctataccattttgcattcccatcaacaatgaatgagagttccaattgttccacatcttcaccagcatttgttgttgtcagtattttgggcttttttattccatattagttatagttatattagcttattagttctaggagttcgtcagtttcttcagattttttaggcaatcattaaactcagttttatttttcctttctgaaacttatatttccttttcttaacatattttattagataagacttccagtatgatgttgaaaaggaatggtgagaggggatagccttgccttgtcccttatcttagtgggaaagcttctagtttctcaccattaagtatgatataagctgtaagttttctgcagatgttctttatcaagttggggaagttccctctctatccctagttagaaagtttttatcatgaatgaatattaaattttgtctaatggttttcttcatctattgatatagtcatgtgattttcctactttagcccatagatgtgatggattacattgatttttttaatgttaaatctgccttgcatgcccaaattaaaatccacttggtcatagtgtattttcttatacatttttggactcaatttgctaatattctgttgagaatttttgtatcaatgttcatgagagatattgttttcattttaataatatctttggtttgggtacagggtaatgctaacttcatagaattgagttaggaagtattttctctgtttatgtcttttggaagatattatagagaattggtataatttcttctttaaatgtttggcagaattcttcgctagtagacccacatgggtccagtgctttctgttttgaaaggttattaattactgatttaatgtatttaataggtataggttgactcagattatctttcttcttgtgtgagttttggcagatgtctttcaaagatttggtccatttaatccaggttatcaaatttgtggacatagaattgttgtttatagtatttctttattaccttataatattcatgggatctgtagtaatgtcccctcttccttttctgatcttagtaatttggagactttctcttttttccttagcttggctagaggtttattaattttctctcttttcaaagaaccagcttttagtcccattgatttttctctattgacttcctattttcaatttcattgatttctgtctaatttttattatttttctttggcttactttggatttaatttgctcttttaaaaaagttccctaaggaggaatgttattgattttagatctttcttcttttctagtatatgaatgcactgctacagatttccctctaagcactgcattcattgcatcccacaaattttgatgttttatttttatttagttcaaattttaaatttattgagatttcttctttgacccatgtgttatttagaagtgtgttgtttaacctacaagtcttttggggtcttttggccaaactcttttttaattaaagaaacctaaaagactgacagtatccaatactgatgaagagatgggttaaaaggtaggctcatacactatggtactataaactggtacagtatttttggagtgcactttggtatgctttacaaaaaataaaaaattaaatgtccatttcctataatcaggaaaaggcaaaagtcaattttaatgctcatcaagactgaatactatttatcagttgggataagctatgttgcagtagcagatgaatgacaaaatctcactgaaaacagagcaggtgcttatttcttgtgtaaatcagaaattatcggagacaattctcaatcaatttagaagtttattttgtcaacattaaggacatcccctgaagaaaggaacacagaaatcacagaaacagtctgtcctgtgtgcctttctccaaagagaaaaaggcttcagtatttaaaggggaaacgcagtttggaggggaaagagagaaggtgtggtcacattactgaatccacgtgttgcacgagaaaaggagcaggtaggggaaaagccaattatgtatttgtctggtgctcagtaaatcagcactttacataagataaggtgaacatagagtagctacctgtggagatatctggccttttatctgcagccgtgtgcttagggacaaaaggaagagcagtttcttgcatgacttagatttcagctgaatttttcccttttggcatagtgattttcatagtgaaattttattttcctttcagacttgataatgctgtccattcaatatgagacatcagggagtttgctctacatagtcactcaagctgatggggatgtcactctcttattctgccgcctctatttttggcttttggaaggtggagggggagagaaaaaagatctgaaaactagcatggggtattttagttcatcaagtctagaaatgacagatgtcacatccactcacagcccactggacataactagttgcacaaacctgtctaacagagttgtagctttccaagagtccaggaagaaggggtaaacaaaacattgatgacctgtaataatctctacttcaactgcagagcaaggcagacacatacttaaaccttggatggatatctataatgtattatcaagttaaaaatcaaatacatggtacataaccttattttgttgaaaagaaacagcttcacatgtttctggataatacattcagatattaagttctgcttttttttatttctccttgttttagctcatttccttcttcttattcaagcagatcgaggctgtgtgcttctcatcttagggaagaatatagcaagatggcagcagaaaaaaatcagactccaaaatctaagtcttcagtccagggatatatcctgagcttcaagtttcacatagccaccttcctaccacaaaattctcatttgaaggctctactcattatcttttctctgtaaaattgctcttatgttccttatctcaacgtatcacatgtccatccatccagtattcgaggtcataacttaagaaaacatctttatccaaacaatcaccgtgtcccaaacacccctgaatccattcatctctgcacctccattgccaccttcatctttcgtctcagttaatgtgacggcctctgatcctatcttttgccttcagtctttcttctccaatttattctgaagtgtaaaccagattgtgtggtttttttttaaacttaaatcctttagcttatttcccacaattctcaaggataaaatcacttccaaaatcactcaagtcatcacgccagcctgcctttcaagcctcatcctcacagtctatacctgcccttctttcccaaatggcatgctttctctcactaagcatttacacatcttgtctgaaattcctatctgcatatgctaaatgcgtgccaatttttctaatgggttgttttgacgtgaactgattaccagagtgagtgcaagttcaagagcttgacaggggcacacctctgtgcaactcaggctcaaggtgagtggctttgacaggacagttctcattctaagacagagcattctaaattatcctttcaaagatagttcctctccctatcttccaccatccattttattttcctttaatttctatgtcatgccattgtttccttcataactcttaatacaatttgtacttttattttgaacttattttcttctccttcgctgcaactaagttctattaaagatcttgcttatcacattcacagcaacatcataagagcctgatacacagaagactctgaaaaaatatttgtagatgaataagtcaaagaatgagtggtagatagcgataacatcaactatcacatctaattatggtcataaaattttcacttaagaactgttgagtgacaccatatttctagttttgttatagtcattggtataataaaaaagtaatggaaagcacaagattatcttactctcaaatattactaacttgttttctagcttggaatataggcatgcctgcaataatatgaacaccgcacagcacagttcatgcacctgttaatgacatcatgttttcttctcttacttttactgtgctaagttctttgagggattaaaaaatatataaaacatcatgcctcttctcaaggaactcataatttgtttggggagacaaaatagataaatatatataaggaattatcaattgcaatataaagaatatgtaattagccatcaaataatgctataaacaacaaatattagacccccagttttttctttgagactgtttcctcatgtgtaagagttaccacaaagatcaaaatacaaattatatgaatgttttatgtgagctataaatcccataaatcccattacccacgcaacacagtagtgctattaaaatttttcctaaagcatagcaaaataagttgactactcagaaaacacagacacattggtagaacacatcatcgaaggatttaagcttttttttttcttttacattattctgacttaattttaactgtaatattcttaaatgtgaaggaaaccctttatcaggattgtggaattaaagagcatttcttcattaagcatgcctttacttgtagttcacgcatttcatttacataaacaagtgttaagtactactcagcactatatgttcttcataatagaaaatacaaagattcctttcatgaaagatccgagttaaaagatgcaaattataaacaatgtcacacatgaaacaaaatgaagtctggctttcctgatgccaaagagacgttgagagttccacaaaacaaacagaaatgtaaaatcgcagccgggcatggtggctcacacctgtaatctcagcactttgggaggccaaggcgggcggatcacgaggtcaggagatggagaccgtcctggctaaatggtgaaaccccatctctactaaaaatacaaaaaaattagccaggtgtggtggcaggcgcctgtagtcccagctactcaggaagctgaggcaggagaatggtgtgaacctgggaggtggagcttgcagtgagcggagatcgctccactgcactccagtctgggcaacagagcaagactccatctcaaaaaaaaaaaaaaaaagtaaaataactttgtgaatgtctgtttatcaggttgtgtgcaacagattatctgtggtctaacttccaaactgtaggggagacttccactttctactttactcatttctgtgttccttgaaatatttgtttgcgtggtttctctctggactagatacagtctatagttcatgtgtatagagactctctcttcctgtctgttaactctagggaagtatcagcaccacatccattgttacagagaagtcttatgagttttagcatgagaaaagtatcaaatgtaattgaagaaatgaggactagattagtgaatgctaggagtcagaatgggggtaagggagttggatgaagctataaattgcaacatgaggaatctttgtggtgatggaactgttctatgccttgattatatcaatgtcaacttcctggttgtaatgttatgctatggttttgtgagatactggccactgggagaaaccaggtaaaagatatacggaatcagtccatattatttcttagaactgcatgtgaatctgcaattatctcaaaagaaaagatttaactggaaagcgacagtaacagtataagtaattaaacaaaacaggaacccatgagttcataggggtataaatgagtgaataaatgagagaaaaagtttctcacagaagattgctaatacattttgaaaagagaattagaaattcatcattaggcaactatcaatcagaataatgattaattcacccaagaaatatcaatggatgctaaaactagacattaaaatttgatgtggaacaggatactcacatagtcccaattacctctctacagggtgcttattacaaaggataaaaaaatgattgagggtatgtgtgcaacaggtatctgttttcttcatagtggcaaacctagtagacatcaccttaactacataatcaaagtacataataggacaaatcaacatgatgtactgcttgatgggatgtagtcggaagaaacacagcagaatttctctcttgttttgtcaaagataaatgatatatataccattgaaaatgtcagacaagccaagttgagagacattctaaaaaatgacctgtgatctttaagtgacaaagtcatgaaggtcaagaaaaaactaagagactgttgaagatttaagaagactcaaagagagataatacagccagccagcctggattaggttattttgctataatggactttattggacaaattgatgaaggttgaacgggatctgtgaattaaatgatagttcctgcatcaatgttaatttgactttaataattgcattgaggttatgaaagagaatgtccttatctgtggaattacataaaaaagtattcagggctgatggggcatcatgttggcaatttattcacaaaatctgtaaatttggttagcttttccataagttccaaaatgcaagttatctttaacataaaaaattgggttgagaattctctctgcaggctagagctagattaaggaatcttgtgcccaatttctccttcttcctcttctaatgaacatccataatcaaatgaggatagcatgattgaaaatggaaacttttttttttttttttgaaaatggaatcttctaaatcaaggattggaaaactttttcaataaagggccagagagtgaatatcttagactctgagggccattatagactctgttgcaactactccactctgcgctagtatttaatgatacaaaagcagtcatagggaattaataaactaataaggatggctgtattccaataaaactttatttatggacattgacatttgcatttcttataattttcatgtgtcacaaaatattttcccaaccatttaaaaatgtaaaacctgttctcagctcataggtcatacaaaaataagtggattcgactgatgtgccttagtttgcaaattcagcatattttcaaatggtcattacatgtcacatcattaaagttcatattcagagttataaagctcatattcatagactatttgctaataatttatgatttaagtttataatttaatattttgttaatagtctatgaatatgagctttataacattaagggaagaattagagaatttgctgtgtagactacacaagatgcaggtgaatgctagaacatgaacagcccttgcttaggaagattaacaatacatcctggctcctagttacgtacatctcttctatcatgcagtgtccaacctcattcacaaaccaccattctaaacccacaaataatccctaattcttatggggtttggaatcaggtgaagctcagttgatatgaaacaattagcactttgtttcaaaagctcttttcattaaaatgttctgtttactttgttatagtgaagggatgtgataaaagaggtgtttctacagtttttacctagcatgagtgcacactctgggttttaagggaaggagctagaagcagtatataatatttcagaagctgagagaattctggaataaactggaagatgaacagtggaacctaaaacaatagctaactgggaaggagaaaaggaaggctgataagattcattaattatacgttagttgcggttttaggtcttgaaaattatggtttcactaatttaaaaagaggaatatatgtgaggggtggctaatttgtaaagaccagttcaaagatatttgatttctaacaatcttatatccacctaaaattaaaggttcagaattctcttccaaatcctcattgagacattcacttgaataaatattttatctttttccaacaccttagtgatatactgaaaatgttataatggttatatcattggaagatatatatataacttttatcttgttggttattaaacctataagtagaaataccaccgtgactttataaactagtgagagtgtttcataaagttgtcaaaattttttgtaaaatcagtctttcaaaaagaaacccactctaacggttatcctgttgagctaaagtaccatcttaataaattgtctcctctcaaggaacataaactaccacctcccagacattggcaagatttattactcagattgaaaaaaagcagttgtgggctgggggagcacacggttgctccgcctcagggttaagcagcccttgttacagagaaataaaggaggtcatagtgggaaaaacacccacgcaatgcaagctggaagactctcgaacaagagaaatagcactgaccagaaccacacattaccaaacgctgattgaaaatgatttattaaagtccaattagtatgcttttcatttcaaataatccatatagcctccagaaaaatatgcacatgtgtaaaagtccacgttcatttctttcacttccaatataaagtattctgtattttgtataaagtacgtgcaaacacctttctgctaatcgggtccccacattcttttcactacaggtactttacaagtctgccctctgctcaaacactaaccgtgcactgacatcctccttcctagacagccattcatctcccggacttctttctctcagacatcctcctgacctcccctgacctgcttcaccactgtgttacctcactggttacttgttacagcaaactgatgcaactactagtctacctggacaacatattaaacaggtatcacctaatagggtggcagcctatcggggtgattcctggcgaatacacagtaaccaaccacatactgacacactcaacccatttgctacagatggacccacactaattgatatgacaatcctttattcactcggcacatttggtttctttgcattttcttccattttacattgcaggtgtggctaccaagagctggataacgagtccctcaaacaaagtttggaattgcgagatatattggggtaccttgattcttgagacagttgaattcttctagttgatcttgttgtattaaaaagtcactctcaactgaagtgaccactgcatttcttttgtaaaaaggtcatttgactggcttttcctcacaactgccacccatgcagtacaaaagcaggaaatcccttttcatgaaaggtgtaagtacaagatgacatttcacatttttttaaaaaaagaatccttcatgggaatatatcctaataatcaattatatggagacagttttatgtacaccaaatttctgcaactttataataatgaaaattagaaacaacctaaatagttaacaacatgggaatggttaaataaactgagttgcatccattaaatggaatataatatagccattaaaattatgtttttgtaaaatttttaatgccataagaaaatgtggcaattttgcaatgaaaaagatctacttataaaactgtttacagtatgactccaattatgtaaaaaaagtatacaatacacatataggcatacatgggggttgctttttaaaggtggttacttctgggttgtgatattatcagtaatcatttttgcttttttatacatttctgcatttttcaagttttctatgatgagtatattattttacaaagactacgaaaattttcctctgatatactggtaattagaatgtacttgggtattttaaatatatgggaacaatattatagtgcttcatcttctatgacttttttggaatacatatcactttggtaataaacttacattccctgttttatacttgttacaacattttaattaaacagttaatattgtgattagagcattgtttgcttcatgacctaaacaaatactggctttgaagtctaggttctatttcctagaagatttaacattagtatccttttaatctttttaagtaaggcatactgcatacatacattacatgcatgctttctaaacaaaagataattccaacttacagttttcctatgtaagggaaaaaatggaattatggtagtttaaaagcagtccatagtctcatccatcacaaacatgctgataggcataaacgtgtttattaagtgaaacgtatcctttaaaaataaaaaagggaagcctgtatataaatgaagttgtggattcaactagccagaatttattctgacttgcaccaaaccacacaaaatcttttaaaagtctagttagtgtagtctaaatggacactccagagtctgttcttgaattccattgcaagagctccaacttcctactttcagaagggatggggatcaagatgagggttgtcacataagctaattttcaatatatatcaagtcttgtggggtccaggaacaaatactgtcattggttagtgtttaagtacatgagttgacttttctcctctctcacaccccaccttgccctggcaattgggtagggggaggctgtttatcctccaagagaggacggctggttcctcatctcagtttccgttctaaaccacagagtggtcattgctgtgaactccagccaagatggtgtggttgagggaggaagccgagcggtctgagccttctgtggggccggtggggttctcactgcgctggcagcagaggatctgcctaaaggtggcgctcatttctttgtcgcggtaggagtaaatgatggggttcatggcagagttgaattcagcaaggagaaggaagaatttctcataggccagcacgtcgcactgtggacagcacacgtctagaagtaacaaaaccaatccaggagtccagcagatgataaaggcccctacaaggacaaggatagggatcagaaggatttttaaaaagagaatgaaaaaatattataaaacatgcgaccataaagtgaaatgatttcagttcaatataaaaatactgaagttggaagccaccattgtcgcaaatgaaatactcatttcctgagaaaatcagaaaaaatttaacgatagtcaacttaaaattttattttggacgttactaaaatcaagcaattatgagacattgatgattattattttgagcaaaacacaaagagtttgataagcaattgagatatgaaaaactgcattcaggaaacacttcacctcacataacaacatggtttttaatagcagtgttattttcaggcaaaagataagcacgaatgataagtgtcctttaatgtttaattaaggcatagtttctggattcaggttgtctgggcccaaatctttgtttgacatgtaataaactgggtgaacttaggcaaactactttctttccttaattttcccatctgaaaatgcagatgattatatttacacctcataaggtttgttgtatggattaaacaagtgttaaggaaataatcactcaatctgtatctacaataacaataataattattacctgctgagtagcatgggcctgtttggaaattgtgattttcaatgacaagatctatgttttatttttattcaacaactacccacatagtgctgtcctatatgctttaccagtaataatttattgaattttcacagtagccatatgacatagaaactaatatccccattgtacagatgaaggaactgagacccagaaagtttatataactggctcaaggccacagtactggaaagcagaaaaatcccagagtttctgttcttagaggctgcctccagagttcaagctctagaaaatattacatttctatatcttgaaaatgataacattaaatattttaaaccaaatttactatttcagatgttctactaatttagatcaactttgttctctttcttcccccaattattctgaatcattacaattttactataactgtaagaggaatgaaaatatagatgagatgcttaattctatttcatttagtttctgaaatcactcatcatttggatcccaggaaaatggaggttgtaaaatagcattaaatcctaccactgtgttactccagactctgctggggatcttctactgaaagaacatgagccaacagcggtgggcaccactgtgtcccattacacctcacctaatgggccccatatgtgtaatcaggcaggctacatatgtgtaatcaggcagagcggaagtaggagcaaccccagaagggcatttgcatcttcagatttaaatggcgctggctttggtggatgcaggcttggactggggtcatggatttggtccagcctcaaggaattagtttcacaaaatgtaaacaaatgagatttagtctccaaacagcccacttttgaatctgagctttcttttgtgaaacttttcagcagggaaatgaaaataaaggagaaaagtacccccataaagctctttgttctacaacacaaatgtgtattggttttaaactgctgttcactttgaagattggccaaggtacttcattttctaataaatacaacaccttagactttccttggagagaaaaaaatatttcaaatatcaggagataatagccaaggagcaatttgaacttcaataaaaatgttaataaagcattcattccaagtccttgaatttccttgcttgaaaatcactcagaaagctaaacataaaggaaaatcaaaggaatgcctcttgggtttcagaaataatgcattattcattgagaagccaggaagggaattattctcaggatggaaaatgcttggatggaaaatgcatggtcccattatgccatttacttggaaactaaaaacacacagtcccttcatgaatggaacagcattctttcaagtttcctttccccttccttttatcaaagctctaattgagttcaaattcagaacttgattagacacaaggaacatgcatctcaatagctagattttaaataaaatgatctttttctccttctgggcaacagaagggaatatctttattctctcatacttaagctgcttgactttgctcaaaagtgagagaattcaaacactgtcatttgttgtttataatttcttcccatgttaaaatttaaaaggtgtaagatctttccagaaagagcccataagccttacttttagaccaagaaatgcaaggaaccctgctagactgaaggcaggaagtgggaaacaccacagcctgacacaggagcttctatgtatggatgcttcattgaggaacctggattcctctcctttatcttcttcactgaaaggaactggtttttgtactaggattaagcccaaccacacagtcccaacactctgtgtttggatcttcaagactcaatccaataatttcagtgactcacagtacaggcctccgaaatcaacatctaaaaccaatcatatggaaattctgcgcccccctccccctcctttctatttcacagaggcctcaaggatcaaactgaccaaaagatgaggatgcactacagaagacgaaaatgggggctggaaaattgtaagggatgaggttcctaacccacaatgaatggatattctgaaataaattttgctcaaattaaggatttccccttgagcttctgaaaacaataataaaccacacctaaacccctttaatagtaaggagctaaccataattcaatcaggttacaggacttgagatgtgcattgtggaccccatcaacatgtaatctacagagagttcagcgtacacctgaaaggttgataagagttaaaacacctccatctcagcacctctgaagtggagaaataatagctccctgcctcctccacatggcacagtgaggatcaaactgagatacaacttgtaaaagccctctataaactgtgcatctacctgaccaccatgacttacgtgagtggcacgctggcgttgcagagccctaggatagattctccaagggcagaatgtgaaaatgtgttttggacaagaaagagctggcatgtcaaaaggctctgagacaatactatcctgattataaagagattcctaggacttgcagttgggtatgaagaagataacaagagggaatagagagacaacatagggaagcaaatcattttggaggttctcatgggtcaatgccatcacctaccaagatggggaatgaaatatagtactcagtagtcatagtgctttgagtagtttgtatatttccagcacatttctgatagaagaatcccacaaacccaggcacaacaccgatgaatggtatgcaacagtatgaaagtaagaggaagggcccggtgcgggagctcacgcctgtaatcctagcactttgggaggccgaggtgggtggatcacctgaggtcaggagtttgagaccagcctggccaacaacggtgaaaccgcatctctactaaaaatacaaaaattagccaggcgtggtggcgcacacctgtggtcccagctacttgggaggctgaggcaggagaatcacttgaacccaggaggcagaggttgcagtgagccaagctcacaccaccacactccagcctgagtgacagagcaagactccatctcaaaaaaaaaaaaaaaaaaaaaaaaggatgaagaagtgtggttatttattgtaacatcagaaacagaagtagcagaagataagatgtccaaggtcacaaaggtcttgtatatctggctatttgaaatttgtccagtccagcatacattctcaaccctagccacacattacaatagtctgcagagcttctttaaaaaataaagaccttcacccacacctcccactatgggattgtaatctcattggccttactggtcagattttcatttaagacacaacattggtgacagagtggaagaagaaaataaagtaaaggcaaaactatttccaaattccagaagagagataatgaaagccagaatcaggacagcagcactgggaagagatatagaaggactggagaagtatttaggagacggactccatgagatggatgagacagagaagtctagaatgacttctaaattttcactttggttgaaggaggaaacacaggagaaaatgtttactggtgttttgtaagggaggtaaggagaagaagacagctgatgagctgggttcagtatgtgtttagtttgaggtacctgcaagacatctaatggaaatgccttaattacatctaaataggctcatggcaatttgtgtcatgggaaactgtctcacagcacgctgaacaaaagtggttatattgtcccctgatttgccaatattacaagtaacatggggtggaggatattcaaaacagatccgtgggttgttcttccttgaacaagctttattcctccctgatgcatctgtcaaagcaatctgtgagaaccccaatgcccacaaagatggagggagaggtgctggaatgcagacgcaaaaggcagggaggaatgaggctgttttggaacaacaggtcacagctgcagatcgagatcatattaccacaccttccctcaaatctatccaacctcatcagctgaataatgcttaccatctggtctcacaattacagtctttttttctagaatgactttttcctaactagttgaactttgcttacatatggaatgcaagaaccaaagttaaagaggaaaacagtccttgccagagaagacctctagagacagtgtccaagatttttgatgaaaaacacagaaagcgtttctagtctggctggcaaagttgtgtttttacaaaagaaccagacatcccatagatccaaaacaagtcaaggtaaatcaattctacaacagcactgtgcccaaggtggcctcactcttcttgtttttcaaatgaggatcccagaaacagtcccatctcagagacctgcggtgggaatcaagggagaaaataaatgagtgcctaagttgctttttctgttttccctaaattgtttattccctcaggtcaggcagcgtggtatcccagaatctaatcaaattttagttcatctctgtagttacgttgtgatttctgctattaaggtacacacatactacatagttagctaggaaatccttcaatgctatgtatcttaacagagcctatgtcagaaaaagtggccacagatgcaaagcttattcttccccagtcttgcagctaagggttcattataatgggggtgtatgtggatggctttttgagattaacgctttttctaaaagaataacccagattaattaaaaaatcttttttcctgactattgaaactatataatttacctgaggtatctccacagtattattgttctatattatttccaccctgataccaattttactccatctagtttggtgttcaacactgccattccttcctggtcacagcacatgttgcatacatttaaagtttcatgatttcatttattgtatgatgtgctctagtattttcattactcactcttgagagcaacatttatcttttagagaaggataataacaccatacagagctctaaagcagagcagaatactcattatgttctctttttaacattcctgggtgacagttttagcttcattagactctcctgatcaccacaatgctactttcctgtgcccaagagaatgccaaagctgccttccctctggtgtactctccttaacattaagtagtgtgtattgcgcacgtacaagttccataccctacaacagactctaactctcatcctgcaactgtaccttggaaagtccacattgaaatgacttgaatgctagtgccattcttacagaccattcaggtgctgaaaagccaggtaaaaccacttctccactgctaccatcctagccaagtgagcaataccttttatctgccaattgcaacaggctcttaaccaattcctcttcctccacactgcttccctaaagtccagcttgtacaaaacaagcataaatcaatttgcactaagtcactctcctgcttaaaaccctccaaagtcttcctacttgaaatccttactgctatccataatgccctacacatgactggccctgctagtttcttggatctcatctctttccactcgctcctcatttacgaggttccagtcacacagaccaagcccatttctgtctcaggatctttgcatttatagatccatctgctgggattactctctctgcagctttttatgtctatttacttattaaatgtcgctttcttaaaaaggctatccttggttatcctagccagagcaacagcccaccaccatcaccacattctcccattttattatcatcacatgctgatatacccaaatgatatatcctttatttatacccaaaattattgtatttattggtttacatgtttattgttttatcttccctcaacaagaatattaacttcatgaaggaaggaatgctacctctttcatgtctgtatctctggaatctagaatattgcctggcgacagcagacactcagtatcttccattggatgaattagcaagtcatagctaagcgcctagtacatatatcccaaacaagaaaaattaataagtagaaatgtcattaaattacgggtggaaaataaacattaacatctaccgtgtgtaaggtctttaaatggatgctataggacattcaaaggggcataaggaagaccctggaagaccaaattctagaatggtggaacaattcctacacacttttgaaggttcagaatttgtatcctataattttaacctgtattacctggccaaattatttttaagtgtgagggttttttaaatgagtgcacagatacataataaaagtgcaagcacatgaatgagaacaagcagcagcaatttccggacaacttctgagatgacaggcaggaggaaggagtaggggacggtgctttggttatatctacaattcttttcagagacctgaagcaaattatgtaaaatgttagcatgtttgattttaatgtttggtcattagatgattgccgtattactttttgtgctttttatatattcaactcactcatattcagatatttataaatttagaaattttaacaacaagaaactagaagtcttgatttttcttaagtaaaaggtaagaagaggaggcagaagagtagaaagtttgctaaaagttttgtcttgtttgggggctactgtagaaaccgaattatatcttgaattttattttattttacttgagactgagtctcactctgtcatccaggctggagtgcagtggcatgatcttggctcactgcaacctctgcctcccagattcaagcgattcccttgcctcagtctcctgaatagcagggattacaggtgcacgccaccatgcctaatttttgtatttttagtagagttgggctttcaccatgttggccaggctggtcttgaattgctgacctcagctgttctgcccaccttcgcctcccaaagtgctaagaatatagccatgagccaccgtgcccggcctatatcttgaattttttaaagtacgtttttaaaatttaaagttagccactattaaaaatagatattggatgtaccactcaaaccactaaagaaacaaacaaaaattttttaaaaaggaaggaagaacaaaacagtttgaaaagaaaactcaatttatcaaaaggaaggaaaagaaaagacagaagcaaaagcaaggaaatgcacacacgtaaatagaatgtcaagaataagcccaaacatgtgactagatatcataaatgtgatgcccttaattctcttactaaaaaacagattcaacaccatgacttttgaacagatttttgttttcccttgaacttctaactgctttttctttttattctctcttttgttacagataagaaacacacagtttattacagcagaagcatgccacagatgtatttccaactttttaattatacaatttatccccaaagacatttcctgcagcccgctgacttactaacccaatcgaacccattgatttctaggcctgcttctcagcttccactgagggctgcttattttacatacctaggtggcacattgtttcttctaacgtacatcttttttttggaatctcttttcttctccctcccccacccccattttctagagtgtatccatgagcattctttctagaaagtttgcataagcttaaaatcattttctctcagaacactgtcttctagtatttagtcttgcaggtgagaagtctgatgtatgattcccattctttttgtgtaaaacacctgcatagtacgagtccttacttactcgccaagctttgtcttgcactgcatgtctgctttctggacatattagtttttccattcctttcagtctatcacaatccccctaaccatgggcctttgtacgtgtttgctctctcttcctgggatgttacctgctctcctcgcaatctaattcctactcacactttacttaccgctacttctgggatgccttccctgattaagtcaaaaatccctttgtaatatgctctcagcactataaaacactccatggtagaagttatcacaggtgtaatttatttttatttataatgtgattattgtttacttctgtcatcagactatttttactccactgtgtctattattacctaacaaaatttttggcacatagtaagtgctctataaacatttgttgaatgaataaaaaaaataagtgaaagaaagaacaaggatctggctagctagctaccaacctaggccattaaccaaatatttttctcatcctctcctacctgaaactgtcacaatgtctttcattaactttgggagatcacagatatcactagaatataatgtcttggctttgctcataattcttgcttggcccttgattggcaattttatctatagtctcacattcgtctttagattaaggaaatatcctattactttgagtaattttctttccattgtttctgttcatctgagacttcttttacaatgaatgttggatatttgggaatctacatttaaaaattgatggatccttgatgtctcttaatttttcatttgtatttttaacactttactttttatttggtatcctgggtgatatcgtggacttattttcaaggtcaaatatttgatttttagctatatccatttcactacttggtagtggcttttggtttgtctgtttattagtaatggataaaggagggcaggcgatcagatttttttattttcaggaacactgttctctgaatgatacttttgcatagtaatatgtactaatttagtcaatacagtgtcttcttgaatttgtgaagctattaattagagtttatttgacgttattttgtgtttcctatactatcactgtttccatgtaagatgttgctctacattcaaatgcagtgggtggggggtcatcatgcttcaaggaatgtctattcgttatgcaggaaacattcctgaatagaggaccctcttaatttgagaagacagtataaagaactgccaccaaagtcagcttttccctgtacctaaaacatttagccatgccctctgagtaggcaaaatgctaaatgagataattacatggggagagatgtgttcctctgaatgttcttatctacaaatagaacaaataaagtcagaataatgttccaaaaatatggaagcagcacaaccacctaattagatccaggatgtatgcacacatacttcattgccaatggtagctactattctcaggaacagaatgtgacccctgaggtctataagcatacaaaaaaggaaaggctttaatttactcgcaatcaaacaatacagtctaaaccttaagatgggtcactgcctcttccttttttcctaattcttgtcttctgatttctacccagctctgtcttagggtgaagtaactaaggttaagactgacttaccaggccgggcgtggtggatcatgcctataatcccaacactttgggaggctgaggcggatggatcacctgaggtgaggagttcgagaccagcctgaccaatatgataaaaccccatctctactaaaaatacaaaattaggctgggcgtggtggctcatgcctgtaattccagcactttgggaggctgaggcgggtggattgcctgaggtcaggagttcaagaccagcctgaccaacatggtattaccctgtctctactaaaaccacaaaaattagtcgggtgtgatggcgggtgcctgtaatctcagccactccggagtctacggcaggagaattgcttgaacctgagaggtagaggttgcagtgagccaagattgcaccattgcactccagccggagcaacaagagcaaaaatccatctcaaaaaaaaaaaaaaatttagctgggcgtggtgacacatgcctgtaatcccagccactcaggaggctgaggcagaagaatcacttgaacccgggagacagaggttgcagtgagcaaagattgcaccattgcactccagcctgggcaacaagagcgaaactccatctcaaaaaaaaaaaaaagactgatttaccagagcattattacccatcaataaccaaaggaaaaaaaaaaaaaaaacaatgctactccaaggcctacaaagagattatctggtaagcccttacaattttcaagtcactgatattattttaaacttgtaaaactatatatatacacatatgtatgcatacacatataacacataacatgcatgcactatgcacactcaggatcctcagtcttcactttgctgtatcataaaaaagacagtaagatttgttttcttttacataatgtgcactatgagacccaatcaaaaacaatggtaccacatatattcttcacatagaaaataactcacagttctcaaaatggtgaaatctattttgcctcgtaaactaagtgataaattgcaaaagttttaaaaagcaaaatttcccccttatttaaaaaataataaattgtaaacttcacagaaaatcaatgttgtcaactccagaccaacatcatctaacttagaaagtgatactaaactaattgcatgactgtggtccaactgttactaaggtgatttgaataatatttatccctttaaaaggataaaggaaattccccttagaatctttccctagcaaaagttcaacattaacaggaagtttataattggttttgcaacatatttaattttttaactacaaattaagattctcccaaaataatataaatctaaacaagtactgaaatctggctgaaaatgctcatagaatgtagctgatgacaaaatcctgtggattttttttctttgcagttcatgaatcacaagatatgtattacccaagacagaaacttcaaggatagagaaacgtaatggaaattttatttacaattcattttcttactatcaaaatggggaaaatattaaaaatttaatctaaaagcgaattcagaaaactttgtgaattatttacataacctaaaaatgtttatatttatataaatataatttttaatagccaaaagacatgaaaagaagaacagtataaactgtaaatgtggtcactgtcattctttttgagattagttacatctcctatagctgccaaatgccctggattgatctttaggaagcacagattcttggcagagcagaaaggaggtacggtctgttctaatatgatagctatgtgtctaagatatctctctttatcaaaaactttttctaaattaaaaaaatccttaaagtaaggttataaaaacaattattcaattgggaagtgggtgcttcggctacagaattccagattcacaatcataaacatacttttttctacataaatttcaattattttaagtacaagtgtagagtaaaaaagctagctgataaaattgacaacaccaagtctaaatattgcaaagcaaattctgactagcccgtaaatcctaagcaaaagtcaatcagttctaaagctgtctaaataaactgcaacaatatcgctgatagaaacttatcctacagatatatttacacacaatacaattatgcatgtgcaaagatttgcagtattctttattttaaaagctgtaaataacttaaataagcataaatagagaagtaaaataaggtacactgcacccataaagtagaatcctattcaattccatcagtttaggtattctggctttactgataccaagtcatcagatgccctacagtaagccttaatggaggataaaattcaatgcctctaacagtgtttagaacaacaaatcataaaaatgatactttaaacatcttatttaaaaatataaatttgtattcatttaccaatgttttgacatagagtcaaggctttttatttgaacacaggtgcattgactggagttctgtgtcatattcgaagcaaaagcaaccccaattaagcatcccatactacttccaatttggctcctccagaatagagtcagaacttaaaattcttgcaaagccatttcagtgaaaaaccctgtggagtgtttttatggattctccaaacttcgacagttgttttcatcagttctttttttcccccaatttacattaattgaatgttaacaaagcattcacctaattttcatagaaacgatgtcttctttttgtacttattttattagacaatgtaattatttcattagttatgtgactagggatgcagcaatgaacccagcagaaaaaaaaaaaaaaaatctgccttcattgagtttaggttctaagataaatgagaaagacaatcaacaaaatacaaaataagtaagatacattttagaggggaataatatttggagactctggaagagcaagtgtggatacaagaagagcagctagaaactcacgcagtaaatcagacaagagataatggtggctttgaatatgggaaggtggagatcatagacacattttgaccatacagctgatatgtatggctaacagactggatactggagagaatgagaaaagtaaaaaatacctgaaaactgaaaaaatgaatttagtggcaaggaggacactgatgacagttcagtggagtcatgagaactcctgacttggagtaacatcgagagagcaggaaagaaactgaatactgcaaggatatacaactctttgaagcagtttcactggaagagaatagaaaagtggctatgggcatgaattagtatgttttacaaaactattgttaacacattggccgggtgcagtggctctcacctgtaatcccagcactttgggaggccgaggcgggcagatcacgaggtcaggagatcgagaccatcctggctaacaaggtgaaaccctgtctctactaaaaatacaaaaattagccaggcatggttgggcgcctgtagtctcagctactcgggaggctgaggcaggagaatggtgtgaagccgggaggcggagcttgcagtgagccgagattgtaccactgcactccagcctgggcaacagagtaagactctgtctcaaaaaataaaaaaataaataaagaaagaaaaaaccacattaagttggtgaaaagaaaagtcaggtaagaataggtgcatatactcagtgtgtatatgtagatacacacatgccctcccacactcacttatgcttatatatgtagataattttaaaaaattctaaatcagaaattagtattgccatggctaaagattgaggtgagaaggtagattcactgtgtatttttcactactagaatttttgtcacaaatcattactttaaaattaattgtaaaattgtaattgagtttacaactgttaataacaacaggataccagctgagctgctggaaattcaaagcagctttaggcttgtttgctgtacaaatagcatattgtggttacaaaataatcactattggttctagtaatacaaatcacataccctaattaagtgattgtgttatatccaaatggaatatctaacagactagaaatccattaacagcacagttttgcattcagaggccaaaatatttttacaaatgaatacaaataatgagaaagaaatgaaccatgcatttaactcaagaagttgagcaaaaatatataacgtccccaaaagcaaaaaagaaattaaaacatgttactgaaatagtaaataaaaaagaataaacttgattaagacaacaaatctggtatttaaagaaacaactaaagagacaaatgtcttataaatatgaccaacaaaataaaaacagattacgaagaagagataaccatagatgatgaagttcacacaactagaagaagttacatgaaattatttgccaataaatttgaaaaaatggctaaaattgatgtttttctaaggaaacaaactatgacaattgatgtaatagtttgataatctgaatatacccaaaacaaaaaacatagagaatataatcgttaaaaaagttccttcacccccctcaaaaggcaccagattcagatggatttgtggatgaaatttatcaaaccactaaggaacatattacttcctatggaatttatattgttccccaagtattaacatttaaaaaaaattccaattcattctaagagactaaaataaactataaaaaaatagacaaaacaaatctcccccccacaaaactacagattagtttttctcagtgggattggaattggctttggggatgaaaagcttctttgttgcattaactgttccatgaattccagggtccttagcaccctgcccattgtggccagcaaaaactactccctcacattcccaaatgtccctggagaatagtcagcaggaagtaccacctttctttgagaataactgtatagaccagtcaactttatgaatataattgaatctgacattatattagcagaatgctatgatccaaccaaaaagggttaacactaggaaatctcttaatgcaattcaccacactattaagaaaaaatattagcaccaatgacttgcctggtaaaattcaacatttacttttttaaaaggaagataaaacaccaccaccaacaaatcaaaatataattacaagtacaacacttagtaatctgggaatggggaaaactacagaaaacttattagaaaccaacagaaatcttatttaacaacgatatactagaagtattccactaatataagggataagaaaaggatatccatttgtactgacattctagtcaatgaattaagctggaaaagaaaaaagtgataaacaattgaaaataagttgtcctcagattgcctgcttgttaatagaaaaactaaaatacctgataactattcaatcaactattagaaaaaaatttgtaactcagaaaagtgggcatatataaattaaagtacaaaactaaatggatttcttataataaatatttgcaagataatcatcatctagcaaaagtatgttattcttcaataaagaacattacataacttttaagaaaaaatacctaaataaatggaactagtaccatattcttgaaggggaagattcaatacttttaaaataggaattctttcaaaattagtttgtatattaaacgcatttgtgggggcaagttaatgaaaggggattatctcattaaaacatgctataaagtcacaggtttaagctagtttggtactagcaggaggataaacgagattagtggcacacattaaaatctaaaaacggatctctgcataacaaaatctaacacatattttaaaacatgaagaaaagatcaaatgctcaataaatagtcttggaataatttgactttggggtgagggagggatataaaagtcagattcccattacatatcagtacaataataaaatgaataatccaattaaaatgtaaaatagtttaatagatgcttctcaaaagaaaatgtataaatggcgcattaagcacatgaaaaggcgatcagcttcactagtcatcagggaaatgcaaattaaatccacaatgagatacgactgcacacccactgaatgtctacaatttagaagagtgaccctagcaaatgttgacttggatatagtggaactgaaactttcatcactgctggtgaaaatgtaacatggtattaattatttggaaaacagtttggcagcttcctcaaaagttaaacattcacatatcatatgactcagccattctactcaatatttatccaagagaaaggaaagaatatgtccacacaaagatgtgtaggaaatgcccagagcaaaatatttgtaatagtcagtaactagaaacaacccaaaagtccatccacaaatcaacaggtgaatatacagtagtatttccaatcaatggaatactagtctgtaatagaaacaaactatcaatatatgcaacaacatgttatatgtcaattatagttcaataaagtaggaaagagagaatgacagagagagagaatgaggaagaggttgaccaacactagaaaggccagcaccaactatctttagtttcttcttctagtttcctgtagaaagtaggtcatagctcaggccggcacggtggctcatgcctataatccaagcactttgggaggccgaggcaggtggatcacgaggtcaggagtttgagaccagcctgaccaacatggtgaaaccccatctctactaaaaatacaaaaattagccaggcgaggtggcgtgtgcctgtaatcccagctgctcaggaggctgaggcaggagaatcgcttgattttgggaggcagaggttacactcagctgagatcatgccactgcactccagcctggttgacagagtgagaaagaaagaaagaaagagagagagagggggaagggaggggaggggaagggaaaggaagggaaaggggaagggaaagggaaagggaaggaagagggagggaggaaggggaggaagggaaggaaggaaggaaggaaggaaggaaggaaggaaggaaggaaggaaggaaggaaggaaggcaggcaggcaggcaggcaggcaggcaggcaggcaggcatgcaggcaggcaggctcaaaaacactcaataagcttagtggtgcaggctgcacccttactggggaaacccatgattgtccagcaatatctgtggctgggtggttgagtctgttgatccagggatgaaatgttagcaagcgctttggcttcagaactaaagctcatcagtattaaatgtgttattctgatcttaaaaagaataggtagcacagtgggaaagatttaaaatgctcttactagtgacataatggtaataaataaatggacacactcatatactgttgatagaagagtcatttgaccatctttttgaagggcaatttggcaatatctatctaaatgtacaatgtcctcttttacctaacaattccattttagaaatgtgtcatccagatatacttgaagaagcatataaaaatacaaccacataatgttcaatgaaatatttataacggtagaaaattagaaactatctcaatatccactgatagtatacataagtggagtagtaagcagccattaagcagattggcactgctctatcatatttacccacatgggaagatacgcacattacattaagtctataaagttacctcatgtacaacaggtcacttataaaattgctataggtacttatatgtatatataccctatgtgcattacaaaaaatgtctagaaggatacacaccaaatcattggcagtagttaccttgaggaaccagaggcagttgcatggactttgaattttaatgtaaacattgtttttgtaactttttttggtaagaaacatgtttttctaagcctgtccaggacagggtggaaactgatggaaaaaaagtcctggaacccactgggacacaaacgtggtctcaattcctgctctcatccagggcaagtgtttgtaaccaaaagtggtatgcgactgtctgtttcatgcacataatcttcccacctgcttacacgtagcctcagtgtgctggcctgcatgatgttcatctactatgctccctggtctaagacggaggaaaaaagaggaaggacagacagtagactttgataatgatattgatgtagataaccaaccctaaattattacttttctttattctttggaaatgcttcattagaataaattagaaatgcttcaatggaaagaacttcattaaaaatgtttttaaaataataataaaacctttattaaacattatttaccagtttaaaacaaaacatgtttaataattaaggaaatgaatgacaatattcacatgggaacttaagaagctagttagcggggaggaagaaaaatagagatatcttggaaataaaatttattttaatctccgaggctgggtaacttggaggactttaaaggtatgtattcatcttttataggaggaaagagacagacagacctgaggtcagatactgtttcttttccttactgcatatgggacattggacaagttattcacttttgcccagcctcaatatccttatctgtcaaatgaggatatgatctactttcagcactattgtgaggactgaatgagacactgcaaatggaatacgaagcacagggccacctaatgggttcccttcatttctttcctttccttcttcagtgaatacgcaaaggataagcctccaagaaatgtggatattttgggtgaactgttattggttctcctaacctagagatagcaaagtgggaagctgtattccctactatgccattaccatagtcacagagtgacaccaggctgtcctttaatctgaaacaattctgaagtaacccatcagcatttcttgatgacttcttgaacttcagagtcagtcctctttttgcttaaaattaaaaataagggacaggtgcagtggctcacacctataatcccagccttttgggaggctgaggcaggaggatcgcttgagcccaggagttcaacaccagcctgggcaacgagctgaaaccctacctccagaaaaagtaaaaaaaaaaaatcagccagatgcagtggtgcacacatgtcccaacgacatgggaggccgaggtgggggaattgcttgagcccaggaggtaaaggctgcagtgagttatgattgcaccaccgcactccagcctggatgacaaagcaagacctagtcttaaaaaataaaaaaagaatataaaatgaatatttgcttttaatttcttaattttagacccaatctcatttgaaaaagaatttgaggtaagagtcaagtttaaaagtttaaatggtcctttattttactatccttcaagtagaggggaacaatttctaagaggaatggactatctcagcctgctaaagtaccacattctggaaaagaatgaaatccttctggctttagagagcctgggaagacagggtgtactggacgccccactctgagcatgctcagagttgcatagccagaacagctgctacagccaggcatagccagcaaaggttctgggtggctggctccaacctctcctctctggggcagacactggggcctggccactaggctgggtgggctgcacaaccagttattgcagcacggggccccctagtcagggcctaaggcagaggccagatcttcttagccgggaaactaggggagacccacttgttttttaatgacagggcctgacctagttgagatgtttgaggaaaatagataagccagggagggaactctttagggagtgaacacacaggcctcatatttctatttttcacaggtcacagttcaggagggtctgttggagacttatcagacaacagcactgactggggggtgttcggagctggatgcactctggccacctcggtaagattggaccccaccctccagaaacagctgggcagctgggcaaaggccagcgctgagagaatttcattgcagaacagttctggctaaaaaacaataaaaataattttcctaagaaataaagtagcaacaaaagagaaccagatgcagcccagaggagcttcatgttggccccacgtgaagaatggaaagacagcctttgggacacctgggcatttctcttgcttctcatgccatttacccatccatttcgtattcatttcttagtcaaaaatcttaatcagatcaggcttacagagtgaaaaacttagttagggaagatgtaagctgggtcaattcctttgtcttcctttagctgtaaaccagtaaagtgctcgcttccagtttagatcagagggagaaatgtacttgctccatttaatccaggtatatgatgctaatgaagaacctcaagtcctgctcataattattcttgttaccacgacagatttttgactatgctgcgtactttctagggccctcattatattttcaaaaacattgctgacaattttctttttgacagttatttttcagactcctgctatttattcaggtcatttgtggccttttgatttttaactatgtaaagttttgaggtgcaattacatcttttaaatgcatttatatgttatctctttatgatgcctaattaaatttatcaggggcaacccacacttgaaacatttaaaaggcaactcagaatgttttttatttgcttagtctgattgttactgaattacaccttattttgtgttttgcacttaagtatttgatttttaagacattccccattgtactactccatggtatgatctagaaagtaaccctacacttaagtaggcaagaaaaacaaaggaaaggatccacaagaatagtacactaaggattacccatagtgaggttactagattgaagactaggatttaagcaccgtatgaacttgtaataaacacataatacactgaagcatgacttaaaatttgggagggggtgagttaagtgacttgtatttgaatatgcaactatttagtgaaatcttttttttttttttttttgagatggagtcttgctctgttgcccaggctggagtgcagtggcgtgatctcagctcactgcaagctccgcctcccaggttcatgccattctcctgcctcagcctcccgagtagctgggactacaggcgcctgccaccacgcctggctaattttttgtatttttagtagagatggggtttcaccgtgttagccaggatggtctcgatctcctgacctcatgatctgcccacctcggcctcccaaagtgctgagattacaggcgtgatttagtgaactctttaatcagacagagaattttattttcctgaatcctgccttcctacctgacatagtttggctctatgttcccatctaaatctcatcttgcagctcccataattcccatgtgttgcggaagggaccccatgggagatgactgaatcatgggggagggtcttgcccgtgctgttctcatgatagcaaatgggtctcatgagatctgatttaaaaacaggagtttctctgcacaagctctctctttgcctgccgccatccatgtaagatgtgacttgctcctccttgccttcctccacgattgtgtggcctcccagccatgttgaaccataagtccaataaacctctttcttttgtaaattgctcagtctcgggtatgtctttatcagcagtgtgaaaacaaactaatacagtacctttcaacccccttagcatgctggaaaagttcttatgcatcagaactacaaacacatcttatagggagaaacttttgcatccattcatctgtttatctgaatgtggaacagcatttggcttcctcttccataagttagaggcatctgtgttcttcaaatcatagcatccttactaagctccatcactctgtctttgaagataaaacaacataaggtaaaaggaaaaagacaactggagaactaattctagaaagatagggagaaacattgaaaagtagaaaaaaataactagatatagactaaaataaggcctttgatttttttttttaatgagcagatatctatactactgttgtcaaggatcattgtctctgcatcactttgtattgttgaattttcattatctggggattatttcacaagggatacataaaatcctcaaacacagaatttctggaggaaggaagaaaatatttaatagcaaaaacagtgagctcaagaaaccctagtaattagaatcatagtcttgacaagtcagattttcactggtcttcagatacgtatttcaagagctgagaaaactagtgactcatttctgtgacattggtgcctctgggaatccagtgaaagccatggctctatcctgaagggtaaaaaggaccttaaaacaacacaatgcttacaattccaagcaatacaaaccaatatttctggaccaagttattttttccagtgctagttttgcttttagaaatttaaaaaatatgtgtctgttggacttttcccagtagctttggaattacaaaactattttatcagagaattaatataacttggcacttttattcatctacatatgaagtaaaaacttttttatgtagattaccgtgtgcaaagaaacatgaatttaaatctaacttttgtactagtattgtagtgacagcttccatccacctacccatccttttctccagacagaaatagtctacagagagtcagtatgaaactataagaacgctatatttagagtgggagaaccggatttaaaatgtttcaaaagttgcaaggccctcaagggtcatcgggtttacagcacacgttcacgagatgaagacagctatgtttaaaagcaagcctccaatattgtcctttccacaaaacatgcaacggtttgatcttttgactagcaccaacttctctaggcctcaaattcctcatctacaaaatgaaggagatcacttacagcctgagaaatctctggctaactaaactagaatttttaatttgctccttttctgtagcagtgaattcttatttttgctgtaagatgcagtattcataaaatcaggcctttcacgtaatgtgtgtcaccttaactccaaaacatcctatgagtgttttcactgcattcgtgcaaagaaaaaaaatgagataattccttgtagttgtaaccatcatataaagtaacagattttgataaataccaaaaacctgataatccccttaggttccttggacaaacatcggctaattcttttttaaaaatacaacacaaattattccattacacaaatgattgctctggagaattaatgttaagaatggaatgttaagaatggaaatactggctacattttgttacacatcaagaatcagaatataggatatttaggatgagttctcttcttcacactgtgaaatcattaggaagcttcaatttactatgaaatttctaggtatttgaaatggctatcttttttcatagttgacactctaggaaatgtttgaattcaattacaaagtaaaaatgatggcagccatccattcagttaaaatgaaaattatctacatcaagaattttcagaagttcattcgatccataaataatatcaagcagctattttgtgcaatgcaatgtagtcagtgtctttgggagaatatagagatgaaataatacacagacctggcttgaggagactagaaactgaagctgggaagaaaggcatttacgtagctaaatgggaaccgtaagtgcagggagtagcaagggaggagaaaggaaatgatagggagaggaagaaagcaagagaaagtcacctagaccagtgctttatcaacttcaatgtgtacacgaatcacccagagatctattaaaatacagattctgattcagtaggtctggagtgggacctgagaatcagcatttctaacagctgtcaggtaatgctaatgttactcatccatgtacagcactttgggtagcaagagtatgctttgagtacataaattaacctagctcagaatttctctattttggctagatgattctttcttgtgggactggtcattccattgtaagatatttagcagcacccctggcttttgcccactcagtgccagtaatacaccacccccatgcccccatggtgaaaatcaaaaatgtctccaaacattgccaaatgttttcctaggggcaaagtcagtggtgtagataatgcttttacataaaaagttatatgagacaaatagcaaccctcttaaaaataactcacttatttgtattcgttttctatttctgctgtaacaaattatcacaaaactttgtgactcagaataatccaaatttattatcttataattctagaggtcagaaatctgatgtgagtccttgctaggcaaaaatcaaagtgttagcagggctgtaattctttcttcaggatccagggaagaatcagtttccttgacttttccagcttccagaagcttccactgctcatggacccttcctctttcttcaaagccaatgatccagcataaaacctccctatctcaaggcctttaacttagtcacatctgaaaagtatctttttgttccagggataaggatgtgagcatctttagtggtccgtatttctcactcccaccatgttaaaataaaaattacatttgtaaatgatttcatacctagaataatttaagataaagtttctcccccaaaatcctagagaacagggattttcttctgtgccgcaagtactttcctacctgagaacatttcatagcatttctagtcacacataaattcatctaaggaagaaccaagtttttctacttttaatgttacagtttctggcaccattcccaagctttcttgaccctgttgctatcactagtataaaattacattttaaatgcccaacaaatgaggaaatatgattcatttctgaatctttgggtgtttcctgaaatttaagaattctatttgtattttacagagttatatttactaccttaaaaattttcttttagatttatctcaaaagtgaaggtagtatttggctacttgaaccctcatccaaaaccttcatcagcaccttccctgtgttttttagatttttgctcatatgtgccaagggctagggcatcttaagttacagaatacttagtgacaaatttaattgaatctaattatcgtgctgaaatgtttaaaacaaatcttttcttcaatctgttcctataaactgctcttcagagtgaaagcatgcatctgctcaaagtgattctgagatgggggcggatgagtaaataaagccagatggcatttacacttacagtttctttccctttttgagtttgacatataagatttgactaactgtctttaaaagctcatttttcccagcctgtgaagttaagcttggtgaagttgacaagaggcgattaggaagaaggcagaaggagaagtcgtggcctaaagatagagtatttgttgactcacgttcccactacgacaagagtagcaaaactgaaggtgaggctttaactcttcctccacgttcctaaagatgtaagaacttcagctcattgaagcccatagaggcagcatgtattagtctgttctcatgctgctaataaagacatacctgagactgggtaatttataaaggaaacaggtttaatggactcacagttccatatagttagggaggcctcacaaccatggtggaagagcaaggtatgtcttacatgcagcaggcaagagagagtgtgtgcaggggaattgccctttataaaaccaacagatctcgtgagacttattcactatcatgagaacagcatgggaaagacccacctccatgattcaattacctcccaccaggtacctctcatgacatgtgggaattgtggcagctacaattcaagatgagatttgggtggggacacagccaaaccatatcacagcatgattacgaagtagggggaagagagagggcaggtagactgcatttcagttttgtttacagggaactatgaaaggtagaaaaatagagaactttctactgaaacaaagccactaactaaattcattttttctataatgagtagtcttaagggtcttctccgaccccaactctacccaaaaatagtccctgcacaagaattctggactggacaagatggtacagatactttttccctgtttctcccagctaagtataaatataaaccctagaaaaaaaacacaaaaggaagccagagaactccaaaaggtgaaatggttagagaccctacaaccagaggaatgtcacagtgacagtgtcttacaacccacaacctcacagaaggtcacccaagcccagtgtttctagagcctcaatctcgtagccagcccaaataggctcattcccactcagaccaaaggggagtcccaatgatactaccaggctggccagcggtactagccagggaaaatggagcaggagccatgctgatattgtttggctgtgtccccacccaaatctcatcttgaattgtagttcccataatcccgcgttgtgagggacctggtgggaggttattgaatcatgggggtggataccctcatgctgttcttgtgatagtaagttatcacgacatctgatgggtttataaggggcttttcccactttgctcagcacttctctctcctgctgccttgtgaagaaggacgtgtttgcttccccttccactatgattgttaagtttcctgaggccttccaagccatgtggaactgggagtcaattaaacctctttcctttataaattacccagtctcaggtatgtctttattagcagcatgagactaatacacctgctgaccataagaagacaggaaagcactctccttactcaccaagcctaagactcccttcctccaatgagaaacagcaggtggcttgcagcactagcaaaggggatcctgccacaaaaaaaggctccacctgggaagtgttttccttggagagaggggcagtcctcagcactagtgcctgtctccaggatatctgtttgtattccctctacctccatcagaggcatcatgaggctctactgaagagctccaccccttcaggtagcaccagcagacgccaggaggaaccctagcagccccagataaaccaagaagaccaaaatagcaccacaaagtctctgaaaatgcaattgtcattggatgcacggcccacaaaattaggccaggattttcttgctaaacctaaatgggatgactgcctactaaaacaaaagatttaaatcagactctgagtctcctaacagcatagccaaattccaggatagaatgaaaaattacccaacaaaccaaaagtcaggaaaatcacaacttgactgtgaaatgacaactgacactaacccagagatgaaacagaagaagaacttattgacaaagattttaaagcagccatcctcaaaatggtgtaatgagtaactgtaaattatttagaaacaaatgaaaaaatagaaaatctcagccaagaactagaagttattaaaaaaagaaccacggtgctcacagttcagcagcaaatacactaacattggaacagcatagataagattagcatggcccctgcacaagggtgacatgcaaagtcgtgacgcattccgtattttttgagaaattaaaaaaagaaccaaatggaaattataaaactaaaaagtacaacaaatataaacttagtgggttcaatagtaaaatgaaggtgacaaaggacagaatcagtgaacctgagaacagatcaacagaattaccaaatttactcactatgaacaagaagaaaatagactaaaaaccgacaaaaaacagaccctcaaggacttgtagcacaataacaaaatgttcaagattcacatcatcaaaggtccagaatagagggagaaaaagagagtgggcttgaaaaattgtttttaaaataatggcttaaaattttctaaatttggcaaaaaaatataaatctacagattcataagctgtataaatctcaaacaggataaacccaaagaaatccataccaggacatttcataattaaaattttgataagtgaattgcaaaaaaaaaaaaaaaaaaaaaagtcttgaaagcactgagagagcaacaacacattacctattagggaacatcaactccaataacagcaaatttcttacctgaaaccatataggccagaaggaaaaggtgcattttccaagtgctgaaaacaaagaattgtcatcttcaaattctatatccaggaaaactatacttcaagaatgaagggaatatagaaacagatgaaagaaacaaaaggactgtgttgctggcagaccttttaaaaatggctaaaataagttttttgaacagaaagaaaatgatggaagatggaatcatggagcattaggaaataaaacaacaaaacaagctgaaatatggctacatacgatagatgatcctcctcatgagtttcataagatatattagatgacttaaacattataacaccatctgatactcaagacaataatatttaaaagtgggaaaggtaaaagcatttaaatggaaataaggcccccatgtgtcactcaaagtggtaaaatgttgatatcagtagactgtgataagtcacatgtgtattgtaatgagatagcaaccaaaaggaaaactattcaaagaggtatactcaaagacatagtaaataaatagaggtataatcccaaaagtcctcaatatctatttgggattctgcatatcaaatgactcaatataaataaaagtattaagttgttcatggcaaagtcctagactaggagctacctcattctgagacagaactagactggagcatgtttctgactcttaactaggaatcaggatcaccagaaattcctggaccttaactgccacatctttgaaataggagtggctggagaagtaggtctggcagacaacctggaccacacccagtgataattctatacattattacaggttttaattcttctcatccatcccgtgttatcccttatgattcagatgtctttcaaagtgctctgaaaactgtaagaaagttcacaatccaaagaggatattgtatgacacactccaagctctcacaaaccccagagtagagaggagaggaagtgacagaaggaagacacttcaaatgtagcataaacctactggagcatggaccatttccacttagaggaattattcatttctttcccacctctggtagggaacaccaataagcaaagcagggtcacctatttactgctgttcattcggcatccttttagatcaactataacaaatccttggaactaaaggaactatatgaaaattggctgatgccaatcatggtccaccaacttaacatgctctcacttcttcctcagtttaccatgctatcctattccaagtctgcataggtggcaagataatttgtccttgagaagtgctaggtcatatatggatggttgggtacactggacaatgaaatgcatttaaaacaaaatatgcctttgcttttttttattatttttttttttttgcagaaggggtctcgctctattacgcaggctggagtgcagtggcatgatcttggctcactgcaacctccgtcacccaggttgaagcgattctcctgtttcaccttcccccagcagctgggattacaggcgtgtgccaccacactcagctaattttttattattattatttttagtagagatggggtttcaccatgttggccaggctggtctcgaactccagacctcatgatccgcccacctcggcctcccaaagtgctgggattacaggtgtgagccacggcacccagcctgctatgttttataaataagtataaacaccttaattgcaccatttaccacaaaagttaaagggcttgcattttcttatcagtaatatgtaaggatttaaaaggctctatacatttcctcagtctcttatgttctatggaattattttccctagacagatagtggtgaacatacctgggctagaacatgccagtgtgtgcacttgctggctgcgtgtcctggctcaataccctgaggttcagtttcttcatttgtgaaaaggatatggtaatacctaatttacagcagtgctataagaaccacatgaatttctgtatttcaaacacgtgacatgtaataagctttctacagtagctattataatccaggagcatgctctttgtcagaaactttaccataggtagcaatggatttggaaacaaagtaaaacatttcaagaaatcagattagtaaaggttatggcacaaaaatacgtcaagttctatggacaagatagatgttacctctaaagccaaaattctccctgcttatgtttgggacttctaagatccctggaactctagaatcaaccttctgactacattgctggtccattctctgtcttctattatatgtaggacaatgttaacccttcccaacttggtgtaatgtgtttcattaaaaaaaggaaaaaatcctacttcttaatttgtataatataatgttgacactggtgatgtttttaaaaaacttatttcaagccatgtgttctttgggtgaaaacttctgattaaagacatataatcattaagagtatcatctccataattttagcctatgctagaaatgcaagctcatcttttcattttttagtaccaacccaacacatgccaaaatggtcacctcaaaatattatctaataaaagtacatattctgatcattgtgtggtagaatattttttcatattaaaatatttttcttgggtttgactcttacacttagggaaacaaaatgcttcacaacaataatactattatggctcataaccagttatcaaaatacttttaaaacagctgattttcttctagaatgaaactttttaaattaaaatgcttttccacataaaatgcatatagtcagcaaatacaaaacataacaaatatatcacataaagtaaatgaactatatatttacttgtaaaaccaaagtttctatggagtgacattggatatatatgctttgaaggccaacttaaggatgaaggaagtttctaaaaattatgatataaaaatcctttattgatgcaaaagggattcagattaacattttaattctgtaacttaaaaaatctagaattaagaacaaaacaaattctatgaatgtacattttctggtattactacatgcagctaatttcaaaagttgatatatatttgaaaaatgttaaaaattacattgatcgtattatcactttaacaaaagggagaaaaggataatactacctctgagaaaggactaagtcttatttaagaatttgatggccctaatgtcacaaacaataaatattccttataatattctgtccggcaaaaaatcaagagaggaacagagagaaactaagatgaacagaaatgtatggcgaacaacctagaatgactcactggagacttgacagaccctgagccactgatggttctaatattcttagctctgtaaaaaggcaaggggtaatcgttcttggtctttaatggaacagactctggtgaaagaaagagaacagagaataaactataagaataaagacacacaatcacctcagccaaaataaacaggttacctgtaaagggagcataatcagactgacccccgacttttctgtaacaatgttaaacatcagggtccagtaaagcaacatctatatgagttcacaggaactgttttgattcattaattctatattctctcttgacattcacatgtctggacaacaggaaaatctcagataaaggatatgtgttgtctttgcatgggagactacaggttactattttctttctttgattcttaatatttcccaatatatctgtactaatcatatgttatctttatagaagaaaatgatttttattaataataatgcacagattaaaacagaaaaagcaggaactacagagagcataaggatggtaaggatggcttactattcaaagaacagtaatttgatttacatcggtttaattgttctaactttcacatcaaaaaagaaagacttaacctttgacaaaacacacacacacacacacacacacacacacacacacacacagcttttctgatttcagggaaaagctaaaacagattcataagaaaattacactacagaagatggaggctaaggctcatatccatcccaaataattctgcttctcatcagttgcttcttgtttaattgttctttggaaataaataatcagtgtgtttttcttttcttttttttcccttatgcatattttaggaacatttttctatttaaactaggaactaaagtattattaattttaaatatctaaatgtttataaatagtaagcaattttaaaatattttacttaaattattttaaaatattaagacatttgtttaaatgcttttataattcattaatgcttaataaactattaacaaattaatattaattaatatattataattaactatatattaaattgatactaagttattgtctagatgttattttattaaaatttaaatgtactgaattataattattttcatcataaagtattaaaacagaaaattaatactgaaattagtctcttatcacatcttatgttcaagagaaatcaaaagggaaatataaagcagaataatcttaaaggaaaaatacattttagtaactgcattgaatggaacattctggtctttcagagagattcattagttagtgaagttacctaagcactgtgaggaagtaccttttcttctgtggaccagaaattccctgaaatgaatacgacttcctaggaggccttgaaaatgcaaagggccagctcttggagttgcccttgctggaaagaactatattgaagggaaagggcaggtgtgaccagcatcctttcagaagaactggtctggtcacatagagaaaaatgttcaaggagtcttatagtttccatttcagaagggacacgagaactaccaatcagatgccagggaagtattgaaaccaaccccatcgttccatagactgttcttttggataaacatagaaattgaccttttttgtcttaaagcttgaaacttatatttattttatctgagttcctttcttgggaaaggaccttcaggcctctcaaaaaagtatcaaagaagtgaaactcaccagatcactgtaccaaatgccatatccctcactcatcatgactgcttcgttgcccctccctagttcctatttcttacacattgtgactatttttttcccttctatataaacccgtggttttagtcagtcagggagatggatttgagtctgagctcccatctcctcagctgcagcacccaagaaaagccttcttccttggcaatgcttggcatctcagtgattgactttctgtgcagtgggcagcaggacctagaccaaaccccgggtgtttcagtaacagtataagttacatgatcctagcaccttcttgtacaggagcagctcatttcactgtgctcacatttcattgattgacatcacattggcatctcagtgattgactttcagtgcagtgggcagcaggacctagaccaaacccctggtgtttcagtaacagtataagttacgtgatcctagcaccttcctgtacaggcacagctcatttcactggctcattacattttttagaaattgaaggtttgtggcagccctgtatcacacaaggatagtggcacctcttctccagcagcatgtgctcacttggtgtctgtgtcacatcttggtaatcctcacaatatttcaaacttttcattattatatctgttatggtgatctgtgatcagtgttctttttgttttgcttcatttattaaataaagtatttatttatttatttatttatttatttatttagagagagggtctggctctgttgccctgactagagtgcagtggtgtgatctcggctcactatgacctctgtttcctgggctcaaaagtgatcctcccacctcagcctcccgagtagctgggactacaggtgcctgccaccatgctcggctaattttttgcattttttggagagacagggtttcatcatattgcccaggctggtctcaaactcctaagctcaagctatccacctgcctcggcttcccaaagtgctaggattataggcatgagccaccacatctggcccaaatgttatttttagagcaggttagtttcacaacataactgaccaataagtgcagagagaaaattccacctaagactttcatagctggagaggaaaagtgaatgcctggcttctaagcttcaaagggtaggctgactctcttgttaggggataaagcggctggtgtgtctttaagcagaagccagtgctcatttaccattccaaaaatcctacagcccttaagaattatactagatctactctgcctgtagtctataaatggaacaacaaagcttggataacacatctgtttatatcatggcttactgaatattttaagcccattgttgagacctgctaagaaacaaagattcctttcaaaatattactgctcattgacaatgtacctagtcgcctaagagctctgatggacatgtacagggatattaatgttgtgttcatgactgctaacccaatatccattctgcagcccatggatcaaggagtaattttgactttcaagtcttatttaataagtatattttgtaaagctagagctgccatagatagtgatttctctgatggatcttggcaaagttagttgaaaactttctggaaagaattcaccattctagatgccattaagaacatccatgattcatagtaggaggccaaaatatcaacattaataggagtttataagaagttcattccaaccctcatggatgactttgaagggttcaagacttcagtggaggaagttgctgcagatttgggagaaagagcaagagaaagagtcagaagtggcacctgaagatgtagctaaattgctacaatctcatgataaaactttaatggatgaagagttgcttcttatggaggagcaaagaaagtggtctctggagatagaatatattctggttgtcagtgttgaaatgacaacaaaggattgaaaatattccatcaacttagttgataaagcagcattagggtttgagaggattgactcagattttgaaagaagttttactgtaggtaaaatgctatcaaacagtatcacatgctactgaaaaatcttttgtgaaaggaagaatcgatcaacgtggcaaacttcattactgtctcattttaagaaattgccacagccaccccaatcttcagcaaccaccactgtcatcagccagcaaccatcaacatcaaggccagaccttccaccagcaaaaagatcatgacctgtgcagggcatggtggtgcacgcctataatcccagcactttgagagaccaaggcaggtggattgcttgagcccaggagtttgagacaagcctgggcaacatagcgagatgtcatttctacccaaaatacaaaagccaggcatggtggttcacacctgtggcccagctacttgggaggctgaggtgggaggattgcttcagcctgggaagtagaggctacaatgcaccaagactgtgccactgcactccagcctgggtgacagaggaagatcctatctaaaaaaatagtggaggatttgaaaaaaaaattaagaagcagacttaagatactttaatttttttaatttaagaaaaaatattttcaaaagattatgacttaaggctcagatgactgttagcatttttaaagaaataagctgtttttaaattaaggtatgcacatacttttttaagacatactactattgcacatttaatagactatattacaaacataactatcatatgaaccaggaaaccaaaaaatttgtgtgactcactttattgcaatatttgctctattgcagtggtctggaaccaaatctgcaatatctccaaggtatgcctgtatctttcccatatgcctatttcccaactgagatcagaattaacacttataatacagaaaagggctgggtgattgttttaacggccagccggaaagcagaaaggctagggagacagtatctcagtctaaagaaaacctaaaaggcagaaacccttgggtgataggaagtgaaggtaggtagatagaagaataaacgtctgggttactgagggctgtgggagggagaaaggaaagcacagtatcaatgcagaaacagtgtgactacatcacagtttttaaatacttaataatagaaaatggaaagaaaaacaacttctttctaagcacatcctacttttgaccacccatgtggccagatctctttgctgtgaccctctccatcatcgaggtgactagaagtacttcacattacagaattgtgcaacttgtgagcttgaacattgccaggaatctccacctctcaaagacaattctgatttctttacaaatgcaaatatttgatccctgacccagagatagaatacaaaactttaaaactcttatcttctcatgacagttttaaaaaaagaattagtagggggcaaagaccttttggctgactacagagttttctcatttttttcttctaaaagcaaagagagaagaggaaacaccaaatgagcttctcctttcacaataaaacccgttttcagacattcgtcattctgggaacattgagattttattaatggagatagtgtttggatattcaggctttcatcaactatagaagctggcatggtctaaatttgaacaaactattgaaatatagccataaatttcttgctggagacagcgtctccatattacagtttttttcatgacgcaaacagtgtccaaggagaagggctagagattccattctaaatgccaccaggacattctgttcttccttcttcaccctccagatgagaagggttcctttcagttcaaaggatgctaatcttgcctctcttgggactgtcccaaataataaacaggctgaccttagctaaacagagcaactggtcaaacctgggaagatcagattttcagcctcagaaagcactgtcatacgaacaaggttgggaggttaacagcattaagccagttactctttagcacatcctatgaagtggtgtcatgtgtgctatttgtgctatttcccagaggaggaacttaaacttgaaagtaattgacttgtcaagctccattcaaactgaagtctgtattcaaatccagatcttccagtatattccctgacctagaaaaccatctgggatataatagataccatctatctaggaatctagctatgtatctacgtagatacctcttgtttacataactgaggcgttgagctgtctgactccaaaagtgtttttctgccagaccatgctgcatagaaagtacagacttttagagcatctgttagattaaatacaggtttccaacaggtagtatttaccactactacaagtcagccaaatcagaaaggttcattatcctaaaagaaattaaaatcagtgccaacctgtcataatatacatacacacaatttgtttctaaaagtctctaaatgaaagttttgcaaaagtattgatgaaaggtatttatatatatatgtatatgtacacacacatgtgtatcaagttcattttaataagtatatatatatatatccatttttagctttagatattacaaaactatgtaataatcagagtagaccagcagataagcctaattaagtatgcccacaaacaaaaagcacattctgaatggaacaaaccaagtgaagtggagttatggaaaataagactaaaggacaggctgcaatgtgattttggaaggacgagaacattagggtaagagatttctgctttccttcttaggcagtggggatccatttaaattgttgagtaggaagatcaaagtggctattttgtagaatgtagatgaaaggttacatgctcaaagaggagagaacatctaagaagttcaatgggtgcctgctatatttttccacaagaaagctggctattaccagactgtatgaacaagacacgtccaagcttgacaagcatcactgacttatttttggcaggcgatttgggacaaaaagaagttccctcattgcttttttcctttggttcctgtcctcaaaggatgacagcatctcaaaaggcaactcttcccaggagaaagcaagctccacacccaagaacttacaaactcctttgcctgattctaatcctgtttccctttgtcttatgtagctgtctccctaacttttaaaccattttatcactgtgtacacaaatgtctttgtgttaatctgttttcatactgctaataaagacatacctgagactggataatttataaagaaaaagaggtttaatgaactcacagttccacatggctggggaggcctcacaatcatggtggaaggcaaaaggtacatcttacatggcggcaagcaagagggagaatgagagccaagtgaaaggggtttccccctgtaaaaccatcaggtctcatgagacttattcactaccaccagaacagcacgggaaagacccacccccatgattcaattaactcccaccaggtccctcccacaacacatgggaattataggagctacaattcaagaagagatttgggtggggacccagccaaactatatcagtctttaataaatgtgtttccacaaaatctctagaacaattctggttgtgaggataattcttggtttccttctttcccaggctgagagtcttatcgaggaaggcagaatgctgatactgacatggaagatgcctagtacagtatgcagagacaggcctctttttatctcttttcacttcctttcttcattaaagactcaaggggggaaaaaaagcttattttgcttgctgagatgatacttctgtgttttacctttcctgcttcaaaattaatgttttagctctcgagctaagacaactgctaatctcatactcaaaaatgaaacctaaccttagttctagccacttggcttgaaagaaacttgaataaaacagatttcgcaagttaaaaaaaaaaagaatttaatgatcagaatgatagtgagggcccctttgtgcaagctgcatgcacttgcagtctaggaggtctctcatttaagatgcagacattgtccttaaggataattttgatggtttttaaactccctgtataattgtactctctaaagtgtgcttatgattcatagtttttctttatcttctttcattttaaaaacagtaatatttattgctattttatgatgatgagaataagaagtacatattgtagaatatttgaaaatgaatatacaacaggtcgggcatggtggctcatgcctgtaatcccagcactttgggaagctgaggcaggcagatcactggaggtaaagagttggagaccagcctgaccaacatagtgaaaccccatctctactaaaaatacaaaacttagccaggggtggtggcatgtgcctgtaatcccagctacttggaaggctgatgcagaagcagaagaagaatcacttgaacctgggaggtggaggttgtagtgagcagagatcacgccattgcactccagcctgggagacagagtgagactctgtctctcaaaaaagagaatatacaacaaaaaagtatctgtaattccatctctagaatttaatctgtgaacatattattcaaaatgtgtacatgtatatatacacacatacatatgtccacatgtgtatgtacacatataaccacaatcatatatttgtacatactcatttttcttagaataaatttctggaattatgaagatgtaaatggatatgaatggtttaaattccttagatgtagattttagctatttttccatacgttatcatcaaaaacgaaacactgactaccctgagaaagaagaaaaattgaacgagtgtgccttcttttcctctcttgcttacttctgagtgtcttacttctcacttctgtcaatataagttatcaaattatcaatatgaaaatcatggtaataacatgaatgactaaaatcaaacaaacaggtaagtatacagtgatataaccttatggttaaaatgttagatgttaaatttaaaggataagggaaacttgagtatgatatcaattatataatactactatatacatttaaatgcatgtatacacacatgtagcatgcaatagccagtatctactgaggtctgtcatataattggcactgtgctaataacctcattgaatatacttctcatgtagtccctggcaataaccttacgagatgggactgcctgtattttacaaatgaggaaactgaggttcaaagaggtcaagaaacttctctgggcaatacagctaggaatgacggagctgggatcttactctaaatctggatgcctccagaggcctttgttcttagccactatgctatattggcacaagaaaaaaatacactggatggaagtatgtcaaaatggtggtggtcaagttcagaatcacttttgtaaccttacttaaatgattctgtatactataaaacattgacataggatacgatttacttttataaccagaaataaattagtgaataataagtattgcatgcaggctttgtgactcagacccaggtggcctggatcactcagaccctccgtaggaagaccattattattatgcagaaacccttgggttggccatactttttttcctcttctgtcttgtagctgaggtggaacagcctcctaatgaggcagatgtctttttaaagtcctccagttttctctagagaatgctaattactcccaaaccaccccctaaaaaaactccactcactttaactagaaattataaaaaaggtatatccagatgtcagcaacaaagataatattttttaaacttggaaaaaataactgtaacaatatgcatggaaaactatataattcattcttttggataggccaaaataaagtcttttttttttttttaaggttgttgagggcagattaactagtgctgagtgtgtatattgtcaatattgtaataactttgtagttggaagataaaataacttcttttcaaatataagctaaggtatgaaaaaaactttaaaatgttcttggccgggtacagcggctcacggctgtaatcccagcactttgggaagccaaggcgggtggatcacctgaggtcaggagttcaagaccagcctggctaacaaagtgcaacctcgtctctactaaaaatacaaaaaaaaaaaaaaaattagccaggcatggtggtacatgcctgtaatcccagctacttgggaggctggggaaggagcatcacttgaacctgggaggtggaggctgcagtgagccaagattgtgccattgcactctagcctagatgacaagagcgaaattccatctcaaaaataataataataataaagttcttaagcttttcaggggcagggcaatacgtttttaataagactaagaaacactatgctaaacctgattcttgagggagccaaccaatatattagaaagccacatgactgggctatatctttaagccccacagaattgctttcattgaactgcactttggttacagaccaccaaccttcactgagaaatgatatggcatgactttatgggacatggtactgaatgtgccataaagaatgtagagctctccagaacatcacatcatagctgatgcatccatcacagagcaatacccaaatgagaaatgtctctttggactcagtacttagaagggttatttctcctgattttactttatggccaccaaatcatgaacgttattgtgttttacatcttcattaactgctagaaagtatgtctttacctgactccatgtcattttcttagatttctttttccctttccctcctttttcttgcttattttaaactcaactttgtcctctgaactgaatgcatctttttaagctgtcttaaatactttgttttgagactgggtctcgctctgccacccaggctgtagtacagtggcacgatcacagctcactgtagcctccacctacaggcctcatgctatccttccaactcagccttccaagtagctgggacaagaggcatgcaccaccatgcccaactaacttttgttttttgtttgtttgtttgtttttttgtagagatggggtttttccatgtcatcaggctggtctcgaactcctaagctcaagcaatccatccactttggcctcccaaagtgctagaattataggtgtgagccactgcaccagccaaatccttttttaaataaaagattaagtataaataaacaggcacatactctgtacacttctgtaagactgtttatgtaagactgctattggacataagaaccacccaacatgaatgaaaccagcatgtttcctataccaaaaagaaaataaattttcatttatattttaacagtgagattgaaacaatctaaggtctctcacccacaggccattctgcagacactcaggttacaacctgaacccaacagagtagctggcttatgtacaggctcatgattacatcatgattatgtgtttccatgccactgtgttcaggaagtaagcggtctggatataagatttctagccatccttgaggtgagtggacagaaggaactgtcaggttagagatgcagcatttcaaaaacaaacagaagggatgaaggaaggggaagtgaaggaacaggtaaagagatatgagactcagagaagagtaatgtctctgtagccaaaattaaagaaaacttcaaaaagaaagtactagatgatacattctttaacagatgactaatattcctggcaaaaactttttaaaaactaagtatacatttaaatacataacattccatcctttagccttcaacctaacaacatcaattcctttaaaacagcatttttgaaaagctggtttttttttttccatctgtactcaaaatggtacatctatggtggacacaccctaagatgttccaaaatgagtcacactcttgtgtagtcccccttcccctggtgtgtgagcagaacctgtaacttgcttctagccatagaatacagttataggatgccactcccttgattaggttctgtcaaatagcaaaagtgaaggggttttgcatatgtaattaaattgacaataaattgctcaaaagggagattaccctgggtcagttggactgacttaagtgagctctcacagaggccagagactggaagaagtacagatttctctctctctccctctatctctccctccctctctccctctgcccaccccctgcctccgcccattgctggccttgaagatgcaagttgccatgaattctacagtcacaaggaaatgaattctaccagcaacctaaggaacttgaagcagatccttccctagtcgagcctccacatgagaatgcaacccaactggtacgcagacttcagcttgtgagaccccaagcacagaacccagctaagcatgcctggacttttaacctacagagactgagagataattcatgggtgtgttttaaaccactaagtctgtgacaatttgcgatgtagcatagaaaatgaatacaacacctaaagacagagacaatttgcatgggaattgccttttaatccactaaacagaaaaaaatgtaacggaaacttcagactcctctcttaacttctcacatcacttagccaagttctcccacattagatgttccagatacttaaactaaagcagctgtcaccatatccaaaatgcttcgctggagaaccatcacatgacaccactgtgggagtttcaatgcttgctggcccaaggaaatctgcctccaataaaccaggaaatgtttaacccagacagcctgtaacttccacaattttctaatcagccaccagagagtcctctttagattgtcatagtgactcagcacacacacatcaatgccttcaaccccaaagctgcacatctatgtacgtagttgttctcccttcacctacttgggcatgaaaatcaccaaatgagcacagaatcagcaaactttgtataggccacaaaggaggaggcaacgtttcatttccattttagcactgagatcaaaacacagccaaaggccaggctattcagctgagacttgattccataatagcatgttctctctgccctgcacaaaattataccctgattatgtatttccatgccattgtgcccagaaggtggttaggcagcaacagctctagcatgggtggaaggtttaggcatctgaatatttggaaaagtagagaatggggggaagggaaagtttgtctctttttctgaagcatttttctgtcaactggaaatcaaacttaccaatgcttacattatacttttctgagtgatgaatacaatgctttggatgcatagttcaagtaaggtcgataagcaatttatcttttgaaattatttctaatgagagagcattggcaatttttttcaactgttgtgatttttatgcactaattaaaatcattataatacttatatatactagacacagcagaaatagcaaattttcattgtttaaaaagacatcagagaataacaatcttcttttcctttttttcttcccttcctcttttgtttttaccttttgaaatactaaaggcaacaaaatagcaagtaatgagcaccagcattgaaactacaagtcctaggttagggtatggggtctagcaaatacttaatttccttcagtaattcacgtcatctctctgaatctgttttaccatctctaaaatgggtaaaacactatctgcactatcatacctacaatttcataaaaatcatcacagataatatgtctacaaagatattgtagtatatataaaccaaatgtggccaggcacagtggcccatgcctgtattctcagcactttgggagactgatgtgggaggaatacttgaggccaggagtcccagaccagcctgggaaacataatgagaccccatctcaacaacaacaacaaatttttttttttttaattagccagacgttacggcgcttgactatagtcctagctgcacacgaggctaaagtgggagaatcccttgagcccaggagtttgaagctgcagtaagcaaggatcgctactgtactccagcctgtgtgacagagcaaaaccctgtttcaaaaaacaaaacaaaaaacaaaacaaaacaaaaaacagggtgaggtaggacgatggcttgagaccaggaggttgaggctgcagtgagctgtgatctagccactgtactccagtataggtgacagagcaagatcttatctcagtttaattaaaggaaattatatgaatgtatttttcctttcaatatttatgtttcctctcatgaactgacaaactaaactttaagagccagtagtttattactctgttcctaaagacattaaaatagttaaaagtaaattacgaaattactgtcagaaaaatatagtaacagttaacatttaataaatgtcagacattgactaaagggcatcacataacttttcatttgattctcacatgaaggaagtcaattatctctattttacagatgaggaatctgaagtttcaggaagttaaagagtaagtagtaaacctatgataaaaaaaattaagcaggttaatccggagtccacaattaaccactcaactgtttcaaatacattttccgggttgatactccaagaaaaggagcgatgagatgtggtctcagcatacaggtggtcttgttgttataaagcagagtgttcctagtgagctaggagacctgatgtggaggacaagcccacccacattgcagggagaccgccacagacagaagctaatggccagccacatgaaaggcatgccattagggcaggttatgatggacgtaatgctccctggagttgtgaactgaagaagtcctgtagaatttagaacacatcaattgacctacagccagctaccaaaccacatcagagcctacggggctgcatctaggtctgcaaaggtccagaagttacagagactgctgctgcttgatggtgagtatgcagagagcggacctgagcagcggagaaagtaaccagagagctggaaccaagaaataaaagtaggaactggggaagaagagtcaatgagatgaaagaaaacaaaactgaagtaaagccagaaaccagaaatactgtaagactctggttcccaaactgtgcccccaggaaccttggggtgccacagtgaattcagaggaatgctactagatatttttaatttgagggcagctaacactcgacatctctcagacaccctctgaactacgagcataaagtagttcagcgcttcaacattaaatggcattacattcctttcaatgacatcatgtccttgcaatatgatatctgctataataaaaatgaagtgtaaacataaaactcagtgtggaacagaaaatgaagatggtggtttccaatctgaattcaagttttgaaaagttgtgcagtgcccaacaggtgcatacataccttagtaaatatgaaggattagataaaaatgataattctttcaatttatatggttttgttttacaaaatggctactaatttatcaggacctatatacgtattaagttgaattaactaattaagttgaatatacttattaagttgatttaataaatgaaactgttaggtatttcttttagctttggggcactgtaaaaaaactgagacagtatgagcactgaactgagacgtcatgggaatattacttagggattaaagttgtctagggaagatagaaaagtaaaggatctcagcagtgagttgcatatctgttttcaaggtcttattattatattattattattattattattattattattatactttaagttctggggtacatatgcagaacgtgcaggtttgttacataggtatacacgtgccatggtggtttgctgcacccatcaacccatcatccacattgggtatttctcctaacgctatccctccctcagccccccaacccccaacaggccccagtgtgtgatattctcctctctgtgtccatgctttgacatggcaacaccactcaatacaaaggagacttgccccactgagtcctagaagcatcatgggtcctgacccttgtggtctggtcctgctcaagacataataaagatctgccacaatgaggattaattcagggactttagatttcagcatggcaatatgataatctgatgaaaacaagttatgtatcatgtattttataatagtacctaccaagtacttataaacttggcatcttatacagacggtccctgacttacaatggtttgatttaggattttttgactttatgacagtgtaaaagtgatacacccattccttagaaactgtactttgggtacccatacaaccattctgtttttcactttcatttcagtattcaataaatcgatgagatattcaacactttattgtacaataggctttgtgttagattattttggccaactgtaggctaatgtaagtgttctgagcatgtttaaggtaggataggctaagctatgatgttccaaggttatgtgtattaaatgcattttcaacttacaatattttcaatttacgatggatttatggagatgtaaccccaccgctaagtcaggaaacatttgtgtaataatctcacttaaccttttgaggttttactgtttctgctgtgtctctcatttaacacgcaaggaaactggagcttgcagccattggatacattgctcaagcggactctgctggtatgcagtagtgtcaggatgagaatccaggaagttgggacttcaaaagtaacactgttaatcaccacgctgtctttttcagctgttaggcctttagatttctaaagaagtaaatatacactagactttcacatggaacaaagtacttcaaaggagtacatatatttttatgtggccacatacattcctatttttgtttatcttggtttctaaatccttaaaaagtttccatctcttttttaggtttgctaatgtttatcatcatgaataaagataacacaaatggttgtaacatagtgccactaaaaaaaatccaatattgtcatgaatgtgacaaaagactcccaatccccttgtgataaattggcacaagctttctgaagaacatttaacaataagtcattatgattcattactctgtgaggaaggaatcataagagatatttatcttaatgttattataatagcaaaaaaaaaaaagaaaacgtaaatgtctaatgattatatatttcatcatatgaatgtactgaactttgggtagaaaaatcacactttcaaagattacttaatggcataataaatgctcaagacaatcttttaaagaatctataaagtggtatgcattatatgaattgaataaactattaattagcaaaggactagaaagaaacagtatattcaacttaatattttggttaattatggaaggtaaaattctaaatgattttcttttttttccttaatgaatatgcattagtttgctaatcaaaaaaagagtaagctgggtgtggtggcatgcacctgcagttctagctactcaggaggctgaggcaggaggatcactaaagcccactgagttcaattccagcctgagcaacatagcaatacactatctcttagaaaaaaaaaaagaggaaatgtgatgtgattaaaataagattcagtacttaacaaggtaaatgcagtctaatacttcattccctaaacatcacctgtatgtcaacagccaagtcatacataaaattcatttacataaagctttcctgattttacttccaacaagatagtctctctcctctaaattctcatacagctttatttgtacttcttttatggtacttttgtcaccttttgcctttctcaataattatctatgtatatgtgccatccttcctaccagactataggcattggcatgtcacggccagatttgcttcataattacatctgccatgagtctgactcccattctccctgtattttagtcatatttgtaagtgaatagggattatacattttggtatttgttttcccatcacacaacaggcaatatgccacccacgctgaattggtttgtatatagttgcagtgctctttatggcacccaaggagacaaataggcttagtggatggcaccccaaaatacagttttttcctgagattttggatatagatatagatatatgacataatatatatttaattatatatatataaaatagtccatatatataaagattgtctggcctcttgggggatacattggtccgtgtatccaagatgcttgagcagatgctgaaaaaccacttatcattgctcccatatagacaattcaagcctggctttggaagattgtatgaacatcatattcctgatagtctcataatcctgatagatgacagtttatagaatcctgctgggattctacatcattgattgaatgaatgactagaggatgaatttctggataaatatacaaactaacgagtggaatccccatatagaaccttcagatcaccttgtacaggcagagaatgggaaaatgccactcatcattatacaggcctataaaagaagctagataacttcaaggaatgcccatcctgggaaggcagctccaaccactaatcacagcaggccacaggtggccctttcatgtatgtgagccacaggtaaagtatgagaacattacattcaccgcagcatgtgccaggcagcatgctaagcacttgaacaaatctaattttctcaacaatctcctcatttgggagacagtactctacccagttatagatgggaatagaagctcagaagggtcaaatatactgctctaggtcacacaattaacatgtcatcagaactggtttttttttgttttttgtttttttgagttggactctcgctctgtcacccaggctggagtgcagtggtgcgatctcggctcactgcaagctctgcctcccgggttcgcgccattctcctgcctcagtctcctgagtagcttggactacaggcgcctgccactgcgcccggctaattttttgtatttttagtagagatggggtttcaccatgttagccaggatggtctcgatctcctgacctcgtgatccgcccgcctaggcctcccaaagtgctgggattacaggcgtgagccaccacgcccagcccagaactgggtttttgcacacaaggacatgtgagtccgactcccaagctcttcagattataccatgctgactcaggaagaaattaaagcctatgaacaagcaaatgattgatttaccctttttctacaaaagtttccatgcagacacatacaattgtattaggttaatgcaaaaataaatatacattgttgctccatcctcattcttgggggaaacaaatggtttctcctcaggataatataaaatcatatgcctacttgaaacattcttagataccccataatttctcaagataccttttagtagatcaggtgattttcagacattaatttacaggtgacaaattttcctagggtgataaaactaattagtgtggatgtttcaaatattttgagaggaaagtctatttagtgtgaaacaatctattttctttcatagctcttcaagagccaagaattttgtccgagtggttttgtgttttttttcccctaactctcctttcctttccttttcccttctgatcctctcccctgtaaagcaagtgtgcaaactcacatgcctggggcaatcacggatactcacagtaccaaaaatgtgcccatttcagtggaaaaggtgaaaagggttttaaaattgagcaaggacaggttgaatgccatgtaatttaaaccaaagccggcaactcctcacacggtcattgttgaaggtttgtgtgacgtaagtactgatgcctgaatcccaacacaaagattctgtttcaatagtctgggctgaggcccaaaaatcagcctttaaacaagtgtcccaggtgactcagatgcaaggtggcccttggaccacacctggagaaacactgacgtagcgaagtccttcgtggtacagataaagaagttgtcgtaaaggttaagtggattgcccaaagtcaattcaacgagtaagtggcaaatctggaattagaatacagctaacgcctttgcaactacactacatcacattttttacttagcattccacacttttttttttttaatttgggtcactgctctataagtagcagctgcgaaaacattcataacttacatttgtgtggcacttcctataaaaagagctctcacattcattatccaatatgatcctcaccaaaatatattttctgtatttggcagatgaaggggctgaaattcagagagattaagattcttgctcaaagttatactcaatttgggacaaagtaggacttaatgagttctgaaaactagtaaacactcaaatgttaaccattattattatattttctttttagaaactctcagaactaaaaatattgacctaggaaaagttaagaaaagtaggaaaaattgaaaacaaaactgaaaacagccaaactgcacgcaataaagtttattacatattagaataaatttgatttgattcaaaaatgaatcaaatcttttttataaaatttagctgtaaaataaggccaaggaaaagtaaacgtgagaggaaaaataactcacaatagtagatggtttagttactgcaatttggtatgttaaaaaactaatcaataagttaagccttcatacacaaatctttgacatacacaaagattttagtcgtatgaaaattttagctatatctgaaactcgtagcaaactagaaatattttaactgtgctatatgttgaagggattaaagtgaattaataatatatactctagaaatgtcttctcaataaaaatcaatgttactgtaattctgatttaaatatccatatttataaagatagtacaaaaatgtcctcaaagtttaatcaaaacaatgggtctaaatgtcccatgatctcaataagcttcctagtaataaagctacatctgttactattaaagttataaatcagtaactgcagaaggacaatacactgaacatgtaatattttataatttaatggtagtaaatcagttatataatatagatagagcaatacatagaaatgaatattttttgtttctgcttctcatttcaatgctttttaaatttacaaatgctttcggacagatttcctgccttaaagtattaatactaatttagattgaactgaagcattaagaaattccactaaggaattctattaatgttactatctcactacgctaatataacataactacagttagaattactcatattttgtttctatagcatgctctgccactctaaataagtagttctcatctactggtactctagaatatatgtatggtgccttagaaatagtgtttttaattaaaacatcttcacttttcttctagaacattagaatttgccaaattaaacaaagccagtgctctaatctctaccgtctgatcgttttatacacacgcacacatacatatacacacacacaccttttaaagaatgtctaaatagagcctcttttgctttagttcagaaactcactgattccagctcctcaatttatagcttggcctttcctctcagactggaccaatatacaaaggagtaccacgtgcttggcaaggttagcaaacccaatcccttcagcataaaatggtgaatcacttgctggctacagcaaaaccttctggactgttcacttcatccatcttttctgcatgttctttaaggctaggctcctaagtggctaccttctctctcccaagagaaaggaaaataacttgagtgaatgagttcatgcctgcaatataaatatgagaagctttttgaagcacagaaatacctgtttagaatgaactcatggaaaacccaacttaaaatgcagtgttctttgtgtcaacaaaagtctacttgggcagaataaataagtgaagccatgaatttccagtctcccaatgccagattaaatcccatttcttcaaaaagaccctgttattgctgtgtcaccctattagaacctcatatttgctttggatcattataataactcctctatgggtgcaggagccctgccagggtttaagtaaagccatgaccacattcagtctagacactatcatcttcactaaaatacatgaacagaaagtagcttctcagaggcacaggctctagttaggcctcaaagaaaaacaatatcaaaggtaccaacagaagaaaaaaattgtttatatgaaaaaaacaaatttcattaaaatgcttttttcaaagagcatgacaaagactatgtaacagaagggaaaaattcaattttgacacagaagtttacaacattacctgttcataagcaagcaaaatttctgagaaaacaagattctataaactgaatacaatcctttatttcaaggcaactcaaaataaaatgcagaaatagtaaataagtgaaacttcttgtatagttaaattgaactccaggataatatggaagcctataagacaaaggagaaaatccatgtaatatagaattgattgctatctaaaatgctgtatttcccagccaataatgtgtgtgtgtgtgtgtgtgtgtgtgtgtgtgtgtgtgtgtgtgttatagttgccagataaaacacaagatacccagttaaattttaatttcaaataaaaaagaagtatttgttttttagtataagtatatcccatgcaattatttttattggctaaattcggcaattcatatgtgtgcctcctatgttcattctcattttttcaatctgtatcaggaaatcagaaatgatgcttcgagttgcaaagaacgtaaacccctcaaaaacagaactatacatttccagatgaaacagctgcctgtgaattctactgctgtaacaataacaaaaaacacctgaagacattctgaaacctcaaccaggccattacagactgtaaaacaccatagaaaattatattctcgttatgtttcaggtataggtgtcgacttttcctggcaatgatctttcagatcctgaaacacatacacgtcactgtcaatcccttcttcttctccataggatgttaatctgacatatagaaatgaatccctttccaccggacgtggtggctcacgcctgtaatccagcactttgggaggctgaggcaggcagattacctgagattgagagttcgataccaccctgaccaacatggagaaactccatctctactaaatacaaaaaattagctgggtgtggtggcctgtaatcccagctgctcgggaggctgaggcaagagaatcacttgaacccaggaggcagaggttgcagtgaggtggagattgcgccattgcactccagcctagacaacaagagcaaaactccatctcaaaaaataaaaataaaaataaaaataaattaatccctttccttataggtcagtaaccattcaaaacccatttacttcataaccagtttgatgatgtcaaattgctatctctagtcaattaagaaagtgaatattgggccgggcttggtagctcccagcactttgggaggctgaggtgggtggatcacctgatgttgtgagttctagaccagcctgaccaacatggagaaaccccgtctctactaaaacttcaaaatcagccgggcgtggtggcgcgtgcctatagtcccagctaccccggaggctgaggcaggagaatttcttgaacccgggaggcagatgttgcggtgaaccgagatcacgccactgcactccagcctgggcaacaagagcgaaattccgtcacaaaaacaaaaaaaaaggtgaatattatgccagtgcaaaatgcagccagaaagttctaagtaaatattgtctgacaattctggaagcttccctttccactctaaggatttatacaagatgtacatgcctaacaacggctattgtcatagctaagtgaaatactaattacaatacaagaaaagtaattgaatatttcattcaattcagggtataaagaatatctaatagaaataattcctttgcctaggcttacttagcaaacttctatacatcatctaagatgaaattccaacatcaatttcatcttgaagtcttttccagacattgcccggtgaaatacagcattcacatagcactttgcctgttttgtcatattatattgtgtttatttaccatgttatattgcacttatttaaattatctgtcattatctgctacagtgagagcttcttgaaagcaggatacatatttttgttgatctttgcagtcatactcattaacagagagtctagaagacttcaatgcatgtttgctgacaaaataaactattattaacaagtttgcaaaaaaaattctgatggtagtttcttttgctgtgcagaagctcttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaattgtttccccatttcttgtttttgtcaggtttgtcaaagatcagatggttgtagatatgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggaagttttcactggaacttagccttaaaaaaagtcctgagaggcaggagttgtagctgcttaattataacgaccttatggcaaatatccctttgaatgagatccactatcaaatcgcattgaatttttggctacctgggtatattactattgtaactaggcaacctgtaaaactcccaatccagaacaagaggtatatttcatgtagtcattcagcaaatatctagagtgccaggacctattctaggtgctgggaagtaagataaagccctggcatcatagaacagccatgatgattcttcacagagattcatgaggtagcagtgagagattaggagttattaataaatagcattttctttgtaagtaaatgacgatgaatcccagactaaaggattcacaggtggtcaaactgtgaagctaggaccggctagagaacagcaatcaggtctcatgaacccagccattcgtcatttcttccatacatgccagacatggcccttcactgctgatcaaaaggaaacagaataacagaatggtgccttagatcaggggttcgaaatccccaggccatggaccagtaacagtccatagcctgttaagaatcgggctgcacagcaggaggtgagcagcagatgcgcaagcattactgcttgagctctgcctcctgccagatcagtggcggcattagattctcataggagtgtgaaccctattgtgatctgcagatgtgagggatctagattgcgtgcttcttatgagaatctaactaatgcctgatgatctaagttggaacatttcatccctaaaccatcccccctcctccaacccatctgtggaaaaattgtcttccatgaaagtgattcctggggccaaaaaggttggggaccactgccctagatgatgcctgggctttcagctgtgccttaagtactgcagatccatctgagggagctcatgactttcttatagacattgacaaagtggcctgttacattccaaagttcattttaatagtcaacaccatttaaccaactctgaagagtcagcagatcagaactattagcatttcctgtgatgctaacaggatttttcatacatagggctgaggctcaacaagtagggtgtaggcaaagctgcagtaaaagcaaaggccattcattcgggataaaaatttacagagtataattcgagccaacagctgctggaacacaatagtaatttcatactatgtcatagaaatgaagcaccatctcgcacatcaaattatacgtggacttggtgtgtaggtagatgtgaatggatgtgggtgtgtcaaaaaagagaaagggaaagaaaaaggaggggaattctcatgaggacacaacctaagagtaatgataatacttgctaccattaagtgtcttctgtaagccacatgtatgtgctttacataaatcagttcatctaatgctcacaaccacttgagaaaggccctatgattcttactttgttaattctgaaaccaagactcagagaggttaagtcagttatttgggactatggaactcgtaagcaaggagccaggatgtgaacttcaaactctggcctatcttactccagatctaaactctcaacccctaggaaacagtgattctcagtggtcaccacaattcatttaagaaatctttgcatcatttattacctttaacgacaaggaaaagtaaatgactttccaacattcatatttggatgaacaagagtctcggccagacaaggcctgaatcactctcaacagacctaaaataagagcttcatgttctggttcctctgtccacacttcaaaaggaactctgttaggttcatgtggtatttttggtttctgtttctgtttaaacgtttcttctgagaaaaaatatttgaatggagatgggcaacaaaagggtataaagagctggtgtttgaaagttgttttctgttttgacccaagcccaggatgtggggtctgggaagcactgtgggacttttgcaaggactgtctcctggccaccacccatggtgccaagcagcctaatggctggccaaacaatcgaggctctcatggatattcgctcaggttcttcctcaaagaggcctttacagggatgccactgggacctgaggagacatggggtagctttagttccccttcagagtaacagaatgtgtagccggtcacctgtggccagggaataagagactctgtgtccattccctgcccctagcaacaggaccaattgggaagtcttcccttcctgccacatggctctcccacaggaaagtaaagcccccagattcatctctttgagaggatcctttatacactcgccactccctttaatgggggatagtgcatctaaaagcttattatgagagaaggtaatggctggtctgagtgcagggacgtgtacaactaattgattataaccaattacagatttctttgttctttctccactcccactgttctacttgactagccttaaaaaataaaaaagaaggtggaatgcaccgttcatacaaagaagaatcatagtcccttatttttgtcccagtcccctttcaagttttcctctagaaagctctacatggttgatccacagtagttactgtccttataattttatttacagaataaatagaatcctaagtaatcttggaaatcaaattggtcaccttatcatacggaaaaaattaacacagggaaagtaacttgcccagaatcatccagatagttcttgtcaaagagtagattccagaggtgccctgactcagtgaatataactgaacacacacacaaacacacacacacacacacacacagagagtgagagagagaggagaggagagagagagcacaaacttaatataaaaaccaagtggaatgaaaaatagtaacataatgctgttgtcaagaaagctaacaggatgctaatatatgtgaaaagctactatatgtgatgctaataatgtacaagcgattcagtttcagataacttttttcaaggtttaattagggagggagattaccaattggttataagaagacctattcaaggaaactcttcctttgagaaccagttaccttcacagccacaatgtttacacctaatcctggctagccacataaatacatggctgaagttcccaaaaaaagatgaagatggaaagtgtggatgggactgaacaaggcaggggcagtaaaaatagcaccttagtggaagtcaggaaacttggatcctggcttggatcaggagctaactaagacctgaagttctcaattaacctgggggtctcggtctcttcatttgtaagatgtgggagttggatgatataatttttagggatcctttcaagttctaagaattctaaatctggaccgactccagccttaaaaaaaaaaaaagccaattatacacagcaatacaagtccagtgttgagagctgcatttgaaaaactaaaagagaacctagaaaaaaatattggctgggcatggtggctcacacctgaaatctcaacactttgggaggctgaggtgagcagatcacttgagctcacgagttcaacaccagcctaggcaacatggtgaaaccctggctctaaaacaaaaaaaagaacaaacagagagcagagccttggaggagggtgaccattcatcctaggttgccctaaacagtcttgatttactcctgttatcccagattcccaacagttagtgcctgttttcattcccaaaagcatctcagtttggatgatacattatgtgaggactctgcctataaggaattggtgttcatttgatcttggggaacccttcatcgtctcccaactcccacagacagaagctcaaacttctcagtatgttataaaggttttgaccctcttgtcaaaactccatctggcatacctactaggtgctaatcacacctgactactttcagttcctcaaaggtgatcatcattgctcatgaactggtcaccttctcctccacccaatgctacagtgaggcaagctcctctacatccagcaagactcagctcaagattgcctcctctgggagcccctcccatcactccactcgtcatcactctctgcccatacctctactagcacatgaacccgagtgctttgcagctcttttttagtctcctctactacatcataagctctgtaaagaattttttctcttatcccttagcacacaattggcactcaacaacatgcttgttgaagtaaactgaaaagagaagcacatatagatttgctaataggacagtagccaaattaaatctttcatcagagtgaataagaaaactatggtcttaaacttatctgactcctgccactttcgtcaccactggtgacagtcaccatggtatgtgaagagtcagtgtcctgtggccaaaaggcatggtctacaagaatctgacagctgatttccagttctgccacttacaaaaagaatgatcttagacaagttacttaacctatcctaattcagttccctcaacgtaaaatgaggaaaatgtaactccttgatgtaagagtataaacaacacaggaagagtagggccgcatactgaccctagtacagagaatgtaagacataaggagtaatttagcttccatggtgatcgtttccaaccagaacaaactagaaaaacagtgtctccctcttcttccccaaagaggtaagccacacctggattcattttactttatgtctctccccaggactcagatgtaaaaacttcacatcttaaccatgattttctcttttcaaattctggatctcctcctctctaagtatcctggacagaagtgtcatcacaaagaatacagccaaaaaggaaaggacttataattcaagacatgccatggtcaaataaggaagaacatcttgacggccactctgactcaatagtggaaacgactcagaaggaattcttggtaaaatgtcaagtagggagacttcaagcctagggagggattacatgactttatgctagggcaatgaaccttcaagttaactataccttgaacaaaatcctccctcaatcagaagccatcagttagtgctgctgcaacatgaaacagtggaaaagggtggatgaaatgagggtcatcagaagcaaaaggaagaaaagattgctcccttaaaagctttctctgcccagggaaacaaagcccagtcagcacagctaggcagtttcaacagaaacaaatgagatcacagtgtttcaatttaatagcacacactgcttgctgttcaaatgttataactaaatacagcatgtgctgctagttgttttgattaaagggaagtagaataacatggaggggacaaacacatgggttctgaaacccaagtgcccaaccttgaatcccagctcctgaccttgaatccccgttcctatacttcctagctgtgtggctgtgggagagttacctaacctctccttacctcagtttttatcaactggaaaataaggataacaaatcaataacagtacctatacgccatagggttgtaatttacaaatactaatttctaaggtagcacatgatttatgccaaataagtatttcacaactaaaaataattattaagatccagtactcactcaaaagcagcttaatacaagatcatgcttaaaaaccagccattggtattgcccattattaatctcaaagatgactttattttaatataacttgactcataacaagtcagttgctgaccaacaaattcttcttttgatcatgaagactgaataggtctaaaacccagggatcattttgatgaagtgaaaatggaaactgagtaatcattcccagaataaatggaagtaaaacaaacatattatttactgagcacccattgtagccaggagttttccaggctgttgtattttagaaggcatagaacataaaggtgtcgctaggtttggctcccacatagctgaataaagtggcatttactgtagtgaattcactacggctctggtcttcagttttgaaggcagagaaacttggttttgtcatcacatgcattccctcagcatttattgactacctactttgtaccagatagccgtgacaggcaatgtggcaacgtggagaaaacaaacaatcattacaatcctgcctgccctcacaaacctggcaatctggcagtgaagacaaatactaaaaaccaaatgtacacaaactaaagtaaaataaccagattatcaatggactaatttacaaagagaagaacttcgagtagaccagaattcttgttcctactgaagtgggagaccagcaggacttgttttcacaacgctgctgatcaaaacaggatgtagcaaagaaaccaatccaaaccagcaaggaccaggaatcataatacatttgcattagacattcctaccagcaccatgacggtttacaaatgcaatggcaatgacttggaagttaaccttacatggtttcaggaactccccaccccttttccaggaagttcatgaataacctgtttaattatatttagcattaagagtgggggcccaggcatggtggcttatgcctgcaatcccagcattttgggaggccaaggcaggaagatcactggaacccagaagctcaagaccagcctgggcaacatgacaaaaccccatctctacaaaaaaaaaagaaaaaagaaaaaaaaaaatctgggtagctgggtgtggtggtatgcacctgtaatctcagctaattgagaggctgaagtgggagaactgctggagcctaggaggtccaggctacaatgagccaagatcatgccactgcactccagcctgggtgatacagcaagaccctgtctcaaagaaaaagaaaaaagaatgggtataaatataactagccagcaatccattagtgctgttctgtgctaccctgcctatgagatagccctgctctgcctttggagtggtcacttggctgtacactgttacgctaacaaacttgctttctttcactgttggttcactcttgaattctttcctgggcagagccaagaactcccccaggctgagccccaattttggggtttgcctacattatgacaagaccaacccatgtctcccatgtaaccgtgcctatctaaggatggacacttacaattcaaataggggagcatactgtaggaatggcattaggcaccacgccttgaaaaacatctgttaggattgtgacttccccattctaaactttccaaccactccctgcccacatcctgcccattctcttattcttgctacttttctcaaaaaggctacggtccatttaatttctgtttcctatattacaatcttattcccatctttcttcaccaaataccttcacctatcaccgtgacggggttttccatgttctgaaagttcttccatctcacagctttaaaaatcatgctctttattccagagatgtcaactgcattcgatctttgtggagtatactagtttaaatattatttctgttattttaaagttagtggttgtgcagtggtagtagttgggcatgggaaagtggcatttagggcaaatgtacactgaaacactagctcctatagcctcaaaatgattatttcaacctgaaaaacaacccaaagaggcacaaaagtatgtgaatcattcagtacattgcacactggaatacacaagatattatacaaaggtcaaaattaaaacaagaacttggcaggttaatagtccaagttcagtagtcatttgctgctggcaattctgcaaactatgagtagcacttgtcgtaatagaaaaagttcatgcatataaaaaatgtcaaccaacatttaggtcatcagcaaataaatatttgagtcaatacaggaaaaaagtctcatgttatttaatgtctcatgttttatttcatacaaaaatagcatccatggtaaacaaagatgtgttttatccacatcatggaaaatgtggccttgtggcacaggtgtgcttaaggtcctgttaataaacatacagagaaaccatttttgtagttctactaatcttcattggatgcaataagacaatctcatatctgaggtgatggggtcctcagtgtttcagttagttaggcagggttttaggtgtgtcagtgatcccaaggcttagttgctattctcacaggtctacaagagggtcaacaatgagtatagctgaaaatgatgtccatgatgcagtcatcctaaccaaaacagacgagacctatgcatcaatctgaatactactttatataatgatcagcaggaccctgtctccttccagtggctaaaattaaggtaattcccagagtttcagaggagccacataatcccatgttacattcacccaaaaatgctatataaattggagcacagagaattataggaactttccattgaatttctgtggggaaagaggaggtgataaaatgttttttttcaatttccatagggaaagatgaaatgataaaaggttttcaaaaaagattttttaatgtgatcaaacgttaacctgaatatagtctatggagaatgtataattccattgggtaattattttaaaaaactctcactctactctcagctccaaaggaaatgtctgtatctgtccttttcatggagccagcacagagcgtagaacatagtaggtgctctttaactaccttctacacacataagtgaatatattcttcttgatcactactatgaatttttcatccaagaaaaacaatgcttatttaaaagcagaaggtatttgagtctacaaatcttgctcttcaccttgaaatatgaattaacctccactactacaaatagaaaattaatagaaaataaggaagttttcatgaagatgactgtcagagaatatcattaattccaatctgttttgttcagtaaatctatataaaaccttgatatactacctataatgtagcaacaattacagaatagactaacaaaaataactatatatggaagcatattcatattctacaaaagcactttctgtctgaaaatatgtaatacagaaaccacaatgcaaaagtttcacaatttaggctgtaagaaaaatgaatgagtttgactggtaattctggtattttcaatattagatagccaaactcttcaatgacatcttttacatcatcatcatttatactgcaccactgggacccatgtttccctaacgctaattctataattttaggaagactcataagctgacatttaatataaaggtgcctcatccccttgtaattcctggtgaattacctggtgaatattcatactgttggttacctctgacataaaataatgtggtttatgttagtcactgagaatctataaagtaagttacagtcaagacagaacttaccaagcacaatgaccacagtcttcagaagactcatcatggtatcccgattccgccggggtccagaactatgccgagacattctcatagtcctctggcgaacatagccaaagatgtgagcatagagaaccaccattaccacaaaggtcaccaagttgaaaatggcccagaagactaagtaagagtcactgtagaggggtgccatgttggaacaattttcaatatcacagatacagttccagcccacactgggtatagcacccataacgatggccatagtccagatgaccacaatgaccaccactacccgccggttgctcatccgtgtgtggagctgcatgcggaaaaccgtaatgtgcctctcgattgcaatagccagtaagttggccacagatgccgtcaggctggtgtcaatgaggccctgacgaaggagccatgtgctaacagtcagtctccgagtattgggtcctgtgttgaacatgagatagaagtaggccaacccagcaaagaagtctgcagcagccagattagccattaggtaataaataggaaaatggaagcggcggttgacatagattgccaccatgaccaataggttggccaacatgatgaagatacaaacagtgattccaagtcccatcaccagcttgctgactgtgttccattctgtggcaagatgctttccacttcggttataaaagaaggcaatggactcgttgtagaagcactgtggttcattcatggctgtgaactaaaagaaaaaggagaaaagatgatgaaaaagaaggcacaggtccaaatttaaagcttatatagataacacaagacttttatagtacatgcaacagaaaaacaaaagcaaataatttgaacatttgatcctgcataccatcttgtgattatgttgaaactccaaggtttctcacaatattactgtccttaagattaaaggcagttggagttaaataaatgacaaggtctctgcttagtggttttatgtcattgaagtctactacaaaagccacatggccaagaaatcttgcttaaaatacatgagacagacaaaaattttgcagaacattgcaattggaatatttaccatagtaaaatctatttgacctgttatttagggaatctgtaaacacagttggtttctagatagggtatcattgccctattattctgcatttctattctcacacagtatgttccatgtgggacagacattttgtaatgcaggttcccacaaggaccatcattccaaacatttcaaacaagtcactgtgcatcaaaggttttttgcccaaagccagcatttgctgctcaacattcctgtggtcagcactgcctacccccacaactccttaagttcagaataggacttgtcaaccaatctatgacatttgagaattttttttctttttggaggacccaacgtaacctccaaagagtaggtgaccctttgacaatgttctacaagtaaaatatacttagattagatgcagcatattttttaaagtgtggagtgaaaatgctttataacatgtttacttattcttcaacatcattgataagaatatatttgcttattatttacaatatttataataatcactttaaaaaggattgagacagtttaaaacagaataatatatgtttatttatctatcataatatataatatataattatatataattataatatgtaattatatataataatatatttaaacaaaattagaaaataagtaacaaactagaaattagaaaagtatacatcacatagagtaagtcattcttcttgaagctctaagtttacctgggacccctaaaattaaaaaatatatcttgaagacggttcacattctactttttcatttttattttgctttgaatctaataaattacccaaaacatatgacacttttaaccactatttttgatcaaatattctactgaatatccataggttgtacactaaaacttccaagaacaacgtgaaatacttaagtggttagtcttctgacttacccaggcatctaaagtctctttccttatctagactttaatagcttttagattatgcttcaaatattatacttaatacattgtataattatttatctctttacttgtctgcttcttaaagagatcacagtccagggcacagtggctcacatctgtaatcccagcactttgggaggccaaagtgggtggatcacttgaggtcagaagttcgagaccagcctggccaacatggtgaaaccccctctctactaaaaatacagaaattagtcagacatggtggtgggcacctgtaatcccagctactcaggaggctgaagcaggagaatcgcttgaacccgggaggtggaggttgcagtgagccaagatcatgccactgcactccagcctgagtaacaaagcaagaccccaactccatctcaaaaaaaaaaaaaaaaaagacaaagttgatcaagctgtttccccactggacatgttttaagggcttatgagtgcacgttagataaaagtctaaacttttcaatcatcttatcagaccttacttacctgcctctccagcctcaactcaagatattaatgactccaaactctcagcttcagctctatttaatgtgctgtgctctctctctcaactctggttctcaacagtgaaaacagtggtttcttgtatcagaattacctgagagtttgtaaaacactgattgctgacataacccgcaagaacttctgattcagtagatctgaggtagggtcccaagtaatgccaaggctgctggtccagggaatcactgtatcataattgcttaattatctgttgatcccctctacactaggctatgaaaccctataaacgcagagattctagcttgcttattcattgttgtatagtatccaactgttctatggactacatgctaaatacatattgatttccttaataaattaaagatatttccaaaaatgtttaaactttacaaattttctttctgcaaaggatatttaaaactttgtcaagacaaatataaaagtctgttcttttcattagtctctataaccatctaccttctctgaatcaagaaatgtttaaaccaaatatcaagcgtatattatttcccagcattccaacttctgaacaccaagtagcaacaaagttaagcagagatatatgcagcttcttagcccttcccacagagaaaaacgataaagttaaggatggcaaaattaagaagtataaattatctctttaagccacaatgtacaaagatgagtaaaactgacagattttctctaaaggtagagaaaagtgccctgtcctatgccatttcttttctctcaacaattgactgtaataccataaaaaccatacatatttaatgataaaacttaaatgattttcgaaactcaattttatcatctgtgaaatgaggaaattggactaacttatacataaggtctagttcagatttaaaatcctatactaagaggattctggataagaacgctatatttcatgaaaattagcagctaaatattgaaagagtagaaaatacaccaggaattaaaaattgggagggtataatatgcctgagaagaagtgagaggaatttcagttagttttatgacaataggactgaactgatagaggaattaaacctcctctcttattgtctgcagaaagcaacaggtcaaaagaataagcagtggagaccctgaaagcacctccaatggcagtaagaagggcagtgtgaatgggctttcctacttcttcaggagccgacagacttaggcagaaaacctacatggttcagagagaatccaatttaactgcaattggactataggccaataagatagtcagggctataatgacagaaaaataattatggaacataatggggaaaaatgtaatcaaaggaggtggccacttatctctcgccaaagaagaaatcacctcccactgaagcagatgtatgggaggggaaaaaaagaagagatagaaagagaaaaagattaaatgatgggacatctctgatttgtgtcctcaatgtgttttgttaacatagtaacattgaaaatagaacaagccattatgaagacaaaagaaatcagtaaaaacatcacaaaaatagttttttattgctactttaacaaattgctataaatttagcagcataaatatacaaatttattctcttacagtcctagaggtcagaagtccaaaataggtctcacaggactaaaatcaccgggaaggcaaagctctgtttctttccaggagctctaggggagaatccgtttccttgtcttttccaacttctagaggctgcccacatctcttggctcatggctacctgtcatcttcaaaagctagtaatgactagtcaggtctttctcacatgactgacactcaatcttctttctcactctaccacatttgatgacccctgtgattacactgagcccacccaaaaatctaggagaaactccccatctcaacatctttaactgaaacacatctgaaaagtccctttctctatgcaaggtagtagccacaggctctgaggattaagtaatggatatctttggaagccattattgtgcctatcagaacaaactgaaaaacaatttctgtattaaaaatggcaatgcaggtaatgaaaggaagtataaaaattccagaaaactgaaatggcaggtagaagactaaggaaattcacccaacactcagaaaagagtcagagatgacaagaacaaaagaaaagaaggcacatataggaaaaaaattcaagatgcaccaggggtccaagaaagattagaaggaacctgaaaaacacagctccaaacagaagacaagtaattgcctaaaaagaaaggtctcagattagtgatttaaatttatgtagattacaaaacaaagttaattaaaagcaactaaaatgtaggtgtatcttgatgagattttgggatctcaatggtaaagaaaaattgtaagagtttagagaaaaaaaataacaagtcaaatatctaaagacagagagaatcagaacagacccattatacagagaaattttttgagatacatagccaattacattgatgttttcatacgaggacaataaagaacagtcacagaaatgtgagtattcagaaagaatgccatctacatttcatctacacttccttcgtagagaaagtgtatatagtatttaactcttgagaaaagaaaaaaataaatacacacacacacacacaataaatacaagaccctggcagcaagcattaaaacccacagaacatgattctaaataattgttcttcatagggttataaaacttaaagcaaatatcaaaaataattattgaaagaagctatacctattaataaaatagcaatttaataataatctgggattaaaattacttactgtatagataaaaacttgaaatggggaagcagaatgtaaacatattaattttctcttattactcaagtaaaaatgagatgatttaaatgtgacaagttttcaaaaataaagttaaatatgctgattcaaaaaccactgaactgaataatacactaaagcagaatggcaactttttgtattactggagaaaaacagagtgcaaaataggaggaaagcataagcaatacatagaatgacaattttgtaaaatttatgtaggtgagattatagatgattttttcatctttagaaagtagctcatatttattgcaagaaattttgggaagaacaaaaatacactcatacaaagtccaataagtacttttccaaaaagctcattataaaatccaaatcaccataattagaaacttctctgtaatacgaagttatagaatttcaccctgcccaagaaacaaaaacataaataagatagcattattcccaaattcagttgtcctcaaaactgaaaagagaagttcatattcatgcccttttctcacccatcaattattttgtcttaggatgatagggttcgagggaagtgatctcactggctgctctatagagtagatgttacaaatctcagaaatttacctcaccttattgtgtgatctcaaaataagttataacaaatctgtcaagcctaaacgctaaagagtcacatatgttgtttaccttcaccatgcaattcattcatccatgcacacattcttgaacgtttataggataccaggttgggcatggcactgcattatgccttctaggagtacgactgatgcacccaagtgcctggcatggagccactcacagtacatctgatgtgttcttccatctcttgaaagacaattacatactcattggccaagaggaagaaggaacagttggcataaactcacatgctagtaattacaccaatgtgatttagtatttagatatgaatgtaaatatgtactctactgagatactctaagggagactgtaatctatgctgataaagaactagtaataagatataaatcaaatcaaaccaacttacttcctccacttctgttaaaatacaatagagtgagccggggcgggggcctgatttgtagctttggtttagcagatctctttctgattctcattttcaactagctaatttgtttttcaataagttccaaaactgttctgaatctcaattgtctcatttgtaaattaaggtaaggatgacctctaagactttttaaattcttattcttaaattcaaaataatcaggcctattttctttctccaaaaaagattagaaaagagacagcatagaatttaattaaattccattaagtctctattaacaagaaaaaagtcctcacccttcttagagcttcaaattggacattttaaaaagtgagatgttttgtcacaataactagaaaatgggccacaaaacaatactgatatccactaaaaatgattttaaactagaatacttaaaatcgctgaagaatatgcaactagtaaattttaggaggtttatctgaaaaagtacataaaatgctacttcttataaaataataatgtatatcaatgtgatatacacatatgcaaaaagaaactgtgcaacacataaattgtaagttaataaaagtactttttatctattatagcccattgtctaccatgctgagaaaaggtacacatcatcatacttgtcaaatttccaaagagaattctgtgtcagtcctaagaggaaggaatggaaaaattcactaaaaacactaagatgtgctggataaagtataataaatagtccttagatgcactgctaagctaagagggaacttaaaccaaggtgaaaggctgtccaggcagcagattgtcagagatcatgaggacagggctttaatactattgggaaacagaagatgagcccttgggcttgactgaggcagtgagttggaattgagacccacccaccaagctagcagtctctaagatcttcgtattggtaagtgtgtagatcaagaaaaaaaaaaaaaaagatatccctacttgcactgggaagaacaaggaagttttgtcaagctcaggctccagattggaaaataaataaagagtcccttaagaaatcatgactctagtcccataaatcacacaaggctgggatttgaacttagactacctgtcaagtctgagaaccctcaggagaagaaattaacacaaaccaaggtcctgagttggtgatatccccatgctcctcccactcaccgcctaacactagcaaacaccaaacttctctggaggacgagacctcaacacagccagccacacgggattctctcaaaccagcctcactgaatataaactcatcttccaaaaggaaaaaaacacaggaggatgccacatgtgagaatccccagaacagttcacagcaggattagacccaagaatgtcagataataaatgattaaagacaaaacggaactgactgcattctcccttttccacttctattggttcaagagttatacattgtttctattctttaatgcttagtcttaatattttaacatgcacacttgactagaagtctgaaggtaatcctcttcccttgatatgttttctctccagtgcctccactcccatcttacatgttactgtggctcaacattctacttccatttgttctgaagcctacctaaaattacttgctattacttattttcccagtttatttggttaccccataagaagccagtagaatcatcttacaagaacaaacaaggagagtaagaacaacatgaattatgagttaatctaatttaagaccataaatgagagtttctaaataaaatgcaagtaaatcaaatatgtatcttcaagatacacacaaacacacagaagatggggtgtgtgtatatatgactaaatgggttgtatgtatatcaatttcttacgactaaatagggtttcctccagaatgcaaagatgatttaacatttaaaaaatgtggttacataattaaccactctaacaaattgaaagagagaaaaaaagccaatgatcatctcaaaagacatggaaaatgtgcttggcaatttttaatacactttcatgatattctgacaatctataattagaagataattaatttccctaacttattgaaaagtagctatcaaacatgtacactaattgtcatatttaagcattcactttcaaaacattcatatcatatttaaatatgacatgaatgtcatatttaagcattcactttcaaacagaaacaaggacaggcgtggtggttgatgcctgtaatcccagcactgtgaagggctgaggcaggtggctcacttgaggccaggaatttgagaccagtctggacagcatggcaaaatcccatctctactataataaaaatacgaaatttagctgggcatagtggtacatgcctgtaatcccagctatttgggaggctgaggcatgagaattgcttgaacctgggaggcggaggttgcagtgagcggagatagcatcactgcattccagcctgggtgacacagtaagactctgtctaaaaaaaaaaaaaaaaaaaactggaaatttttaaaaaaccttatttttaaccacacataatataatcagttacacagaaaatgcaagacacctataaacaaactgtattaagagagtttaacaaattttctgaattaatcatcaagccatatgaatcaactgctcctataaaaataccagaaaaaaaaattctagttattatttcaagaaagaacacatttacagtaacaagagctctaacgtatctaggaataagtctgactttacaaaagcatacaagcaaacctaaataaatgaagaaataaaatatttttgtgaatagagatgtaaagatgtcaattttcccagtatcaatatataaatttaacatgataaaattaaaatcccaaaagggtttctcatggaacttgacagactccctgaacattgatatgaaagcacaaaagaacaacaatacccaagacaactagaaaactaataactagatgcgttattgaatactacattttaaagtgatggtagttaggacattgtgatattggcatagaaatacatggatagcccaatggaacagaataaagagcctgaaacacacatattataacttgatatgagagatatgattttacccatcaattgagaaaatgacgtatctgttcattcatgtaataatacttaaaaactgaatatttattttaaacacagaaatccgtttcaggcaatatgaaaatacacatataataaaatataattttaagaagaaaatgaaaaaatatatttataagctctgaagaggggaatatttctaaatatgaccaaaaagcatcgataaaacttgactaatcaaaattttaagacttctgtgctgcaaaatctaatgagtgaaaagaaaaactaaattagtagaaactttagaaacacacataagaaagactttctctacagtgaaatgtaaagacttcttacaagtcaaaaagggaaaagacaaacaatccaacagaaaaaggggcaccgatgtggataggcaattcacagaagagaaaaccttaagagccaataatcacaagaaaagaaaattacatttacagggaatcagagaattaattacaaactgcagtgagatccaatttatttccatcaggttggcaaaaattaccaagttggaaaatgtcaagagtcagtgaggtcagtcctacagtgctagtgaaagtaaaatttagtacaatagctttgaaaaacagtttggcaaaaactactaactatgaacatgttcatacactagatcaaaagattctaaccctagtttaaaaaaaaaatcacacatgtgcctaacgagagacacatgaattccaattgccactcttttaaaatatcaaaagcaacacaaatatttatcaactggtgaaggaataaatcacaatattaccagaaagatataaagcagttaaaataaacaaagtatagctttaaatatgctaatgactaaagcaatttgcacaaggatgcatgcagtacattattcttgtgaatattaaaaacttgcagaagccaagacggctgactagaggcatctggtactcacctcctccacaaagaacagaaatagcaagtagatagtcacactttaaacagaccacctaaaaaagagtactagaattcaacagagaagtgacaggaaacacctaaggcaaggaagaagagggaagcaaggcagcctgctgttctgggactggcgagaagcctggaacagctcttcgatgtagggaaaggggaagtgacctccagtggtccacaatcccaccagactccaatcctagccacaggagagcccctcaacccaaaagggccctgaaactgatgtagggagctgcctggagaccatgcaacagcgttactccagagacagagctcatgccaattcccaccttccccctcaccctctagtcctaagcagctacagcaaagcaccactttgagaacccagcccccaccaaactgcatctacccaaggggcccaagaccctcctctctccacatatctgaagctacactgacaccctctgcttacatctaccaccacagctgactgccattggcagcaactctgctgcccacgatagcagggctacaacacacttaaaagtgccctgaggaaaggctactctgcttatagctgctacctggggctgaagcatgtgctctccaaccacctgtctgtggttgctgccactgaaagcaaccccgccctccccagcagtaggaccacagcacagccattgccacccccaccaagcattccactgcagaactgaggatcaccccgcccctgcctaccacagctagcaccagcacttgggagcctgaggacacgtccacctggcccagctccactgtctacctccagtgctcaagcatgccatccaggggccttgggatcaccctgccccaaccaccaccactggcacctgagcacacttcctggggatctcaggatgggctcacccaaactgccactatcacctcagttggcacacagacgtatgtgccaactgcaggcctggcgactggccctcccagcctgttgcagccactgtcaacacagtatggaccacctggatcccacagggttgccccatcactaatactgctatctcccacaccacacctgacactcagagggacctaaggacctacccacatgcctggcccactcaggcaagcctggaggctcaagaatcagcctgcctggacctcttacactggtaccagcatacaccaagaacaggcatgctcagcctgcaactgccactactgaggctcaggactgacccatctgacatccccggccccagcaaacctttgccacagcctccacaaccaaccacacccaaagccacttaaagaattacagacacatagtccgggcgtagtggctcatgcctgtaatcccagcactttgggaggccgaggtggacagatcacctgaggtcggaagttcaagaccagcctgatcaacatggagaaaccccaactctactaaaaatacaaaattagccgggcatggtggcacatgcctgtaatcccaactacttgggaggctgaggcagaagaatggcttgaacccaggaggcagaggttgtggtgagccaagatcgtgccatgtcactccagcctgggcaacaagagtgaaacttggtctcaaaaaaaaaaaaaaaaattacagacactactgatgcatttacagccaaagaaattatatggagactacactacttcacatactcagaatcaaagccaaagtgacctacacaaccaacaccatagatacatcttcaggaaaacatcctcccctatgaaagtaaattcccaaaactggaataagaaaattttatatcagatgtgcaaattatcaacatgcgaacaaaagaaacacaaaaaagcaaggaactatgacaccttcaaaagagcacaataattcttcagcaatagacttgaatgaaaaagaaacttatgaaatccaggacaaagaattcaaaataataatattttaaaaaatagtgaattataagagaattcagattaaacaataaaaagaaatcagaaaagcaattcaggatataaatgagaaatttagcagagacagatatcattaaaaagaaccaaacagaaatcttggtactaaagaattcactgaaagaaatacaaaatacattcaaaaagcttcaacaacagacaacagacaagatcaaggagaacaatttcagaatttgaagacaggtcttttgacataacccaggcagaccaaaagagaaacaaaaggataaaaaaagaatgaacaaagcctatgtgacatattggacacaatatactgatcaaatatttgaattttacatgttccagaaggcaaagagaaaaatgaaagggaaagaagacctatttaacaaaataacagctgaaaatttcccaagtctagcaagagaattagacatccagatataggaggctcagggatccccaaacagatacaacccaaaaaggtcttctccagcacataataatcaaactatcaaaagtcaaggacaaacagagaattataaaaacctcaagaaaaacaaaaagcatcaagtcacttataagggaaccctcatcagactaacagatttgtcaggagaaattgtacaggccaggagagaatgggatgggatgacacattcattcgaagtgctgaaggaggaaaaaaacaaacaaacaaacaaacaaaaaaaactgccagtaaagatactatacccagcaaagttatccttcataaatgtagaataaataatgtatttcccaaacaagcaaaagctgagggaattaccactagaccatacctacaagaaatgcttcagggagtcctacacttggaagtgacaggataatttctaccatcatgaaaacatacaaaagtgtaaaacccactggtagagcaaacacacaaatgaggaagagaaagaattcatatgttaccactaaagaaaaccacaaaaccacaatgataaacagtaagaaagaaaggaaaaaggatacatgaaacaaccaaaaatcaattaacaaaatgacaggaataatccctcacatatcaataacaaccaagaatgtaaacagattaaactttccacttaaaagatacagcctggctgaatggatttaaaaacgtgatccaactatactgttacccacaagaaactcatctcatctgtgaagaaacatgtagactgaaagtaaaaagacagaaaaagatattccatgcaaatgaaaaccaagaatgaacacaagtacctatacacatgtcagataaaatggactttaaattaaaacagtaaaaagagataaagagggtcattacataacgataaaggaatcaatccaggaagatgtaacaattctaaacatatacaccaaacacagaaacaactagatgtataatattattagacctaaaggaagagacagattccaatacaataatggttggtgacctcaacaccccactctcagcattgggaaaaaaattaacaaataaacattggatttaaactacactttacacaaaaatggacctaatagacatttagagaacatttcatccaactgctatagaatatacattctttgtatcagcacatggaacagttcccagaatagaccacataaaaaagtctcaacaaatttaaataaaaatcataccaattatctcctcagaccacaatagaaaaaaaaaaacacaaatcaattacaagagtaactttggaaactatacaaatacatggaattaaaaaaaatactactgaatgaccattgggtcaaggaagaaattaaaaagaaaatcaaaaaatttcttgaaacaaatgaaaattgaaacacaacataccaaaaccaatgggatacaaccaaagcagtgcaaagaaggaaatttatagcaataaattcctacatcaaaaaactagaaagatttccaataaacaacccaaaaatgtatctcaaaaaactagaaaagaacaaaatcaagccccaaataaatagaagaaaaaaaataataaagattagggcataaaaaaaggatgagttcgtgtcctttgcagggacatggatgaagctggaaaccatcattatcagcaaactatcacaagaacagaaaacgaaacactgcatgttctcactcataagtgggagttgaacaaggcgaacacatggacaccgggaggggaacaccacacatgggggcctgtcggggggttggggggctaggggagggatagcattaggagaaatacttaatgtaggtgacgggttgatgggtgcagcaaaccaccatagcatgtgtatacctatgtaacaaaactgcacattctgcacatgtaccccagaacttaaagtataataataataataaaaatactatgtgtagtagggaataaaagttaatatttaaaaaataaagaaagaaagattagggcaaaactaaataaaatagactttaaaagacaatacaaaggatcaaccaaagaagttagtgttttgaaaagataaacaaaattgaactactaactagactaaccaagaaaaaagacaacccaaatataattagaaatgaaaaaaaaagcagtataactgataccatagaaatacaaaagatcatcagactattataaacaactatacgctagcaaactggaaaacctagaggaaatggatacattcctagaaacatacaacctaccaagattgaatcaaaaagtggaaaacctaaacagaccaacaatgaataatgagactgaatcagtaataaaaagtctcccaacaaaataaattccaggactaaatgacttcactgccaaattctaccaaacttacaaagaattaacacaattctcctcaaaggattccaaaatatcaaagggaggtgatttttcctaatccattctacaaggccagcattactctgatatcgaaaccagaaaaggatgcaacacaaaaagaaaactgcagggctatatcccagatgaacatagatggaaaaaatcctcaacaaaatatcagcaaactgaatctaataacacatcaaaaagataatataccacgttgggctcagtggctcatgcccgtaatcccagaattttgggaggtcaaggtgggaggatcacttgagcccaggagttcaagaccagcctgggcaacaaagtgagatgccatctctacaaaaaaaaaaggcatagtagtgcgcacctatagtcccagctacatgggaggctgaggcaagaggaacccttgagcccaggagctatgattatgccattgcactccaacctaggtgatagagtgatactctgtctcaaaaaaaaaaaaataataataataataataatgcaccatgcaccatgcaccatgatcaagtaggatttatcccatggatgcaatgatggttcaacatatgcaaatcaataaacacaatacatcatattaacagaacgaagaataaataccatatgaccatctcaatagatgcaaaaaaaattgataaaattcaacattctttcatgacaaaaactctcagcaaactaggcataaaaggaacataccttaacctaataaagcctatatatgacaaatccacagctaacatcatattgaatagggaaaagctgaaagcctttcttctaagaactggaacaacacagcatgcccactttcaccactcctagtcaacataatactagaagttccagccaaagcaatcaggcaagagaaagaaataaaggcatccaaattggaaaagaggaaggcaaattgcccccctttgcagatgacatgatcttatatctagaaaaatctaaagactccaccaaaaatctcctacgttggataaattcagtaaagttgcaggatacaaaatcaacatacaaaaatcaatagtgtttttacacaccaataatgaactatccaaaaaagaaataaagaaggcaatcccctttccaaagctacaaaaataaaataaaatacctaggaccaaatttatgcaaggagggaaaagacctcttcaaggaaaactacaaaacactgatgaaagaaactgaagaggacacaaatggaaagacatcctatgcttatagatcgaacgaattaacgttgttaaaatgatcacactacccaaagcaatctacagattcaatgcaatctctatcaaaataccaatgtcatttttcacagaaatagaaaaaacaatcccaaaattcatacagaaccaaaaacaagcctaaatagctaaagcaatcctgagcaaaaagaacaaagctggaaacatcacactatctgacttcaaaatatatcacaaagctatggtaaccaaaacagcatggtattggtataaaaacagacacatagaccaatggaacagaatagaaaacacagaaataaatccctgtatttacagccaacctactttttgacaaaagcatcaagaacctacactgaggaaagaaaccctcttcaataagtggtgctgggaaaactggatatccttatgcagaagaatagaactggacccctatgtctcaccacatataaaaatcaactcaagataaagactttattaagactgcaaactataaaattactaaaaacattgggaaacacttcggggcactgatctaggcaaatattttatggctaagacctcaaaagcacaaataaaaacaaaaacaggcaaaagggactattttaaactaaatgttttaaaacaatcaatagaatgagaggcaactggttgaatgggataaaatattttctaactattcatctgacaaggtataatatccagagtatacaaggaaggaactcaaacaagtcaagagttaaaaaaaaaaaaaagcaaataatctcattaaaaagtgggcaaaggatatgaatacactttctcataagaagacatacaaatgcccagtaggtatatgaaaaaaaacgcttaactttcctaatcatcagggaaatgcaaatcaaaaccacaataagatatcatcttaccccagccagaatggctattattaaaaagacaaaaaaaaaaaatgctggcaaggatgcagagaaaagggaactcttatacagtgttggtgggaatgtaaattagtacagtgactattaaaaaaaaacagtatgaagatgtctctacaaaaaaaaaaaaaaaccactaaaaccagacattccatatgatctaggtatccctctactggctatttatcagaaaagagaaaaaagaaagaaagacagagaaggtaaggatggaaggaagggaggaagggaggaaaggaggaaaggaggaaaggaagaaaggaagaagggaggaagggagggagggcatcatttcagcactttagggggctgaggcaggcaaattgcttgagcttaggagttcaagaccagcctgggcaacacggtgaaaccccgtctctaccaaaaataaaaaaaaattagccaggcatggtggtacacacctgtggtcctagctacttgggaggctgaggtgggaggatcacttgagcctgggtggtggaggttgcagtgagctgagatcacaacactgcactccagcctgggtgacagagtgagaacctgtctcaaaaaacaaacaaaaaaataaacaaaaaaaagtagaagaggaaaaagatatcagtatatcaaaaggatacctgcattcatgtgttaccacagcactatttaaaatagcagagacacagattcaacctaaatgcctaccaattaatgaatggataaagaaaatgtggtatatatacacaatgggatactatctggtcataaaaaagaatgaaatcatgtcagttgcagcaacacgaatggagtggggggcagtccttatattaagcgaaataagccagacacagaatgacaaatatcccaggcatgggatctatgaacataggattaaaaaaaattgatctcatgtatagtgaatagaatggtggttaccagaggctgggaagggtaatggggaggtgaggataaagaggggttagttaatgggtacaaacatacagttagatagaaggagtaagttctaacattcgatagcagagtagggtggctatagttaacgaaaatgtatggtatatttccaaacagcaagaagagagaacttaaaacattcccaacacattgatatggataggaacacatggatgtgttcccaacatatctcaacagaaataataagtacatgaggtgatgaatagcctgaatagcctgacttgatcatgacacattctatgtgtgtaataaaatatcacatgtaccctgtaaacatgtacaaatattatgtatcaataaataaacctgcagaagcctactatatattttttatgtttttctcacatatgtatacattcacaagcacatgcagagagacgataagtatcaattaatggtctgggcaaagaggaggctaatggaattaggaaggagtaaaagggctccaactttatctgtaattactgacttgttttatgtattaagtcccaaaagatcttgaagaaattacatcgaaatgttaacattttacaaagctgggtaatggctatgttattgcattataactccctgtaagcatttcattttgcttaattttttttaaaaaaggaaagaaagaaattgaattcagtctgagccattaagagagagaggaagaaatgggagggaatgttaatttactcatccacaaaacaaagagaaaaagatcaccttttatatgttgaacactgagaactctatttctgtgacatctattctcctgcaacttttaatcaggtaacccagaagacttgaaacttcataaaccaaatgccagctctaaaatgcagccttacttgaactgacaggtcaaaacaatgtaataattcatactgacaaaaatgaaaaattattttccattaggccattttgctgaaaggctaataacaatatatttccttataaacttgttccatttcaatttttaaaatggaattttgtatctattttagtttttattatcttctactaccttccattattgtcctttttttattacaaaacagcttatctctataaactatgtttttactgtgatgagctaagagacagcaataaacttatacaatttttaaaaagcagcacttaatattttagatactgagagcaattcatttataaccattttaaggggaaaaaaaaaaaaagccaaatgtggtcctaagactcctatgagtaaatgtattagtccattttcatactgctatgaagaaatacccaacactgggtaacttattaaaaaaaaaagaggtttagggccaggcacggtggctcacacctgtaatcccagcactttgggaggccgagacgggtggatcacctgaggtcaggagttcaagaccagcctggccaacatggtgaaatcccatcctactaaaaatataaaaattagccaggtgtagtggcacacacttgtagtcccagctacttgggaggctgagacaggagaatcgcttgaaaccgggaggcagaggttgcagtgaactgtgatcatgccactgcacttcagcctgggtgacagagcgagactatctcaaaaaaaaaaaaaaaaaaaaaaagaaagaaagaaaaagaggtttaatggactcacagttccacatgtctggggaggcatcacaatcatggcagaaggtgaaggaggagcaaaggcacatcgtacatggccgcaggcaagagagtgtgtacaggggaactgccctttataaaaccatcagatctcatgagacttatttactatcatgagaacagcatgggaaaaacccacccccgtgattcaattacctcccaccaggtccctcccacaacatgaggattatgggagctacgattcaggataagatttgggtgggaacacagtcaaaccatatcatgtatatttgtgatacatcatttgaaagagtaaataccatggtgtaactgatgactataatcctcacaatcatttgccaccttgtttctcctgccttttcttcctccactgccatagcattgaattcccccctgtaacttcagtgttgccctagttttccagctagttttgaatgagacagtggaatgatctatggttaagtctctccatcttgacctatcttacataagtgggatctacatctgaccatgacagctcattcctaagttcccatcagtcatctctacacaatccagcatgtcagaggtgagccctgcactatgacctgtgccattgagctgggatgcttcctgggtcttctcctccactgtctttaccaggttactgcagtaacctgatcaaccacaattaaggtaatactaaacagagttctaagtaggcaaagccctgagagctggggcctacacctgctccactccaaaaccttcctatgcttggtggtggaaactcatctaagtgcaaatgtttgatatcacctgctggacattctgactttgaaatcagccaactagttgaccaacacacacaccctactcttcttccttcaagattggaattcctgctactaaaggttgtctgaatcattgaaagttgctttatttctaatctatgctttcagaaactaatatgctccatggccctctaataaacatattctctgatgctgagaagaaagtatcaacccacttttgcttttctcctggcctgagcctgcctaacacaatcatgtatgaaatgggataagtttaacttaagggcagctcttaagtgatgttatgcaattaccaaatggcagtattaatattttcacacagcagggaaaggttgattttttttaaatgacagtcttattaaggcaaggtacagatcttaaaagacagaaatcccctggactctatgattttctcaggtggaaaaaaacagcaggccactgtcccaccttagtgtgtattcacagcaaagctgcaacaaaagttcaaagaaagacagctggagaatctaggggtatgaaaacgagattgggcaaacagttccctaatgggcaagaagtgggaaaaagccagacccactttgaaagataaaggagtagctccattaaccattgaagactaaaccaattaaaaaggatgtattagaaagaaaaataaacaaacatgaaaggtgtcttatgtggtttaccctaggtacccctgtacaatttcatcttatgaatagaaaattcaaaatgggctttcagattccaaaataatatctcttctcaaaccttatctgagtttataaacacaaaaggaggcacaagatgaatttaaattgcaatatgggaacaaatttaacttctaatagaaacatggttcaagatgaagtcagaagtctcaatgtttatctccacatgcatttattcctggcaatacgttggagttttccatagagtgtttatccaacgtggccttcctttgatgggtcttctggcataccacatacacagaccatatgtagtggttacctctttctccctgtaaagaacttccagaatttacctaatgttaaatgacgagttaatgggtgcagaacaccaacatggcacatgtatacatatgtaacaaacctgcacattgtgcacatgtaccctaaaacttaaagtgtaataataataaaatttaaaaaaaaaagaacttccagactaatcatggggaaaagggaaagaactaacatacgtcaggtatctatcaaaaggctgatactatacaaagcacttaacagttatttttgccatttaaacttgttaccacactgtatgttatttgaattctagagattttaaaaaataaagctgaaaaagacctatgtactgaagatcccccagctatggtgtataacagtctagatttgaaccaaaatccacccgggtctacgcccatgcattaccttttctcaattctatgttagacgaaattatcgtgtggcactggaaacatacttcatactgcaattaattgttcacattttagtttgaaagaaagcactgtcaagataatctgtaatcccttatttcagagactcataatttaataattgcaaacattgtatgaattcccttactctgaagccttctgtgtgtctcatttttgtattcttcagttgtgaaatattctagttataatttcaatctgttttctcacttagaaaataaagagaggaagtggaattgcctttttaaaccttaagagtcattgaatcattttatgcagaagagtaaactgatctaatcaatgtttttaaaaaataaaaataaataacccaccaactacaagaacacattttagaaaagcaactgaagaaacctgaatgtgaattgagtatcaagtgatattaaggagttatttatacttttgctaagtgtgatgatggcagtgtggttatttaagcaaattattttttagatatgcatattaacataaggggattttttaaaagatgacaatgctagggatcctaaaatacttcatcccccaaaaaaggagcaagtgaagcaactgtgtcaaaatgttattactgaatctaggtgttggctatattgagattgttatttttatttttgtgaatgtctgaaaactgccatagtacaaagttctatccaaaaagacgaatctttcagcctcaaaaaaaaaacccatttaatgtgaaattcagttgctttgataaaaaaaaaatccactttctaataacagaaataaaacctaaaacacagattttgaaaatacatattttgttgagagtacctattggtaaggatgtccaaaaaaaagtgtcttccaaaagacaacaaacagacaccaatcacttttttttttttttttttttttttttttgagacagagtctcactgtttcacctaggctggagtgcagtagtgcgatctcggctcactgcaacctgccacatttgcctcctgggttcaagcaattctcctgtctcagcctcctgagtagctgagattacaggtgcacgccaccacacccagctgatttttgtattttcagtagagacggggtttcaccatattggccaggctggtctcaaacttctgacaggtgatccaccagtctcaacctcccaaagtgctgggattataggtgtgagccacagcacccagccgcaatcactttttatcagaacactgaatgagaattggaggaacaatctcttaactaagatattgaaaatctacccaaattcacatcttcaatgaaagctacaggaaatcacttggagggatcaaaatatctttatgttcttgacttaaaaccaaaatggttgtgaacaggcaacctacagaatgggagaaaaattttgcaatctatccatctgacaaaggtctaatatccagaatctacaaggaacttaaacaaatttaagagaaaaaacaaccccatcaaaatgtgggtgaaggatatgaacggatacttctcaaaagaagacatttatgtgtccaacaaacatatgaaaaaaagctcattattcctggtcattagagaaatgcaaatcaaaaccacaatgagataccatctcacaccagttagaatgatgattattaaaaagtcaggaaacaacagatgctgaagaggatgtggagaaatgggaacacctttacactgttggtgggaatgtgaactagttcaacctttgtggaagacagtgtggtgattcctcaaggatgtagaaccagaaataccatctgacccagcaatcccattactgggtatatacccgaaggattataaatcatttctactatgaagacacatgcacacgcatgtttattgtagcactatatttacaatagcaaagacttggaaccaacccagatgcccatcaatgacagactggataaagaagatatggcacatatacaccatggaatactatgcagccataaaaaagaataagttcacatcttttgtagagacatggatgaagctgaaaaccatcattctcagcaaactaacacaggaacagaaaaccaagtaccacatattctcactcataagtgggagatgaacaatgagaacacatggacacagggaggggaacatcacacaccagggcctgtctgggagtgggggaaaaggggagggagagcattagaacaaatacctattgtatgcgggcttaaaacctagatgatgggccgggcatgctggctcacacctgtaatctcagcactttggcaggccaaggtgggcggatcactaagtcaggagttcaagaccagcctggccaacatagtgaaaccccatctctactaaaaatataaaaattagccaggcatggtggcacacgcctgtagtcccagctactcaggaggctgaggcaggagaatcgcttgaactcaggaggcagaggttgtggcgagccaagatcacgacattgcactccagcctgggcaacagagtgagactccatctcaagaaaaaaaaaaaaaaaaccaacctagatgatgggttgataggtacagcaaactaccatggcacatgtatacctatgtaacaaacctgcatgttctgcacatgtatcccagaacttaaagtaaaatattttagaataaaataatttaaattcaaataaatataaaaatgaaaattaaaaaataacaaaatggtcatgtaacaaatgagagacagaatgatacaccatgaaaaatactgataaagaagactcttgccttactggaatcacaggtgtgagacctgaatatcttttaggttttcagatacctattctggcctctaatataatcctaggtttaagagaagccaaactgctcactctggtactgaactattgactctttcatgaacaatgaaaatgaaacttttaatccaacttctatccacagtaacctgatcaagcacagggtaatgcttaacacagtgctagaaacagaaaatggctctggagagctgcaagtttgtttggtttcctaccccatccccatgcccccaatatccacaggatacgaacacattaactcaacctaatgatgaacaggttcctgtctgcaaatacatcccaggagtttcctttggataagaaaactctttttcagtgtctggaccagcagaattataaatcggttacaaacacggcatcttcttgctgctgctagtccagtttcgtcttagtattcatcacctagctttgtaagagctaggtgctctctcagcatgagaaaacaaaaatctgtctcagagtcaaggcaggggtaaagcagagaatacaaacttgccccacttcaaaaaacaaggcatatctttcaactaactaaacagcaatcccagcaggcgtgacaatgcaagctttcttccctattattgtttgaaacaatcacaagctatttgttcatattaattcgtttatatgtagtattaggcagccttgattagaaaaatgctctttgttacccaatgaatagagtaacaaacaaaaccaaaagtttttctaaaaaattgttgttttggccttagaaaaggattttcaggcctttcacacttgaatgtggatttatctttacaaggtccctgaattcactggaaaagaaagcaagttgatgtgccagacaataccaggctaaggtgactgagtgagctgcttattatgcttgcctaagaagatgctatatctaaattatttttaccttctttgaacttgggcaaaactgataataagagagaagacatcagtagaagcttcggggcaagggcaagtcagccttggactaaatttcactgtacaaattacatgtgaggaattgacatataattaggaggcccatcattggccaaaggatcctgggaaccaagtgacccaatggtctgcatctctccagaagaagctatctatctctatgacctaatgtcccagtgtatagctgactccttccccgtgggcttagttccccaaccatcagaggctgccactattcccaaaatacggtgagaataatgcaactaccctggttaaggttaattaataaacttgctcaataaaactattatcgaaagtcagaacttgaacccaggtctatttcaaaggctgggaccattaagctaacaaagacttcttttaagatcaatgttaaattcattaatacggtttgaaagaccctgtaaaatctccaactttataacctaacccatttatgctaattctagcacttgccgatttctgcagtataactattccatgtggctgatttcaagctgctggcatgaagtcaattggctcgcgaaattcctgaaaatttaacaatctgcttctgtgagttggtataggtggctctagggacatcactgtttacaatctcatgccccactgtagtgcaaccatccaaaacaaaattctaaatgctttgctccctctctctctctctctctcacacacacacataccttgggacacttgacattcacctatgctttttcttctcctttaccaaaataactcatattaatttgtcctcagcctagtggtcttccttcaagaagccttccctgatcctctaaatcttttcttgggtctccactttcctcccagagcacccatacttcctgtatttgtgcattcctgcatgggtgacaaagcgttgtaactttttgttttatctgtgtatctcccactatatctgtaaactctggcagggcaaaacttatttctcttatttattcttgtatcccccagccctgccacaaggcttgctgagcaataataacaatgcttgctaatatgcactgggcaatatgtgcccagaatatgtgccaggcactattctgagctttatagaaattatttcatttccgccttaaaataaccctatcaggttggcttcattaatgctatgctcattccgtgggtaaggaaatagaggcactaagagggtggataccttcccctcaggctcaggtaattagtaaattgaagcagggtgactggtgagcctatgtgcctccctcaagaaaccagtgtttcttggccatatttttttctcattagtgatccttaaggagaaaaattaattacatttaaattttttctaatgagaaaaaactaaatactaaggaataagattttgttggatagaggtataagctctggagggatttttttcatctcccaaaacccaatttttgtcctcttggggcaatataactatgttaagaatgtatgttctaggactttcattatccatttccattaatgtaccatatacttctccctaaaaatacacagtcttgttttagaattttaatggtatcttcccataagtactattttgcgtcttgctttctttttcctccatacgatatcttggagtaatatatagctgtgtagacatcctcattttaaaactactgaatagtggtcgggcgcagtggctcatggctgtaatcccagaactttgggaggccaagatgggcagatcacctgaggtcaggagtttgagaccagcctggacaacatggtgaaaccccgtctctactaaaaatacagaaattaaccaggcatggaggcacacacctataatcctagctacttgggaggctgaggcaggagaattgctggaacccagaaggtggaggttgcagtgagacaagatcgtgccactacactccagcctgggcaatagaatgagactctgtctcagaaaaaaaaaaaagaaataaataaaatgactgaatagtatttcaatcatgtccacattcctgaattcattaagtctttctactattggatattcacaaaattttgtacttcttggtttgcaaccaatgcttcaatgaatatctttatacattccttatacactccttgggctcatgtgtgagtggttttctaatgtagattccaagacaggagcagggcatgtgcagaagtgtataattttaatagatactgttgaattaccctccagagtgactgtaccaatttactttcccacagagaatttacgagagtacacatttcccccagtgattgtatgaaatagaacctctttctcctttgggcagtgttaaacattttaattaaatgagtcatttagaggtatttctattcctcaccagctgataggagcttgtgtaacagagaagatatatagataagaagatgctgttggaaatgctgaaagatgacagcagcaaaccgggatgtggaaatgccctgtctagaaaacccgcactagcctaactcacttcacgaaaggactaagaagagtcattacatgggaacagctgcagtggactttgaaatggtgacctcaggtaacaggcactaaatctctttgcccattctccaagtctctcagacaccaaaaaagtctattgaagataagggaaaccaaacacccaaagtaaatgaagtgttgaaaggacaatggtccacttaccagaaagaggaatgcgtatgacgatggtaacactaaacattctggaaaataatactaaaggccttagtactttattctttattcatatgatatgaataaagggctttattcatatgataaaatcccaaggttgataacaatgatgacatcccaaatggtgttgaggagaaaacactatactatatgagggaaaaatgccccttgttctcctttttccctctcctccttctctccttctctcacaaacacacaaacccctacttaaaatacatacaaaattgaatagcctgcaaaatcatactgaaaaaaacagtgtggaacaacgttctgtatcaagttcaaatttcaatcagtatggctctttcttgaaagtatgcttttttcttcaaagttgcccgaggccgggcacagtggctcaggcttgtaatcccagcactttgggaggccaaggcaggtggatcatttgaggtcaagagttcaagaccagcctgaccaacatggtgaaaccccatctctactaaaatacaaaaattagctgggcgtggtggcgggcgcctgtaatctcagctactcaggaagctgagacaggagaatcgcttgaacccaggaggtggagattgcagtgaaccaagatcatgccactacactccagcctgggcaacagagcaaggctctctctcaaaaaaataaataaataaaaataaagttggccaaaaaatgattgtcacaaataagaaaggaggtcacactatagaaagaagataaatgaagagtaaatgggaaactacacttgctgagcacctctgtatgcctcatgtatatgaaccatcattttatccatataaccatcatgtgaggaatgattacatgagaggaaactgaagctgagagaagctagcatgactagggctctttatcctgcaatcagaggagcagggatgtgaactgtggccttatgactccaaagtctgtttccacattgtaccctgctgcctggtgaatctgaaagagtccagccaatgcctgattaaatcaggctgtaaaatcatctgaacaaagaccatgtccctgccgtattactgctcttcactggacagaaaaaaataactcatacgattgctgctcagaagtttctggaattgcattttgtttcaaagttcctagaacagatcaaggcaaaagagtaagtataggaggaggacaacaagacagccctcagaaaacttgttataaaattagatccattctgatatatttcattaaaccccaccccaccccccggcccacaaaaaagccaagagaggaaaagcagcagggtttactactgacttactttgatttagagtttgatgcctataatgtcagacatcctaagcactgaaaaccaaggcctcctatgaacagaggccagttcactaaaatcacttgttcattgttccagctgcttcctgaacgaaatggcacctcactcacaaaagcaccattattcgaatacacaccaaatgatagcgagagagatatacatgatccctagagtcaaatacacttcctgaaacccagtttaaatatttgacaaacttacgattacctcagacctctgctagtttgaagcccttacctggggctgtgaaattacagggatggaagtagagatggcagccatgacagctctgtggttgtaggtggtgaacacgccccagaactacgggagacaaattttcttgtttgctgatcagatcgaagtcatgctaggagaagctgtgtacctggaaaacaacaggaaaacccacatttagcataaaaggactagcatatgggtgtgaagtaccattggccaaaggaggtaagaatccctagacatcaagtgtcaaatactagcttaatgcaaacagaaagccggtagggaaaagctaaggtctaaaagccacgacttctgtgctatctgtccaaatactcttaagttgaggaattttcataggtttgaatccaacatcccagctagatgttttgggaagacagtttcaagttgcagagctgaggagggtgagtcgggggaaaagccatcctgccattaaataataaaggaattgaataatccacagtggagagctgacggcttacatagagggcaaagagaatgcagtaaccacccccacttatctgaggagtggattctaagccccccagtggatacttgaaactggatagtgggtcaggtgcagtggctcacgcctataatctcagctctttgggaagccgagggggaaggattacctgaggtcaggagtttgagaccagcctggccaacatggcaaaaccccatctctactaaaaatacaaaaattagccaggcgtggtagaacatgcctgtaatcctagctactcaggaggctgaggcaggagaattgtttgaacctgggaggtagaggttgcagtgatccaagatggcaccactgcactccagcctgggcgacacagagagactccttctcaaaaaaaagaaaaagaaaaagaaaaagaaactgtgaatagtacccaaccctgtatataacagagacagctactgagtgactaatgtacaggtagcacacacagtgtggaatcgcaggacaaagggacaaatcacatggacagtatgagatttcacccacactattcagaacggtgtgcaatttacaacttgtgaattgtttgtttctgaaatttttcatttaatatttttggaccaagtttgactgcaggtaactgaaactgtggaaagtgaagcttcggataaaagtagactaccataataccgtcaagtgattagatagcaccccgtccaaccccacctatttgcagaagaaaaaattgaggcttagagaagaaaagggactagagtcacacatttaatggtagaaccaggactacagcagcaactccggttcccaggcctatatgaaacgtaacgaagttaatgtgttccctgcctatatctcctcaaggaacttagttaccgcttttaagactaaagaaaggcaagatacctgatgctgtaggtgtcagtcctgagaagtcaggtactcagataggtggatggggagcttcataaatcagacgtccacctgtgtgagaaagagaacatttctaaaatccttttgacatcctcaaagagaggatgctaaataagcacaaagtataaccaaatctcttattcacgtgttcattaagaaaactcagaaagatgctaacttccctgtagtaaatcacagccctagttctgtccaaaggctgatgtgactctttccacattgcaatttagtccagaagaaaaaaatttttcattttaagaaaataatttttaaaaattcgtttatttttaagaaacattttcattttctggtgatgttcatactccctaacaatatcttttcttttattcaaaagacgttattggctgggcacagcagctcaggcctgtaatctcaaaactttgggaggccagtgggggcagatcattagaggtcaggaatttgagaccagcctgaccaacatggtgaaaccccatctctacttaaaatataaaaattagctgggcgtggtggcacacacctactcaggaggctgaggcaggagaatcactagaacccaggaggcggaggttgcagtgagccgagatcgtgccactgcactccagcctgggcaacagagcaagactccgtctcaaaaaaaaaaagtaaggctaagccaaccttgcctttaaggagcttttgtctgtaaatatacttcctagtttcaccaacatgcaagatgatacctgaacactttttaaactattgggaaatgatacttttcataatagtaaaagtaatgaaccagatgtcacaagatccaagtcttgcacagcaggaactgtggagttggacatttaatccaagtcctttgtcccccacatcccttggtgctaccctatattagctcagggatactgggcaaatgaggagctcagaagtgctgcttttctaagaaataatctaggtttgacagcaacttctataagcttaaatttttaattgctacatttttgtgcagcatccttgatactacagtttcaatcactttaggttctggctgcttagaactgtagagccttcctattttcttctcccattacagcaattattttcattcacaaataagtagtaaagttctcaagttatcttgtcatgacattcaacaccgaattccacagctgccctgtgacagtactgatattctccttagtcccagttttaggaacaaatgagacttgtttatcacactgtgaaagtaaataaacaacccaggagaaaagcatatgtatacaggacctttcttttttcaagatgactgctagagtgccaaacctacccaagaaaattacaggaaccccaaggtgcactgttttacactgaacttattcctggcactattttttgctcactcctactttcatttttcctttctccttctcatgtatttattattcctggcattattttttgcccactcctactttcatttttcctttctccctcttatgtatttataattcacattatcttgctctatgtgacataaatgaatatatcaataatacaactaaaaagcaaaaaatcaagcacataagattccattcttaaggacgcatactatatgctcaggtccaatatcatttcaccaagctatgtcattaagcaatataaccttaaaatattttcaatattcagaatatagagagttgcctaaaaggtaaatagaggcacctagcttagagtaaggaaagcgaaatagaaatggatgagatccaccaaacaaatatgtcatatgacgttattactaacaacagcagagggaaagatgcgagactgggatttcatgaaaggccactggatgctgagctttggagcagtcatttccccaacagtttgaggcagatactattcagttattttacagaggagacatctgaggctttgaaaggtattgtgaggttatgcaacatacccacagtcacacagtcaggaaatgaaagagctgaggtctgaaccagggcctatgctaagattcatactctttccataggccaatattccatgtgatcaaagattaaaaagagatggaaagcacatggaatctttaagcaaaaatgtcagataaaaaatggagaaagtaggatgaaagtcagatgacctgcagagtaaccctgagacagagaaccttgtgctcttctcatctatataaaattttaaccatttaaccctcatttggatgtttcatttccttgagatgcctaataaacatgacagattgttagtttcacattttcaagaagaaaataagacagaaaattaactgccttctcctaaaacatgcgacacgtctaattttgttgaacctattcacacattacaagaacgctttataaaatagtgtatgcttactttgccaaatacaagggctaaatgacataacttcaaaggtataaatcagttttcccttgggagtgaagtcttaaaattatatcatgaaatctatttacttctcaacttatttacaaaactgcacaaatcatgggggaactaaacaagacaaaaaagacattaccctaagtaatcatgccatacagtatctagctgagtaagctggctcactttgacagatgaacccccgccttaccagagccccagactgtcaactagagagttgcacaataatttttaaagaaatacatccctggctgggtgtggtggttcacgtctgtaatcctagcattttgagacgccgatgtgggtggatcatgaggtcaggagttcaagaccagcctggccaagatggtgaaaccccgtgtctactaaaaatacaaaaaaaaaaaaaaaaaaatttagccaggcgtggcggcaggcgcctgtaatcccagctactcaggaggctgaggcagagagctgcttgaacctgggaggcagaagttgcagtgagccgagattgcaccactgcactccagcctgggcaacagagtgagactaagaaatacacccctctgaactcttccaagtacttggatacctgttctgcaactcttccaacctgccaccaacctaactctccatttcctttgcttgagcttcaaaactgtgttctagccacagaaaaccatgaagcaatgtgggtttgcccagctgacatcaggctctccaactgcccttggagcattactgctgcctcttctcttctttcctagttgtctccattttctattctcctaggcatctcttctcatctatatttctcttctcaaaaccgtaaaattacttctaatgcctctcacctgcaaaagatgagctttgtcatctatttatttattggatcattcatccattcctttacaatcactgggtctaaattacctcaatatcccccctatgattcaaatcacatatataaaatacaatttccaaataagaaagctataagcttatttctttgtgccagattaccaaagaaatgaccagttgattataacagaggaatatcctgaatcagccctggaaactataaatagatcttaaacgttcagaaatatatacttgaaagaatcaacatgggaggttgacaaaaggactaaaacacgatatcctcttcatgtgaaactgcaactgcacaaccagaaaataagcaaatgagaatccactaaacccataatgatacccctagtttagagcgatgggggctgagggaactaagcccaggaagacttggggtacatttaaaacacactaactcctttaaaagggctcctggcttcagaggccagccaagcaagtaacctctggctgcatttacttctggttgacaggtggccatgatgactaccacagaaaacacatgggaaaaagacactcccagctggctcctggcaagggcagccatgccaagtgacaatgaccttgctaattactgagtgccacaccaaatacctaaaacaaagtctttggtttgaggcaaacttccctttgattacttctggagctgatgctggctcttttcccaggcctcacaggaatatgaattcataattggtaaattaatctactacaaatgtaacctttttcctttgtctggacttgagtcaaatagtgactcatacaagtttcttgaaagaacacagggttactaatgcacgcggggcttaaaacctagatgacgagttgataggtgcatcaaaccaccatggcacatgtatacctatgtaagaaactgcatgttctgcacatgtatcccggaacttaaagtaaaattttaaaacagaaggaaagaaggaaggaaggaaggaaggagggagggagggcgggagggagggagggaaggaaggagggaaggaaggaaggaaggaaggaaggaaggaaggaaggaaggaaggaaggaaggaaggaaggaaagaaggaaagaaggaaagaaaacaaggcaatacccaatactgaatatgcattgacttccctaaggataagcaaaggagaaaaatctaaatccaccaggcaaatagaacacattgtggttcagaaaaggggaagattctagaatcagagcaaatatttacttaagaaatagatatactatataaaagagaaaactctattaacagaaaatttctagctcatgttcttaaaattccaggggacatagtagaatctttgcacatagagcaggtagccatagaaagaaatatgagaccagaaaagagtctgcgctaaccagaaaagaaaatctgaattatgaacttgaataaaagcaaccaatgaagcagaaagtagaatatttttaaaaagcaaaaaataaaattagtgatgcaaaagataaaacagacttctcagaggtagctgggggaagctacgtgggtaaagattttaaagccttcgtctccaaaacagaatagatgaatgaaaagcaataaaggaggaaagaagaaaccatcaatgctgaaacctggaaaggacaaatttattctaaaaactttagaaaactattacagatatacaacaatttagataaaatggggaaatttttcaaactatgtatcattcttcagagagccctatagtctgatataaacaaaatagaagaaattcctgaagcccaaacctggaggaacaagatgagatacaggcagttcagagctgaagcttgtcttctttcttattatctcttccgcctatcagagctaaatagcatctgaagccagtcttacatcatctaaggcctgagacggaaagatttttctctctggaatctgagcagatgaataggtttaacaatagtaacatcgagaagaatatattgcacttattcaaacaaaaacaggatgcttaaaaagtggtaattcaaaatctaaaaaagtttttcccacagaagtagagagcaaagtggtggttaccaaaggctggggtggttgtggggagagggagttgggaagatgttgatcaaaggatacatatttacagttagacaggagatctattgcagttaggaggaataaggtcagatccatcgtgtaggacagtgactatagataatgatgatacatggtattcttggaaaatgccaagggagtggatgttaactgttcttaccgcaaacaaatggtggctatgtgaggtaatgcatttgttaattagctagacttaaccattccacaatatatatatactcaaaacatcatattgtgcatgataaatacttataattttatatgtcaatttttaagaattcaaaaaaaattcagtagacagattggaatataactttaaggaatgtgcccaaaatgtagagttaaaaaaaaaaaagtaaagaagactagaacagtaaaaatgagaaggctacaaaatgagtccagcaggtctaatagccaaatagaattccagaataaaagagtaaaggaaatggggtggagtgaagtcaaatgactaactcaaaatatttcctaaaacgtaaggtcataactgtgtagactgtaagggcccactgagtgcctacctgcccatttcatttgatttcaatatgcccacattaaacacagcatctgtcatcatgagttgtgtttttttaactgtaaggatattaaaaaggtcctataaaatatcaaaaagcaggtagggaagctcataagcaaaagattaggaatcagaaagtctctggacttttcaacagcaaccctgaaagctagaagacaatgaagcaatgaggaaggcagttgacaacctagaattctattggcagatgttcttctgcaaaacagggaggaaactaagaaaaagacaggcatgtgatacaggaaacaggagtccaatacaagagggagaaaaaaaggaattcctggcataattgtgaagggaaatccttgggtgataagcaaaaagactcaagaagtagtatatcaagaggagatttggataaccaagagcatttaggactgaatgagtaaaaagcacatagaaaactaagcaaacatcaaaagaacaattagtttaaatagaacaaaaaatttgcagaagaggaaaaggattcatagaattctacatggctcaggtatgaacagcattaacaaggtcatcatcctattaacactgaataatggcctagtcaaaatcatgacctaactatactaagaaaaggaggttcaggatgggagtatgtgaatggtacactttgcacatggtacatctataaatattccaaactagtaagataaaaagaaataaaaaccttagaattccacatagcacatatttcaaaacatatcattcacaattttaaaaattttcaaaaagaagttaaaaaaaatcttacagattaaatgcaaatatcaaatgaggctgccaaaacaactgaaagtggtagctctggggaaggtaaaattgtaggaagcaagcaaggactcctctttcctggcaagcctcagagctatttgacactttaaattacatacatcctgtcatttgcagcaacacgggtgagcctggaggactgcatgttaagcgaagtaagtcaggcacagaaagataaatactgcaatgttctcgctcctatgtgggagctaaaaaagttgatcccacagaagtagagagtaggatagtgcttactagataccaggaagcctaggggacagggagggatagggagagtttggttaatggatgtacaaagttatacctagatagcaaaaataagttctagtgttctatagatctgaagagtgacttatagcaaacaacaatttattgtattttttcaaatagctagaagagaggactttgactgttacccgtataaagaaatgatgaaggtttgaggtgatggatatgttaattgccttaatttgatcattacacattgtatatacatgtatcaaaatatcacactgtatcccataaatatgtacaaatgtatatcaattaaaatgaatatatttaaagataatatagaggaacaaatcccaagcatcatttaatttcttctgtaaataactcagcataatacatatgctgtaagtaactttatgtttacatatttagctgttttgtccttaaaagaactcttttataaggaaactaccttaccatcatcacagttaaaaaattaatcagaggtacttgatatcatcaaatattcggtaagttcacaatcccctgattttcttataacttttaacagtttggttggttgagtcagaattcaaataaagcacatacatttctttttttaagaaaaggaggaagagaggcagtgctgcatagtagttacaagtacagtacgctagggaatccaactgcctaggttcaaatccttgtcctgccagtatgaccttgggcaggttatgtcatgtctccttgcctcagatttctcctctgtaaaatgggtataataatagtaaggctgccacatatgactataagaattgaattgattaatgtacctaagacacctggagtaatacttatcatactgtgaacaatatagtgaacatggtaaaagtgatagctaacattgtttgccaaataaagtatctacctatacatttttaaattataaacatttacaagtttgattttaaaattttttaaggaaataaaaaaaaatcactgcagaaactaaaaatttaaaactacaaaagacagaagtgccactgcagaaaaccaagttggtgccatggaagtctggcttgggaaaaagtacatgtgcttacaataatggaatttactagattaattagaaattatggacatacagaatctacaaataaacaaatttacaagaagaaaacaacctcatcaaaaagtaggcaaaggatatgaacagacacttctcaaaagaagacatttatgcagccaacaaacttatgaaaaaatgttcatcatcactgctcgttacagaaatgcaaatcaaaaccacaatgagataccatctcacatcatttagaatggcgagcattaaaaagtcaggaatcaacagatgctggagaggatgtggggaaaataggaatgcttttacagtgttggtaggagtgtaaattagttcaaccattgtggaacacagtgtggcaactcctcaaggatctagaactagaaataccatttgactcagccatcccattactgggtatacacctaaaagattataaatcattctactataaagacacatacacacatatgtttactgcagcattgttcacaatagcaaagacttggaaccaacccaaatgcacatcaaatgatagactgaataaagaaaatgtggtacatatacaccatggaatactatgcagccataaaaatggatgagtttatgtccttttcagggacatggatgaaactggaaaccatcattctcagcaaagtaacacaagaagagaaaaccaaacaccacatattctcactcataagtgggagttgaacaataagaacacatggacacagggaggggaacatcacacactggggcctgtcagggggtgatggactaggggagggatagcattaggagaaatacctaatgtaaatgacgagttgatggatgcagcaaaccaacatggcacatgtatacttatgtaacaaacctgcatgttgtgcacatgtaccccagaacttaaagtataataataaaaaataaaaataaaaaaatttaaaaagaaattatggatataaatcgcaggacataaagattcaacataatcggcatacttgacaaaaataagtggaacagaagttacttagcaataaaagtaaactttcctaactcctacaactcaaaatcaaaaacaacaaaccaacaaacaacttaaaaattgggcaaaagacttgagtagacacttctacaaaaatgtatatacacatacacacacacacacacacacacacacacacacacacggccaaacatgaagagatgctcaacatcactaatcatcagtaaaatgcaaatgcaaatcaaaatagtaagataacatctgacacccattaagatagccattatcaaaaaaagaaaagaagtattagcaaggatgtgaacaaactggaacccagcactgctggtgggaccaaaaatggtacaatcactatggaaaacagtatagaggttcctcaaaaaaattaaaataggattaccatatgatttagcaatcccacctctgggtatatatccaaaataactgttaatgatctttcaaagagatatttgtatacccatgtttgtagcagcactatctacaagagccaagaggtagaagcaacccaagttttcaacaacagatgaacagacataaactaaattggtatatacatacaatggcttatcatccagccttcaaaaggatattctggcatatgctatgacatggatgaaccctgaagacattatgctaagtgaaataagccagtcaaaaaaggacaaatactccacatatataaggtagctaatagtcaaattaatagagacaaagtacagtagtacttgccagggactgggggagagggatgaatgagaaattgctgtgtaatgggtacggggtttcagttttacaagacgaaaagagttctggagattggttgcacaacagtctgaatatacttaacactactgaactgtacatttaaatggttaagagggtaaattttatgttatgtgtattttaccataatttaaaaaagtgtgacaaattccaggaaaactatgaagtaaatgataagtgcaaaacaggtttaagttaataagctttaaaaattaaaagaaatcccattaaaaaaatcaaatggggaaaataaatcaaatcataatgggaaaaaaatgggctggacacagccattaacctcaccccaacaaataagatgaaggaataaatttcaagattttgtcagaaatatggaacgactcaaaaattctacagccaatcaagcctttgtttacctgcaataacaaaaacaagccacttttaatatttttatttttaatttttgtgggtacatagtaggtgtatatatttgtggggtatatgggatattctgatgcaggcatgcaatatgtaatagtcacatcatggtaaatgggtacgcatcacctcaagcacttatcctttctttgtgttacaaacaatccaataatccaactatactcttttaactattataaaatgtacaataaatttaccctgttatgctaccaaatactagatcttattcattctatttaactatatttctgtacccattaaccaacccaccttcctagcccctcgtaactatccttctattctctgtctccatatgttcaattaatttttttagttcctacaaataagaacatgcaaagtttatctgtgactagcttacttcacttaacacagtgacctccagttccatccatgttgttgcaaatgacaagatcttattccttttctggctgaataatactccattgtgtataagtaccacattttctttatccatttttctgttaatggacacttaggctgcttccaaatcttggctattgtgaacagtgctgcaataaacatgagagtgaagatacctcttcaatatgctgattttctttcttttgggtatatacttagcagtgagattgctggatcatatggtataattaagatatatttctccctgaaaaatttgttcaaacacataatacaactactcatatgacaaatcaaaataatgtgctcaggaaacctttggcaagagcagcttgtcaatccagataagcacagaatacctgtgatagtaacggtgacaaaaaaaaaagaatgcagttttaactaataggaaaaaaaaaaagctatacagttgaaatacgtgtaactaataagctaagatgaaaactccagaaaatcacaagaaaaaggagaacattcttcaccttttgagaaaggagccaatcaatactgtttcatttctaaagttgataaaatcagaatttccgttttaaagaatcaaaaagaaaaaggaaaggggaaaacaggatgacagagacatggccatgctaaactttttatctgggttacttatccctaccactgactctacccccttcactgacagtgaagcaaatggttcagctgggatgaaggaggctatgggttcatttgcttcacatgcagattcagaacaaagaaatcagaaatgcatttgagaaaccaaatgactaccttatgttttgttttaaaataccatcgccacctgtggctacaggctgctttcctctctctgtggctactttcctctcttcctcaaagtgtcagccctaagatcttgcttcagtgtactcacaggatacaatatatttcatgttcataaatccttttccacaaataagatcagtcttttcatttgcttctccagcttttcaattagatcttttattttcaaattggtctaaaagtctatcattttttctacagggcacagagctaacgcattccaaggaagaaatacaactagcccatcctgcgcacactgactgcagagagagaaacacaattaacacaattgcgcctttttacatgtattttatcaggtcatgatgggccaggtcaggtattctagaagctggagaaactggccaaaacttatataagtaaacactgtcttaatttcaaagactgtattcccagctgtatagttttcactttagaagtggtcctgatggagaggaatgctatcctgacacttaccaaaataaccaagaattgtaaaattcaaattatggagattactatcttagaataagtgtcactatgaaggcaaaggatatattggccaaactgtttagcctcaaggtcaagctagtttgtgttacaatgcttagaaaatgggagaaaatctctacttagaagtagtaaatcaggaaaggcctggaactacagatttctgagttggagaaaattgagctcaagggagtgtgatcactcatgaagacagagagcaagaagagaaggaatgagatctacattttaaggggaaatgaggaggattccacaaagaagactgaaaaaaatcctcttgaaaagtagaactctactctgggtaagagacagacttcattctgccctgtttctttccagagtcatctaaactcttgatcttctttgtgtgtgcatgccatgaccctcagccatttgcatagggacctagagcaatgcagatataaatttgaattaggatttccacttacaggagaagcaccctatagggtggatacatttctactgagggcgccactgtgccaagctggggtgttttcagtccgtagttttcagaacaaggacaattacaacctctataaccaagcttcgggcaggctagactcttccaaccacagatgagtcttgaaaaatatttcattctaagagtaagtgcatgtttctaacatgagaagtaattttcagccaagtatggtggctcatgcctgtaattccagcactttgagaggccaaggccggaggattgcttgagcccaggagtttgagaccagccagggcaatatagtgaaactctgtctccacaaaaattaaaaataaaacaaaaatttaaaaagttaactattctaaaaaaaaaaagtaattcccaaatggcctaaaatagaaggaatgtgaatatatgaagtgaagggaagaaaattagggaagaaaagagaccaatgggggtggaaacaaagtgtcgaaatagctagtcagaatatagaagtctgtggctgtggtaagtaaagtgattcagccctgaataacagtgttcaacagcagagagttctcttaacagagacatcttccattatttaaggtttcaagtagcttaaaattcaagcacctttgggagaatgaatcaaaatcaatactgagtgcttgaatgattgtgatttaaaactgcctcaacataagaaagttatccttgaaagatggttttctgatgtgtttgtatacaaagtaggaaaataggcgctcaaatgtatttctggtataggtgaaactgttgtaacctttctggaatgctaatattagggaaatgtgtgtatatgcatggtttccatcaagatcctaaaaagtgtgctgaatcagaaggcatgtaactccaccactaggaatttatactatgggaaaaatataaaggacaaagaatttgctacaaggatgcttaatgcaatatcatgtatgataggataattttaggaacaatgtaagcatccagtaatacagtacttggcaaccttgttattaaaactacatttacatgcaattcaactattatatatctattcaattattatgtttattctatataatatattgcatatataataggtattatattcaattgtataatacatatgtttatataatatatatgtttatataatatttcaactcccaataatttcatctccagtgccaccaataacactccctactccctggccccctactcacgaaattattctttaaaaacttcagtctccaaatttggggggagactgatttgagtaataaaactccagtcacccattcagctggctctacatgaattaaactctttcgctattgcaagtctcctgtcttgataaatcagttccacctggggagtaggtaaggagaacccattgggcagttacaccacagacagccctgtggaacctacatgtatatatatatatatatataaagttggccctccatacctgtggggttcgcataccatgaatactatatttctgatctgcatttggttggaaaaaaatatgcatataaatggatctgcattgttcgtgggtcaactgtacacgtaactggagtccccaaagcaaaaagggagagtgaaaaaacaaggctaaaaataaacactataaacccacagactcaacaagctcaatgaagcatgagcacaggaaacaaagaaaaatgcacaatcaaatttacaaaaccataacaataaaatctttaaagttactggattaaagaaaaaaaaagacacctagagaggaacaaggataagaatgacagcagatttctcatcagaaacaatccaagcaaaaagacaggtgatcaacatctttaaaataatgggaagtgggggaactatcaatctagaactttatacacattaaaaaatgttcagaggtgaaagtaaaataaaaacattttcaaacatacaaaaggtgaaagaattcatcataagcagacgttggaccataagaaatgttaaaaagaagttcatcagacagaaagaaaattataccacatgaaaatatggatcctcataaagaaatgaaggataccaaaaatattaatagtaataacatggataaatataaaaaccattttattatataagtatctgaaaaatataattgaaaacaactcatagaaagaaaaatatttgcaaatcataagggacttgtatccagaataaagaactcctgcaattcaataatgaagagacaagctaattttaaaatgattaaatatctgaatagatatttttctaagaaaacagacaaatggctaacaagaatatgaaaagacactggatatcctttagccattagggaaacaaaagccaaattcacacttcataactactaggatggctataatttaaaagacataataacaagtgttggttaagaatgtggagaaattggaacccttatacattgctggtgggaatataaaaggtgcagccactgtgaaaatctggtagttcctcaaaatattaaatagcattttcatatgatccagcaattccactcctaagtatatgcccaaaagaactgaaaatatatatccacacaaaaacttctccaagaatattcatagaagcattacagaatcatcaaaaagtagaaataatccaaatgtctatcaactgttgaaaggataaagttaaatatggtatttttaaacaatggaatattattgagcagcaacaaaaaaagaaagaaagatacatactacaacatgcagtattgtgcatttttttctaagtgaaaagccaatcaaaaaaggccacaaatctataagcctgtttacatgaaatgtccaagataggtaaatctatgagaaagaaagtagattcgtgtttttcaggagtttggaagaggataaatagggagtgattgaaaacaaatatgaggtttctcttggaatgataaacattttctgagcttgattggagtgatgattgcacattatctatctatctatctggagacaaggactggctctgttgcccaggctggccttaaactcctgtgctcaagtgatcctgtctctgcctcctgaatagctgggaatacaggcacatgccactgctgcagaactcttaatatatcaaaaactattgaattttaaatggctggcttttatggtattaaattatacctcaataaagttgttctaaaaagataatgaaaataacaatagagtttattacaaaagttttaaaaagcaggggagtaaagtaagtatactgtattgttgtgaggttcttgtactatacataaaggggtacgatgtcacttaaaagttgcctacaataaattaaagcctactgcacacactgaatcaaccactaaaaataaaataaagaattatggctaacaatccaacaagaagataaaatgaaatcataaagtataccaaatccaaaaaatagaacaaatgtgacaatagacaaaagcaagatgatagatttaaacataaccatatgaaaacacatatatatacactcattaaatgtaagtggtctaaacaactcaattaaaaggcatagattatgagactggataaaaaagcaagacacaactatatgctccctacatgaaccatactttaaacatgaagacacaaatagattaaaagtaaaaggataaaaaaacgaaatacccagctaacactaaacaaaacaaagctgaagtatcaatattaaaatctaacagagtagattagtagattttagagcaaaacatattagcagggattttaaaaaaaaaggttatttcataatgatagagtctctttatcaagatgacataacaatcctaaaagtgtatgcatctaattacagatttttgaaacatacgaagtaaaaacgagtaactggataaataaacaaatccacaaatatagccagagataaatatgcctcagtcattaattgacagaacagaaaaaatcagtaaggatataagagacatgaacaatacaagtagtcaacttgatctaatttgacattttgaaaagactcaacccaacaccagactacacattcctctcaagaacaaaagaaatctgtaccaatatagaccatattctgggccataaaacaagtctcaataaatgtaaaagaatttgagtcataaaaagtctgttctctgaccacacttaaattatcaataacagaatgatctctggaaaatcatcaaatgctggaaactaagtaatgtatctgtatataccttataaatcaaagaagtcaaaggaggtaattaaaaaatcttttgaattgaatattttgaactaaatgaagaggaaaacaaaacatatcaaaatttgtgggatgtcactaaaccagtgccaaagaggaaaaccatagcattaaacacctataatagaaaagaagaaaagtctcaaataaatgacctcatcttttaccatcaaaaactagaaaaggataatttaattaaaatcaaagtaagcaggaaaaaataaaatagtagataattatatagaaactataaaacaaatccaaaagatgtttctttaagaacatcaatacaattgctaacgctctaaccagattagtcgagaaaaaaggtgagaagatataaatgactaataataaaattgaaagaggggtcattactattgtccctgtcagagacattaaaagtataataaatgattaagacagtgtagtatagcattttctccacttttaaatatgaagtcacaattttaaaatcatggtggaactattagatatccataagcaaaaatataaactgaaaaaaccaactgattcatacctcataccatatacaaaaattaactgaaaagggtcataaacctaaatataaaacttagaaccataaaacttctagaggaaaacataagagaaaatcattgtgtactttgcgtaagcaaagtttccttagataagatacctgtgagccaaagtaacaaatgtaagaagacatatttgctcatttctgcttgtcaacatactttcccaaagcccctgactctgtgacaacgtgtagctctccagaaacgtgcattgaagacaaaacagaatagagaacagggcctcccaccctccagctcttgcctgagtcactgtattccttaaaagataaatggccctagtccttgccttttcctacacataagagaacacctgacagggttagtgattacacttctgtaatctataactagatagactcttgcacccaaactttgatgtgattttatatgcactgaacctgtatataaactgtgagctgaaacactattttggagcagtctgatagaatctttctggtttgttttgttgttgttgttgttgttgttgttgttgttgttgttgttgttttttgggacagtttcactcttgttgcccaggctggagtgcaatggcacgatcttggctcactgcaacctccgcctcccaggttcgagcaattctcctgcctcagcctcccaagtagctgggattacaggtatgtgccatttgtatttttagtagagatggggtttctccatgttggtcaggctggtctcaaactcctgacctcaggtgatccgcccacctcggcctcccaaagtgctgggattacaggcgtgagccaccactcctggccaacagaacctttctgaaagactcctcccaggctgtagtcctcagtcagtctatagctctcagtaagacttctggataaaactaacttaaattctttaaaagcttgtttttttttttctttagtcaaaatatcaaaagcaggatctataaagaacaaacagaaaaactgaacttcatttaaatttactttttaaaagacattgttaaataaattaaatggcaagccacaaactgagagaaaatactttcaaagtatatgtccataaggaacttgtatccaaagcatataagaaatttcaaaattcaaaaaggggcaaaagattgggacagtttaccaaagataatatacggatggcagataagcatagaagagcaattaggaaaaatgcaaattaaaaccacaatgaaacaccactacatgactattagaatggataaaattgaaaaaaccaaccataccaagtgtcagtgaggatttaaagaagctgcaactctcacacactgatgtgggaatgtaagatagaatcagtctggaaaataatctgacagtttctttaaaagttaattatccagttctgccatttaactcctaggtatttacccaagagaaaataaagtagttgtctatacaaagacttgagcacaaatgcttctagtagttttatctgtaaatagccaaaaactggaaacagctcaaatgtccattcataaatgaatggacaaattgttatgtatccataaaacagaagactacccagcaataaaaacaaatgaactactggtatgtataatactatctatcactctcaaaataagccgagtaaaataaaccagacaaaacacaacacttactgtatgattccattatataaaactgtagaaaatgcaaactaatttatagtgaccaaaagcaattaagtggttgcctgggagtataagagcagaatgacatgagggaaggatttcaaacaacaggagaaaagctgaggagtgttggatatgttcaccatcttcattgcagtgataatttcgagagtatatgcatacgtcaaaacaaatcaaattgtatactttaaatatatgtagtctatgttatcaatgaaaaaattaaaagaaagcataagtcttaaagaaaaacgctattttacaactttttaaaatgtaatatttaaagaacattctccttaaatggaaaactctggcatacaagaaaatatgaccactaaccacaaactaatttttttttaatatactttaagttctagggtacatgtgcaccacgtgcaggtttgttacataggtatacatgtgctatgttggtttgctgcacccatcaacttgtcatttacattaggtatttctcctaatgctatcccttccccagcccctcacccaccaacaggcccctggtgtgtgatgttcccctgcctgtgtccatgtgttctcataccacaaactaatttttaaaaattattatggaatagtttttaagttttttcctggcttttatacccttgatctcttgattataggctgtttattgtgtagaatgttcctcagtggctccaagggcagcccaacgcagagtgtcagagtctaagtgaggtgaagaggatgtccccatgggaaggtagcccagagtttgtgtcaaagcctgaaaggtgaggggtcaaccaggagagaaagaaagaggtaatccaggagagaaggagagaggttttcaatagaaatagaaataaaaacagttatcaatgtgtgtgttgcacagtgagaagcctgggaatagtgatatcccaataacaatgagcacacctaacacttacatcttcgtctcttaataccattctctacagaaaggtgccaggctccttggagatatgcctgttcctcagattagggaaatacatgatgccttggttaccttgagcagacagttaagacagcacttaaaagaattatgcagacatgtaaaaaggacaaggaaactagtttgaaaggtactcactggtctaattatttctaagtttgaaaatgaaaaaggaatccgtaagttcattttaatacaaataaaagtttgaccaaaaaattgatatttacaaagactcaaacacttccctagaaaatacttaccataaagtgcaaaataataactgtacagtaaataagtctggaagacatcactttaatcaagtgatcaaaataacatcaccaataatggagcaaatcaacagtgtgtgccacctgacaaaatgcaatgagaatatcacttctgtcatgttcctgccaaaagtttgaaatctgaatttaatcaacaggaaacatgtaacaaacccactgaggaacattctacacaatgaacagcctataatcaagagatcaagggtataaaagccaagaaaaaagttagaaactattccataataaagtagacttagaaaagacctaattataaatacagtgcaagatgatgagctggatccttcactatcaaggatattgttgtgacaatatgggaaaatttcaatgggatctgataattagatgatagtaagataatagggtgaatttactgatttcagtggttgctttgtgactatgttgaagaatgtgcttgtttgtgagaaaaacagagtatttgaagatgttagcgcatcagtgtaaacaattcactcttaattgacttagggagataaaagcttcttcacacttttttactgtacttgcaacttttctataagtttgagggaggcagagtagaggaggaggagaggaaggagcagggatagaaggagaagcagtcatcttacataaaataattttaagtggaagagagggttcatgtgtcactactaaccataagaatagacatccccaagatctggctaaaagtgactgttacaaagtacatgactaccccagacacatatgtgcctgattttagagaagacaggaaaagatgtctcaaacaaatcacaaactctaagaggcacgttgccaaaagtcaaataggtcttctgaaaaaggagaagtctagaccacagtcaacagcgcaggcagcatcgtaccaccaagtttagctgtgttttcaaaaaagctaaagaaatatcatagtattagaaagacacatttatgttaaacacaaaacaaagacaaaggcagatgctccagcaatgtggccctaagtacttctgtttccaggatacatgtcacatgagaaatgtgacgaggtaccatgttctttgaagatggtacattatgaaatttcttctgcctaccagtgagactaatctcttccagatgttgtttggcccacaatgtgctattcaaatatatgaaagttttgtttattttcaaagtttgagagccaaataagaaacccagtttccttcaccagcctctaattaaactggagataaaagcttaaaaaaaatcagtatataacctaagtctagacttatacatcctgcctgaagttttgaggtggggagggggaagaaaataagacctgtggaatacaatcctaatatctacttcagcatgggaaaaataatgagacgcttaatttcatttcctttcctgctcccagcatattaccattcttcctcattgaaaaccctcttggcaatacctctctaaaacagtaaatatagaggggaatctaaagaaaactagtattgtactagaggatgaattattcccagctgggtcgaggatatgtaaatactctggcttcctgagaagtcacatacgtgattttaccaacttgagggagcaccaagaaagagctggcctcattctttgatatacaattctatgaatagcatctcaaatgttaccactctgttgaagaaatcaggaagtgaagcaaagggaattaagtgacttttctctgttcacaatgatttagtaactatgaaaatcaccaaaaaaggggggtcccctctctaacttatgtgagtggttaactcctgttttcctgttatgaaagggtttaaaatataatagcggacacttttaaaaataatggctgaagtcttttatcaggaaagcagtagaaaatggaagggaaaaggagcctcttttttaataaactatgaggagatagtaaaaccacaaagtagccacaaagcccctatgtctgagacatgacctaaaaaccaaccggagacctaaaaacagctgtgaggccccacttgaaagacttctatctgctaatgggcctgaaagatgctgtcctacatgtccagaaaaacacagtgggatagtccaaatatgtagagaatggagaatatcacacagaaaacttctaactagtgtgaaaagggatttgatgaccactccaaaaaagagataaggcattatgacattagaaagggaattctgggctgggtgtggtggctcaagcctgtaactccaacactctccgaggccaaggcaggacaatcacttgagaccaggggttcgagaccagcctggccaacatagcaagatgccatctctacttaaaaaataataataaatataaaaatattttttaaaggaaaggaattctgatacaaaaggagtccgcttacaaaaaaataagttttactaaactgatattccctaaaaaatctgggagaagaagaaacaaccagactcagtggctgtgggtgcgacctgaccaagaatttcctggggcttgagaaggaagcgtgtgccaaagggctgaggttacagcgactgttgttttaagccaagtcatagcgataaaatgagcaggtggcaagtctctaaatcttttgtattcccagatttccccattttacagtaatacagtgctgggggcaagggataaaatgtgatgtgttcagccaattgcagagaagcggctccaagggtataattttagatttctaaaaggccacctctccaaagaactaccccagtttcttttggtggtagcgatggaggtaactgaagtgacatacaaggacccttccccttctggggtctgatggtctcgttacagagactgatctctgatctaagttacatgaactcctcctctcagctggaattcatagcaccacactgatttcttttggccccaagcccaaattgcagctgtttgtacttattcgtggtatggtgtattttgaaacaaaatgaaccagatttttcctactgcctatgtcagtgcctggtattgggaaacattaactctttcacagtgaggctaccaacaattgtattgtgtctatgaaaggaaggatgatataaagaagacactgaccccaagctgggaaagagtcaatcaagaagcccatttcaaagcaaagggcagatattccatcatttacttagttttggggccccatctacttccaaataagtttcagataggttacagaagattataaagaacaagagtcatggattaaagtaagcaagggaaataggtatttcaaaactgagtgcaaaattttactctgagctctctggtaaccaaagcaaaagggaaaatgaagagttgcgtattaactattgagagagagagatgttattttcttctactaattcctagtaagagttatcaaatggtataaaatatacaaaaatattaatatggctatttcttctcctatcaactctcaatgaaagctgaagataaaaataaatggttcttggatggtatagcacccatgaaacttaaacacaaaacaaaaccagacttttaacagagttttttatttagtagaaactagacatctgtattttttaagtctccttaattctgaagcgtatgtctgattacatgccattatcttaaatcagagttcttcacagatacttggactagaacaaacgtattatattctacatttattgctagtaagtgatctaatatgatataaggtgagcagagcaagctttactgcagaatatagtaacactgagtcctgtgtcttctccaaagctggtgcataagatgctgtgcgagagagaaccaagaatctgtattttaacaagcacccaaagtgggtctaggttgaaagctaggtgtgttaactactgcattacaccagtggttctcaaattgtaatatgtggcacacagaattcactggagggcttgttcaaacacagatgtatgagccccaccccactgcatgtctgattcagtaggtctggggtggatccaagaatttgcatttattaacaaatctccaagtgatgctggtgctgctcatggggccacactttaagaaccactcactaaactgtccatttaaaaaatcagtggcctcacatggcctttaatagaactggaaataataatttaaaataatacataattcaagactaaagtctctgataagtgtctgaagtgttcagtattgttgattagaaaaagttttaagtgcttttaatacctggcagaaaaggcaaatttggaattttattaaataaataaataaattggactttcatccaaactgaaggtcattccacctggtcaattataaggactgccagaaatattgtttcaggagagaacttttgaattattcaataaagactgtaactgaaacaccgtggaccagtgcaaaaaagaactgagggcaggtgttaccatttataaatcctggacattaaaaatacacacacatgtttaatgaaactcctaagagcatgttaagtttgagaacttcatcccggcaagcgtctacaacaataagggagctgcaattgtaccttcacattatatgacttgatctgtagcataaagctattagtgtaatccatctgaatctgaattttggagggtgtcgcccaaggcaacagatttagttttgacaaagtcaatagcaagttcttcttaaagaaaagaactggacaataggtctgaggattcttaaattcattttctgttcatgagcataagatcacaccatagctctaccggaaaggcaatatctaatgcatagatagatttcttaagttatcaaatcatagattcaaaagaaggcataaggatgtggacacaggtgggttttatatcatttggaaatggaacttgatctgtcaaaagataactcctatatactatgttattctctggatggctgtatcaatcctcttaggaaacattaaagtttaaaatcttcgtgatcagtcagctcaacccagagacattttattaagatcaaaagctgtagtgaaattaatatatcccgcacatggtcataaagtgacttctgaataaagatgatgtcagccccaactccccaatatgtccacacccaatttccagtcaaaatacaaatgaagacaaaaactcaaaatagctctgaaaccaagaataacaaccagccatttataagaacctgggagtaatatctattaagtacagtgcagatggaactgaattaaaagcaactggtgtccaacgaatgctttaattgctaaaaaagaacagctagaaataaattagaaggttcagacctcccccaccctacctcattttccagaacactggaatgagcaggaatgagtagcagcagcatccccacaccatgcagccctgctttctaaaacaaccagacagctatccacttgtcttagtcagttcaggctgctatgaaagctaccacagactgggtggcttaaacaacaaacatttctttcttacagatctgaaggctggaagtcgaagaccagggtgacaacaaagttgggctctgatgaggcctcttcggggttgtggtctgcgatcttctcaatttagcctcataagtggaaacagggctagagagctcttctggggtcacatttatgaaactcctaagagcatgttaggacagggtcttgctgtcacccaggctggagtggcgcgatctacctcactatagacttaaactcctaggctcaagtgattctgccacctaagcctcccaagaagctgaaactacacgcacacgccaccacaccaggctaattttttaaaatatttattaatagtagacacagggtcttgctgtgttgcccaggttggtctcaaactcctgagctcaagcaaatcttctgcctcagcctcccagagtgctgggattacaggtgtgagtcaacacaccgactgtagggtctcttttataaggcccctaatctcattcatgagggcggagcccttatgacctaatcacctcctaataccatcgccttggggactgagatttcaacatatgaatttcagggagacacattcttcagtccataacactgctattctccctttctcttacccctttcagaagctctgtacaaagaagttttttcataaatcagcaagcacaataaacaatctactggttggttcatggcctcctgaatatgggagaacagtagtccagttctaaaaagagctgggtacaagaattctaacatgaaaaatttccttgtcactagccaaatctcttagtattgacttgtgactagggaaacaacaggctccactttgatcgggtgacttcttaggggcatggggccagggttttctcctgtttcagcagtcagggtccagagcctccagaggtagtcaccaggatcacccttgtcaatggtgccagctgctcacttgcacaaaggcatcaggctaaaaggagagccatggctgcaatccagcaaggactgctctactcccccagccacgtgcctcagtgtgagctgtgctagcccaaaagaataagccttctgaaaccaggcaggaacctgtgcagctagtaaatggggcatggttagaactccaaagtctaggcccacactgtccaatatgatagttgctctcctacgtgcacagtgcagaaatacattttccattatcacaaaaatctgttggacaatgctggaatactgtccacaaaaattacgaagtggaaggaagctttgccacttttccattaaaatggaaatactcttattctctcctacaaaatacagtctccagagaggtcggtcattttggagtcagaattaaatctaactaaatgcctctaaaacaatgaaaaccttaagacagctggtacactaagctcataataaccccttttgttcactgcatgtttcctatgttttaatatgctaaaatcaaacacatggaaatgctgagctgttttaaataatactcctcaaaaaggaatagggttctctttagaagcattttcttcaatatcaggaataacaagaatctcactattactcctactattcaacacagttctagacagcctagttaattcaatgaaacaagacaacaataaataacatgtaaggagtgaaagagtcaaaactgcccttatttgcaatcaaaatgattatttaaattcaaagtccaaggaagtctatagataaacctgctcctaaatttccagtgaaatgctaaggaccaaaatagccaagacaaattaagagaatagaagtagaggacttgacctaccaatgagtaagacatattaaaagccatgtaatgaaggtaatgtgacaattgttccaggctagacattcagaggtacacaaagtttcaaaacagtcttacataaatgatacacatgacattacagtggggacataaagggactggaaaaaaaaatggttctaaggcaaaaggaaaaatatacctaatcagacaccccaacttcatatcatacatagaactaacatccagatggactaaaggcctgaacataatttgactggcctaggggaactccagcatcatgctggtctcttatttccttttagcttcatttctgaacccttctactgttattctgtgctaacaatctaatgtagggaaagctgcctctatttcctgaaataatacagaaacaagaagttaaaaagaccgtgcttgaagatctcttttatacctaaaactaaccactggcttccttcccctccaaagaaagtcatgtaatgttcctgattcagcagacagattaaaagctcaattagaattctatttttaaaaataatacatacagcttctgaaagaacatataagatgccaactaatcaataccctggataaaaacttccaaaatgactaataaataccctggataggaacttccatataaaaattcatataaatgtagccaacaaatgcagaacaagatttagcttttaacatatgctaaccttctttggaaattaaatattttacctggaaataacagtggttttttaaagttctatcttcagactttctccttggtttatagctctttttactttatataacacttacatgtttcagctgattaataacaactacgcaggaacattcaattccagaggcaattttaatgtagtcattgataaaatacaagctatcataataaaactgtttaatttacttaaaaaaggaatgcagttctaatcacatattcatctgttatacttttcttgtaaatttcccttcggaaaccaattttaaacttctaaaccacctcaatctgcacacttaacagtaaatcacggtaatatgtgtatgtattctagctctcttgaggcaaaacaagcatttaattttaacagacactactcatggggtgccaaagttaatcacacaaaaccagaagtatggctcaatgtgggaacatatttctgaatgaacttatcattaaagatagaaaaagtgtcccagaatgtaaactaataatgggaggtaatgaggatgaacacagtgcaatattcattgctgtttgagagctgaataggtaggtattctcttattcctaatcgaaattaagataaaccaagggacctaaaactccagagataggatttttcctgctaaggctaatggaacaaagcaattaacaactttcagtaaaagaggaatgcaagaactatgctctagaaagatgtgtccatcaaaagtcgaaagcgctgtaggtgtaacttctctttaaaatatgaagggagccaggcatggtggctcacacttgtaatcccggcagtctgtgggcctgaggcaggagaattgcttgaggccaggagtttgagaccagcctggtccacatggtgagaccccatctctacaaaaaaaataaataaataaaatatgaagtgttggttacaagaaacctaatttgtatacccagatgagaaattctgggaatccaggcagatcatcaggagcccatttgaaatggaaatcccctgatcctgtggaatcaactgtaaattaaacagttttattatgatagtttgtattttatcaacgactacattaaaattgcctcagaattgaatgttcctgcatagctgttattaatcagctgaaatgtgtaagttttatataaagtatttaaaccacagagattcagtcacaaacagagaaggcaggattatggctgtccctatccctggagtttagtaggcaagccagaacactccacggtaagacagagtcaacacatgcaccctcgcatctcaagtaaaagcccgcaagagtgagaccagcagggtggcacacaaatctacttagaacccattctctagggacaatgaatgtaatttgcttaatagagtgaaccacaaatcaaaagagaaagggctatgttgggtgctaaaagtgttacaaacacataggcatccctgaggatgccctaaagagttttcttatttggaaggaaaatctccttctctttggggagggtaagataagtacagtgaactattatttggggatcagggactaaaaagtggtggctgcaatcacagaaagggcagtcacccatgagccaatgcagtgtggccaggtcagaagcttcctcctccaccatcccaaggagccggaccatgaaaaccaaaccattctttgtgggagttaaggggagatggtgcagccacatatcctaggaattattcccccaaacctccagctgtatctcagatttatatggctcacagaaacaaaaatataatggtaaaaataattgggctcagaattcataactcagaaataactgaatttatttgcatatgtcttggaccactattccaactaacatgtaatattcatactcttagtagtgtcaaagtcacattaactatttcaatgaagttcatcccaacaactcagacttaagaaaaactaatcattccatgagggcataatcaaggctccatccttcacccagtacacagctgccatagttctttgtgctcataaacatttgtgaaatgcatgtcttgatcctccagtgatagtcaccgtcaccaattttggctaacaatgactttgcaagatatctctcccattcatcctagtcttcaattggccacatcttgttttgcactgcagtttacttcattcaattattctctcttctgtggcttcagttttgttctctcctcatttcccagtcctcagaatataaacatgctaggtttcctattcaagaaagaaaaagtactcccttgaccccaacttcttccttctctctcgttcccctaccccatcctcccttttcaaggcccaggatactgaagaaactgtgcttattgcttttacatttttatatgatgaaccatggcttcctccaccccaactcaaaaccttaagatcactgacctctaaaaaggttctttctctgtcctcatcttacttgaccctctgttggcattttgcatcattaatcactcgttttaattttgccctactcacaacaccatgctcccttgattcttatccaactttgtgatagccttttctcaagcttctttgcaggatcctcttcctctgatgactaggaaatgttggcttacccccaagctctgtacttggccctttcctattctacttctgcttactctccttaggccatcttatccataccaatcaattccacagacacttatagtctggtgatacttaattatgcatcccattccagaatgtagtccaacattccaacttaatagattcaaatccattcttggttgagcacggtggctcatgcctgtaatctcagcattttgggaggctaaagtgggaggatcacttgagcccatgaatttgagacaagcctgggcaacaaagtgagaccccatctctacaaaaaacaaacaaacatagctgggtgtgatggcgtgtgcctgtggttccaggtactcaaaaggctaaagcgcaagcattggttgagcccaagaggtcgaagctgcagttagccatgattacaacactgtactctagcctgggtgacaaagtctcaaaaaaaaaaaaaaaaaaaaaaaagttctctagctctaatctcatttcatttctctctgtctctctccaatttaacctcctgcaatgatctaacaaaattgtggaaatcctttcaattgttaagaattgggagggaggtgggccaggcgtgacggctcatgcctgtaatcccagcactgtaggaggcccaggtaggtggatcacttgagctcaggagaccagcctgggcaacatggtgaaaaaaattagctgggtgtggtggtgtgtgactgtgtagtcccagctactcgggaggctgaggtgagagaattacctgagcccaggaggtggaggttgcagtatactgtgatggcaccactgtactccagcctgagcaacgagtgagaccctgtctcaaaaaaaaaaaaaaaaaaaaaaaaaaaaaaagaagaattgggaaggaggaagcaaacttcagattcctttgtacattccccaagacctcccctgatccagcctctgcctcatccactagcaagtcttaacattatttaccaacaaaactacctggagttcctagaaaacatcatgttacttcatgccttccatattctgttttcacaattaaaatgccttcttccactgcctatccacaaggtgaactccctttatctttcaatcttccaatgtccagctgatgtctcaggagtctccttaatcactgccacacacacatcatcagcagtgtgttggtgtgccctgctatatgccatcacctctgtaccttgcacataagtcataacattcatcacactaaaccctattcagttatgagacaactgctggactttgagcttcctgaggataaagccagcactataattatttttttatcctaatgctcagtgtgcctggcaatatagacagtgctcaataaagggtaattgaacaataaaaggaggaattaatgaaggcatatagccactagaaatgaaaaatgaactgaagaattggtttgcccaaaagcacaagtattctaacacaactatttcctgtcaaatgattttcttcattcatgcatgcatgcaaaaggctgtacacaagacacaaagtgctggtaatataatcttcccagctttctcaagtcactgaaaatcctgatgatgcaagagccttcctagtcaatcccacacattccattcccaatggccattaggaagaaaaagaaacatacaaaatgttggggaaatgatccctaaaggttaagcattataattaactttctgtcttggcacatcctttaacttattccttcttccttaacacacgcacctgcttgttccatcatgaatttggagttcaccattgcctgtgcaaacatctatattaccaattccatgccatggtaattacatattcaaaagttacagactcaacacacaaaaaaaatcccaaataatttgggttgatccaaatcacacctccaaataggtacacaggcaagccaactcaaataaattcacaggggtataaggtataaatctttatagcacataaacaaatgtttatgcattagaattgagtatgaaaaataaagccttaagagatctagaagaaaatacagtagaatgtttatatagtcacagattgagaggaggctattttagcataaggccaaagaaaagactgataaaggtaactacctaaaatagtttggatatttgtctccaaccaaatctcacattgaaatgtaatccccagtgttatacctggggcctgatgggaggtgtttggatcatggggacagatccctcatgaatggttctggaacattctcttggtggtaagtgatctgagttctctcaagatattgtcatttaaaagtatgtgtcacctcaccccaactaactcactccttctctccctttctctctctctttcagtggtgcttgtttgctcctgttttcaccacatgaggtgcctcctcccccttcacctactgccatgactgtaaattttgtgaggcctccccagaagccgagcagatgccagcaccatgcttcctgtagagcccgcagaattgtgagccaattaaatttcttttctttataaattacccagtcttaggtatttctttacagcagtataaaaatggcctaatgcactacctaaacattcaaagcttcattatattaaacaaatgcatatttgaaaaaatgctttatatcacatcataaactgttaacattcttaaagtttaaaaacgaaaattatatgtattaaatatatagcttaaacaagtaaatttttagatgagcatcccaatagaaaaatggttgataaacatccacaagaaatttatgaaatacaaatgatcgatgagcataagaaaaaattgtgcctaacttaaagtgattaaataatctaattttaaaaataaaatgccattgcccccaacacattgataatctttctaaatttataatattcagtttaatgaagttgctgcactttcgagcactgtgatcaggggtttcagtatggaaaaatctcatcctgtccctgaaggatgattttggcaatatgtatcaaaagccagacaaacacaccctttgacctagcaatcctacttcaagatgtttatcattggaaaagaaacagcaatctgtgctaacatacctattgaagacaatcattacaaaactatatccgggaaattgaaagcaaccctaaggtttcgagaagtggtattaatttaagatgccgagcgcggtggctcacacctgtaatcccagcattttgggaggccaaggcaggcagatcacctgaggtcaggagttcaagaccagcatggccaacatggtgaaaccccatctctactaaaaatacaaaaattagctcggtgtggtcgtgggcacctgtaatcccagctactcggtaggctaagacaggagaatcacttgaacctgggaggtggaggttgcagtgagccaagattgtgccactgcactccaacctgggcaatagaacaagactccatctcaaaaaaaaaaaatcttattaataacaatatatttgaaggacaaaatatgtcctgctattttaaaagtcacactatagacgtcttttcccagaatactaagagcaaaatacagtgaaaactcttctagcacaaaaacatgtaaaactgctgtgtgtgtatgcatacataagcacacacctccacctctgtaaatgtttacccaagttggcaaaagtcatgaatctcccaagaagcaaaagtaatcaagaaatcaactcggaaaagaaaaaaataacaataataaactagggagtctgtcagccgattatatcccaataatcccaggtgaccttgagttttggcttttaaaagcagaaatcaagtgaaaaatggaagtcagatcaaagacctctgcaaaaagctgggacatcctacccttaacagctgaactaatagaaaaaatactgacccaagtcacacagggagagggtcagaaaatgtgactgtctcacacatggatctacatggatctaggtaggaaagagtcgcccctgagaatttatatccggacacttgcccttaataaactggggatgacctgaattcctactgctggtgtagccacccaaaaacctcaagctaataattcaacctgatgtggacatgggttgagagtgcctttaatgcatcaaacagaagaaaacacaaattctttctgaactgattcaccttaagctctcaaagaattcccagagaaaaagttcctagaaacatgagcttacattgggagaatggggagtggggtgggatcgcaaagcacatacagaaacaagtcaacatttacaagagtcatcaaaaagaacaaacagtcgaagcagacttacaaagtctacagatactgggattatccaatacagactataaaataaaaatgtttaataagtttaaaagtaaaagaggacatattaaaggataatatattaaaaatgacttacaacttttaagaagatgtaaacagggttcctaaaataaaaatagaaacagggttcctagaaatataaaaacacagtatttcaaattagatattcagtaggtgagtaatacagctgattaagtgcaactgaagagataattagtaaagtggaccatcactacaaacgaattacacagaggcacagatgggaaatctcaaagtgaggtttagagtcaggaatgagatttaaaaaaaaaaattcataccaaaacaaattttattgagcatttattaacacaaaaatgtttgatacattcctaaatattttttaaaaagccacaaagcaatatatacttgtgtcatttttattttttgaaaagtgtggggtttacagacataagtgtacatatttggaagaattggtaaaaatgattggtttatgtttgagtggaaatatttcagtccattttttgtttacatttttatattttccaggggttctgaattatatatgaatcacttttatagtaaaaaaagttatttaaaaattaatagaaaataatactgggcatatatatatgtatttgagtatatgaagggacatataccaatactgttaacagctgctatttctagtttttcagaatttgcatgatttggatgatttttacctataatttctaatcaataattgaataaattatatgtctaaatatggaggggaaaagacttggtacttacaaacactaatagagattttattatggatgctaagttactatgatttttatattttacaaattctcatttgtttttgttgtttatatagtttacactttacatattttcatttctcatttcataattaggaaaatatatatatatatatatatatatatatatatatatatatatatatatggatacatagataggtcagttggccatagaattgtatacaaacctttgtgcaagaaaatcccactttaaaattgaaaacaaatatgcaatatatctatatatttatatacaatgttttcagagacttacaatgtgacaggaaagcactgcctttaaatgttaaaattttaaaacacagaacaaaaatacattcagctctcataaaggtcttgcagaggaataacaggcagaaattataggagaatgttaacagtggctgttcctggtgtcctagttcccttcttgcattaatatctggggagggagagaacaagagcgccagtcagagtttcttgatgttaacatacatctggcctcaattttgattcttgggaaccagagcagtggaagcaagagaccaggaaaataaggtaggggctaaaaccacctatcttaaaacatgttaaaatgtacaatcattgaggtgaattagaggcaaaaagtcaacatttactaccgcctttcaagataagggaaaaggaccagtgcaaccaagaaaagggaaaagccaataatacttagctgttgccgcctttcttaatgacataaaaacccacatcagacaattttttttggtaccctacccttgaactggaaaccacagattttaatctctaatttatttaggaataaaaattcagatcacaggcaacacacttccatgtgactttaaatgtatattattagctaatgataggaaaacctcacattgcccagttgagttcacataaaatgtcatgacttcccttctccttccagaaacagatctctgaaagcatatccctaaagaagaataccaaatattagccagaaacttaatttattctatcccacattcctctgatctttgaaaaagtgattctgcagtgctttccaaattcacagcagacataatgtatgaacatcaaatcatcaaagacagttcaagagaatgcctcacttttagaaacactacaaactaaaacttaagagcttctacacctgcaaataataaacttcaaaggcaatccaaactatcctggcatttatcatttgtgagcataagtgtatgtagtgggtgtaagtctgtgcttggttttaataatcaattgactgattatagtttaactagtcttatttcagcctcgaattcgtgtagagtgtcttaaagctattttaagtatgttgttcataaaatttatagcatctcatcattggaagaaaacttctgaggtctagttctacatcttatccaatcctttagtcactgcagaatctattctctatgtctgctggaacacttccaataacgggaagctcactaccttccaaggccagccatgagatccttggacaggcagtttgctagaaattctctctcaaatgtagttcagattatcctaactgaaaaacccatccctgggacccagctactcttttgtaaccaaactgaatcccgttctttaaacacttcaaatcttacctggccgatgaagatagagatcagattgtctgtttctttctttcctctgtctcataattctattttgcagatcctttaaaacttctttccacttttcactgagaacacgacagctgatttattctatccttcaaggatgacacctaaaacacaatatagtacccttgctggctagttctgaccagtccagaatatgatgaagcccacttgttcttaatgtttggatatgaggtgtttagagagcacattataatgaaaacaaaatgtctacagtttgataaaacagtcatttcaaattggcccaactttgaaaaatgctgctaccgtgagatggaaaataataataactaaagtccccaaatccactgtttctcaaagaacatgtggcccaccagttgtctgttaaaaatgcagagtctcagctaggcacaatggctcatgcctgttattccaacactttgagaggccaaggcagaaagatcacttgagcccaggtgttcaagaccaggctggacaacatagcgagaccctgtctctacaaaaaaatttttaaattagccaggcatggtggtgcacatctgtggtcccaactactcaggtagctgaggtaagagaattgcttgagcctaggagttcaaggctgcaatgagcagttatcatgccactgcactccagcctggacaatagagcaaaaccctgtctcaaacaaacaaacaaacaaacaaaaaatgcagagtcctggatccttcccaaattatctgaattgtgaacactgtgagcaggctgaaaactctgcatttaaatacacatctctggcatttctgatgacagtaaacagtgaaaaccaatgccttatcctatgcttgccgaattgttattgttttaacaaacacaaacacacacatgcatgtacgcacgcgcgcacacacacacacacacacacacacatacacactcagtatcctggtagtccacaaaagcagaattgaatctgggttggtctcagttgatggtaaagctaggattagaacaagaccctggtaatcacatctttcagttccagtccaagcttgtcccctaaagaagaaaacaatatctgggatgtggtaggaggatgagacagagttttaaatggggctgatggggcaaaataaagagcctaaaataaagcaattacttcattcacacttgatcctttgaggttggtggtaaaaaactaagaaactgttcaattgagagaaatatgccagaagagaggagaggaaaaggcaaggaaagagaaaggagaggaagaaggaaggaaaatttcgtttaatagtaagcgggaattcctgtgactggacaggacagaccagctggattcagcctgtaactttgtgaaaggtctagaatttcactcttaaaattttaattttcaaattttcttctgttaatgttaagctttacgtgatttagaaaatgttctcccctaaataagcaaactcgtcatgaaaatcgctgatatctgcatttgctgcaacaagaacaacaaaaaatacattcaaggattttttttaattccaggataaggatcaaatttatttcctcatagaacaagaagacactctaacaatgaaggccaaaagtgcttgtaaaatcctttttgctgttggggtcgtagttttaaaaagtacacttcattccagttctaaatacacacgcaaactacagacaaaacatcctaccacaaaactaaatctgaaaatgtccaggaccaaccaatccacaataaagaggttaaacaccaaacccaaaatggtaaatgtaataaccatgaccctcaccatgtggtaagagatgaatctaattaatgttaccttaaaaagaacttaagtaactccttcctgtcctaattgcccattataagcctcagaagccagctgtgtggtagagacaaatcagtgacattcagcaaaccatgttctgaccaaagtaccactttaccctgtgtgaactctatgaaacatgcgttaatggattccaagggcatttaaagaggctataacctgtcaaacatttacaattacaatgggatcaataaaaatgggattgttagatggcatttttcagattgctctattctgattccaaaaagaaaaagaaaaaaagggtgatcagggagccgtgacacaaaacaatgacattttgttaaatcctgaggctggaagaaaccttaaaggttatctagtaaatttccccaaccttcattccctcttgcaaacaactcaatcatcaagcaagtcattatcaagggcaatttcatcacacccaacagtctgacctctcaagttagtttctgaattgactataccacttagcccctcatcattcagaattgcctgtgacacttcaaaatccccctttatagctgaaactatgcatctatgcagctgtttgtgctcatacacattatttcagccctccaaaatacccagcctcctgctccctccattctttcctgttcaccagccctatccaaggtcaattctcacaatgcccagcctaaataccatagtcagccctctgggctcccctcacaccagcctgatacctcccatgctcctttctgccaatctgccctttgacaccacaatcatgattaaactccaaactgcctgttctgctcccattcacaacctccagaggccttgtggggaaaacttaaggacaaggtaaagctgtcactattaatgaatgcattctaatctcaggtgagcccaaaaagagaagccatcagtgctgccatttctctcggcgcctcttccaagccttaaatcccctaaaggaactccccagtttgcacatccatcatggagaagttgatgaacatcaggcaagaagccccccaaactcccatccttcccatccttctctctctcttaccaaccaccacttgaatgatccgagccattctttcggatctcttctctacacttaacactagacccatcctctcaaccttggatcacattagaatgaccaggtgtctgccctggcctctctttcaaagactgagtcatggcctgaagtgagccccctgcacatggcatgtttcaaaagctcccccaggtgttcttaaaataagccaaggttgggtattactggtgaagacaatttttatccatgcccatgattttaaataccaaatctggagttcttttctgggctgtgttctcacacatccaaatgcattatagaaccaccaccaccaccctacatactccatagggtttgcaaattcaacatgtaccaaactcttcatccttcctgttctaggctaaactgtgtccccccgagaaattcatatgttgaggtcctaactcccagtacctcagaatgtgaccacatttggagccagggtctataaagaggtaattaagttagaatgaggtcattagagtgggccctaatccaatatgactagggtccttataagaggaagaaagttggacacaggcaggtacaaacgaaaaaccacatgaagacacggggaggagaccatcacatgcaaggcaaagagagaggcctcagaagaaaacagtcctcacaattctctatgacttccagcctccagaattgtgagaaaataaatttttgttgtttcagccacccagtccgtgggacttcatggcagccctggcaatctaatataaatacacttcccatgtccttgttactctctcctacttcgtctcattcaacggtattgtcatccattcactatcactcctccccctccctcacccaccatatctattcaatagccaagttgcatcaattcttcctcctaaatgtctttcgtatctaccttcttccctccaaacccactgttactgccttaactcaagccctcttaagatatctcagtactatacgatctcaacttataggtagaatcttaaaaagttgaaccaagaagtagagggtagaatgatggtcaccagaggctggaggcaagggatgaagaacagtggggtgggagatagggagttgttgatcaaagggcacaaagtttcagacagacaagaggaatagcttctttctgagatccactgcacagcagagtggctagagtcaataataatgcattgtatatttcaaaataagagtaaatttcaaacgtctcaccataaaaaattatataggtcagtgaaatggaggaaaaataaagatgttttcataaataactttttttaaaaagctattctagtcccttctacctgcaactatttctcctgggtgtttggagaataaccttcctaaaacagaaatctagtatggcaatgatctgtttcaaaccttcccatggttccccattgccccaaggccagcctcctcatgcacggcaaactgagtccttcaggtacttctggcttaggctataattcaccttgcttgttaagccccagcactttggatctactcagaaatcccctaacatataatgctaatccacacagctgtctttgcatatgcacttggcttttcctggaataccctcccttgtccaaattctatgcctggcaaatatctactcatctttccagtcacagcctttcaatgaagccttttatgggtcctattccccacccagattaatcaccacctcctctatgctgcttctgaacttacacatacatcattacactgtgaccatataccagcaaatgtcacaagcacaaatacccacagggaccaaccaggtatcataaatacatgaagtgccaatgaaaacagatctttagcttccatgatacagaaactacacttgcacgaggaacaatcataatgcccacctgtctatgctgacttttgaaacttgacctgaacaaataaactgtatgtggggccaaattcatttagcacatagacttccagtcttgcaaactctggccaaaggcatcaactgtcagagccttcatttctcttccttctactccctgaagtaaaaagactccacaaaatccgtgctcataggctgatctttgttcatgctactctcagtcaagtcaatgcttaaagcacaggaacccacacttaactgaccacaaagagaggatgcagtattgagcttaataaccttgaacttactgctactcagttcttatcaaaaatatccttttgcatgaagtaatattcataggaaacatcctgaaaagtatctaattcagcactccacaaagaatgtggaatgtctatgcttggacagagccagcagtgagctgcttgtctgaactgtcttgctttggctcttacagaatggcttttctgagataagcaattggcattatgccattaacctatattgagcaatacagttttttttaaccccattgtcacattcattgtaagattgtatttggagacacgactcaatacattaaagtacctaacgtttggagaaccatggataaaatcctctctcctcccagcacatgaagagttctcctcccagcacatgaagagttgtcccccctggttagtccttatcttcatgggctttctgggtaacacagctcattgagtcccctcttcatgtcaactatgaggaagaacagcaaaatgcgtggcccttttctaatacatgaatagcaccctaaggtgggcccttggtctcggtctctgcttaaattcacactcacttcctcttaccccatttccttcctatgcttattaaatttcactatatttagtaggaaaacagacatgcaactaacttataacattgcatttatcacatggtaccttcattcagttcccatccctcgagtctgagttttttgaaggtgggcctccatcactaatgagatatcaaatttaattggattacatgtgactacttccagtaatgggtgaaattgcaaatctattacctcctaaggaagctcactttatttccccaaggcacaaaagtggtccctgactgtaatatcaatggcatctagaagaaaattgagcttatgcgggtaaatatgcaaaatacacactaaaccagcacaggtataattaccatttagtttttaattctttgctattcatttttagagcacttgctccattttctagtagttaaccagttatttcacagaagtatactcatcaggaataccctaccatcagttgatgcagtgtatacagttaaaaacaaagcttggctgggcgcagtggctcacgcctataatctcagcactttgggaggccgaggcaggcggatcacgagatcaagagattgagaccatcctggccaacatggtgaaacctatctctactaaaaatacaaaaatcaactgggcatggtggtgcctgcctgtagtcccagctactagggaggctgaggcaggagaattgcttgaacccaggaggtggaggttgcagtgagccgagatggcgccactgcactccaacctggcgacagagcaagactctgtctaaaaaaaaacaaaacaaacaaacaaaaaaaaactttttcacagcatattaaaggacataaaactaagggaagcttgaaacataaagttctctgttagaagacaaaactgtggatgagtgaaagacatgaccacagtggagagaacatccaccaatgaggtctagtcaatgtcatccaggacagattattattaaagtttcccattgctctaatcatttcacatttcacttatactaatttccatctttaagtttttctcaaactctgctggtaggagtatgaagcattatcattgttttggaaatcaatttaatcatttctatctctagccataaaaatcatccctgccttttaaggcaacaaattatattaccaggaatctactctaaagaaattacctgaaatgcaaaaataggcttgcaaagatatttactgaagtgagttcactataacagtagctgaatggaattaacatcacttccatttactgcatactattaagagaaaggacaaagtactgattatgcccagtaggattccaactagataaaatttacagagaaaatattaaaagggaatatcccataaacttgacaatggctatctctaggtggggagtatgggtactttttccttcttcttctttatatttttctttgttttctaaaatgagcacaaacaggtgttacttttgaaagttaagtttttaaactaccttttaaaatctacttggaaaccaaatgatattactttcaaatcagtgatctcactcttaatcagtctacggaaattacataaaagttgttgagtacaatactttttaaaacagcaagtacaaaggaaataaaactgtgtaaaaatagggcaatggttgaatgaacagtttaacagcttaatggattattatcaggctattaaaaatatgattcagactatatcgccttatataacagtgtgttaaaaaacaatcagtagaaataaaaacacacatttgttacttctaggtagaagtagaccataaaatagaacataatagaaataggccataaaactaacatgactaaataacaaatacattcattagggaactgcaaatacaagtgggtttatttaaatattgccataatgtgatttcaaaaataatttttttaatgtttttaagaatacactaagggccaggtatggtggctcacacctctgatcccaacactttgggaagattgcttgagcccaggagttcgagaccagcctggtcaacatcgcaagacaccttctctattaaaaataataataatagagatatattttaaaagataataaacagtatttcatataaaaacaattggttttaaataagttgaacagttttaaatactttaagatgtgttcactggaacatttttactcactgagtcattctgccactaaaacgggatgaagaaggaaaaaggaagagagttaggcaggtaaatgatagtgtgtgttttctgctgaacggctactggacagagttacttttattccctacccaaattagtggaatgttgtattagcttaggctgccattaaaaagttccttgggaggccgaggcgggcagatcacaaggacaggagatcgagaccatcctggctaacatggtgaaaccccgtctctactaaaaaaaaaaacatacaaaaaattagccgggcttggtggcgggcacctgtagtcccagctactcaggaggctgaggcaggagaatggcgtgaacctgggaggtggagattgcagtgagccaagatcacgccacagcacatcagcctgggcgacagagtgagactccgtctcaaaaaaaagttccatacgttaggtggcttaaatgaaaaaaatttattttctcataattctagaggctagaaatgtaatacagggtgccagcatggttggtttctggtgagggctctccttttggcttgcagacagctgtcttttcactgtttgctcacacagcctttccttggtgaatgtgtatagaaacaaagatctctctcttcctcttcccataaggccaccaatcctatcagattaggaccccacacttataatctcatttaatcctaattatctcctaaaagccttatctccaaatacagctacactgggggttagggctccaacatgaatattagggagaaaatccagtccatagcaaatgttaaatatgttttataataaatctcttgtagaaagaatacatttagtcatgagacctcagctaattcctgctcctagagaaatagtattcaacaaggttcttaatccctgaatcagatgagaatttgtgatttcaaagccctctactttaagatgaccaaacacttgaagagaagctgggactttgtcccaaggtcatggtgactaaacccctgcttgagtgttgagattcccttgaacaatcagcgaagttcaactgatgcttccaactctgaaaataaatttctcctgggagctttagacttttgtctacaccacttctctcttagggctatccagaatgccttttatggaattctaggccaggcatctacatgctctgtgcctcttcctggctttgtctaccttgaacctaccctaaccccatgaccccagccccttcacacccaacctgtttctagtactagcattgagcacctgtgcctagtacctacttggacctacacattgccaaacattgcctgtgcctgtgtgacctgcccctgccttgtctcagatcaggagcctggagtcctggctggtttccatataataatcagcttaagaagatatttaacaacaaattaaaaaaatcaactgatgaatcagcaccaaaacacactaagtaaaatctccagagttacctggacttcctgagtaaatattttactatgaatgaggaattcagcagagttcagacaaacagaaaaagcatgcatctcatctttcttccctcgatttctaaacaaaaaataagaacgagtgtaataacatattcacgttacaataaatgaacttgaaagactgaatatattgaattacaaaaaaataatgttgaaatgtatttgaatcaaatgatttaatatactggtaagaaaagctgagttgatgggggaaagggaagatgctggtcaaagggtacaaacttccagttatgagtaagttctggggatctaacgtacagcatggtgacgatacttaatagtactcatttcacagtatatatgtatatcaccatcataagtagaacttaaatacagttttgcttgtcattatacatcaataaagctaggaggaaaaagaaaagataagctgaattgccaagtacctttaattctctttcacataagcccatttcttataaaatattccttaaacttggtgtagtcattaaaattgaattcatcttccatatgattccttagccctttaaaatctttttaaaataatatcaccctcatccaatgggtttttataaaatgtggaatatatataacttagatgctgcatatttctccaaagcaagcatccagcatataaacataagataatcatatttttccatgtttgctgaatctgaaaggataaaaaaaattaattccaagtgttgtcaaactgcaaactatgatataaagtcttaaaagatttaggccagttgccgtggctcacgcctgtaatcccaacactttgggaggcccaggtgggtggatcacctgaggtcaggagttcaagaccagcctgaccaacatggtgaaaccctgtctctactaaaaatacaaaaattagctgagtgtgggggcagacacctgtaatcccagctactcaagaggcttaggcaggagaatcgcttgaaccacccgggaggtggaggttgcagtgagcagagatcccgccaccgcactccagcctgggtgacagagcgagactccgtcacaaaaaaaaaaaaaaaaaaaaaaaaaagtctcaagagaattctaatctttacccattcttccatgttgtaatgagaagcattagtagtgttgcccaatgtgaaggaattagtgccacctgagcctgaccccacaaagacacagaaagatgcaaatacctggagttctcccaagtttggcctgagcttgttggactaggttagttaaatggtggggtgccaagtctttaaacagccagagcaaagttgaaaatagaaagcataaaggcacttaatactaataataggactgggagaatgattcttgcaaactgatttcaagtcctccattttaagacaaggctcccagggcctcaaaggttgggtattgtcaagggtatcatgcacagcaatggaagaactggcaattgaatcatggtctcccatctcacgtggtctccaacttactttatggacttctaatttaaaatctttcttttaaactcttcagttttaaaagagggtggggggaatgaacactaaaatcctaccaaggtaaaaaaaacaaaaatcctagtgcagtaataattcttaccattatattcaaatcaacaagaagcaatgaaatactcacccaaccatctgatcttcacttacaaaaaacttaacttcagtgttataatttcttacaaattatgcatagttactaaattggtaattatattatataaaagtattttttaatccaaccaaatctatttctcctgcatatcgaacacaactttgtacagctcctcatacagagcaagccttcaaaaaaccctgctattgccgggcgcggtggctcaagtctgtaatcccagcactttgggaggccaaggcgggcggattacgaggtcaggagatcgagaccatcctggctaacacggtaaaaccctgtctctactaaaaatgcaaaaaaaaattagccgggcatggtggcgggtgcctgtagtcccagctactcaggaggctgaggcaggagaatggcgtgcccggcaagcagagcttgcagtgagccaagatcgcgccactgcactccagcctgggtgacacagcaagactccgtctcaacaaaaaaaaaaaaaaaaaaaaaaaaccctgctatttagcaatatactatattgctctaatacaaaactacttcaacaaacaccaacacccatctcccccaaaaaatccttgacattcctatttgacttttgtcaagtaagaaaaaaaagccacaaacaggaaggcctactaagtatcacaaaaaatgccaactcatcaaagaagattgccttccacctgtctttcccttccggttttctattttgcttctgttactatttcttccatgactctgcaatcccacgcacacacccctgctcagtccttcacagagttaacacattctcatctgcagacctaaccaaatgtcagttccccagggaaatcctgaatcacccccaaagtcagatgaggttccccatttaatcgcttttgctcttttcccccacagaatttatcatgcagagtatttatacatttggatgtttttttttttggttcatatgctccatcccactagactctatgcttcatgccaccagtgataacgactgctttactcatcactctattcccagctactagcaaaataaccgatactgtatttaacaaatggatgttgaaaaatgaatgaacctgattttagacagcacagcaacagactagatcagtgtctttcaaactgcagttcatgactagataagtgttttcaaaatgtatgagttataaccagtactttttaaaatgaaaatgaacaaattatcataggaaaaaatagaaaagaaaatgtcagagtttactatgtgtagtaaactatatacaactaatgtctcattcaaatgtatggacaaacatttctaactatgggtcatgactaaaaagtttgaaagccactgaactaaatgtcccaataaaactcatcacaatttccagttaaaatgctcaagaaggtgcacacaaagacaaaaattggcaatagcactaaaaatatacgaggaaaaagcagccaaagtcaaggcattatttccactaactacatagtacaaaaaatgggtaagaagcatgttcttggaccatatgcacaatgcataccacaccttttgaacttcaacaagatagattctctaacaaatgtagaaaaaaatcctgagttgaactcaggaaatgcagaagatgcaactggccagataaatctgaagggcgtaatattagactgaaccgtacaaaactaccattttataggtcaagagcagtcaaataccagcaatctcatatgattcaacttaccaatgaagataatgaaaatggcagctaatacattcagtgtgctgggcatcatatatatacatatttttatatatatacacacacacatatttatatatatatttatatatacatatataatttttatatatttttatatatacataattatatatacatacatatttttatatatttatatatacataattatatatatttatatatatgggagtgtgtgtgtgtgtatatatatacacacacatatatatacacacacactttaagttctgggatacatgtgcaggtttgttacacaggtataaatgtgccatggtggtttgctgcacccataaactcgccatctacattaggtatttctcctaatgttatccctccccttgtcccccaccccccaacaggtcccagtgggtgatgttcccctccctgtgcccatatgttctcattgttcaactcccacttatgagtgagaacatgcagtgttaggttttctgttcttgtgttagtttgctgagaatgatggtttccagcttcatccaagtccccacaaaggacatgaactcaccttttttatggctgcatagtattccacagtgtatatgtgccacattttctttatccagtctatcattgatgggcatttgggttggtttcaagtctttgctattgtaaatagtgctgcaataaacatacgtgtgcatgtgtctttatagtagaatgatttataatcctttggatatatacccagtaatgggatggctgggtcaaatggtatttctggttctagatccttgaagaatcaccacactgtcttccacaatggttgaactaatttacactcccaccaacagtataaaagcattcctatttctccacatcctctccagcatctgttgattcctgactttttaatgattgccattctaactggtgtgagatggtagctcattgtggtttgatttgtatttctctaatgaccagtgatgatgagctttttttcataagtctgttggctgcataaatgtcttcttttgaaaagtgtctgttcatatccttcgcccacgttttgatggagttctttttttcttgtaaatttgttttaagctccttgtagattctggatattagccctttgtcagatgaatagattgcaaacattttctcccactctgtaggttgcctgttcactctgatgatagtttcttttgctgtgcagaagctctttagtttaattagatcccacttgtcaattttggctttggttgcaatcacttttggtgttttagtcatgaagtctttgcccatgcctgtgtcctgaatggtattgcttgggttttcttttagggtttttatggttttagttcttacatttaaatctttaatccaccttcagttaatttttgtataaggtgtaaggaaggggtccagtttcacttttctacatatggctagccagttttcccaacaccatttattaaataggaaatcctttccccattgcttgtttttgtcaggtttgtcaaaaatcagatggttgtatatgtgtggtattatttctgaggcctctgttatgttccattggtctttatatctgttttggtaccagtaatagccttgtagtatagtttgaagtcaggtagtgtgatgcctccagctttgttctttttgctcaggactgtcttggctatacgggctcttttttagttccatatgaaatttgaagtagttttttctaattctgtgaagaaagtcaatggtagcttgatgggaatagcattgaatctataaactactttgggcagtagggccattttcatgatattgattcttcctatccataacatggaatatttttccattcatttgtgtcgtctcttgtttccttgagcactggtttgtagttctccttgaagacatccttcacatcccttgtaagttgtattcctaagtattttattctctttgtagcaattgtgaatgggagttcatttatgatttggctctctgttcgtctattaatgatgtataggaatgcttgtgatttttgcacattgattttgtatcctgaggctttgctgaagttgcttatcagcttaaggagattttggctgagacgacagggttttctaaatatacaatcatgtcatttgcaaacagagacaatttgacttcctctcttcctgtatgaatatcctttatttttatctcttgcctgattgccctggccagaactttcaatactatgtcgaataggagtggtgaaagagggcatccttgttttgtgccagttttcaaagggaatgcttccagcttttacccattcagtatgatattggctgtgggtctgtcataaatagctcttattatcttgagatatgttccatcaatacctagtttattgagtgtttttagcatgaaagggtgttgaattttattgaaggccttttctgcatctattgagataatcatgtggtttttgtcattggttctgtttatgcgatggattacgtttattgatttgtatacaccgaacctgctttgcatcccagggatgaagccaacttgattgtggtggataagctttttaatgtgctgctggattcagtttgccagtattttattgaggattttcgcatcaatgttcatcagggatattggcctgaaattttctttttttgttgtgtctctgccaggttttagtatcaggatgatgctggcctcataaaatggactagggaggagtccctctttttctattatttggaatagtttcagaaggaatggtaccagctcctctttgtaactttggtggaatgcagttgtgaatctgtctggtcctgggctttttttggttggtaggctattaattactgcctcaatttcagaacgctccaccccaaatcaacaggccaggtgcggcgttcatgcctgcaatcccaacagtttgggaagtcaaggtgagagttcaagactagcctgggtaataaagcaagaccctgtctctacccaaaaaataaataaataaataaataaataaccaaacatggtggcatgtgctcacagtcccagctactcaggaagctgaagcaagaggatggtttgagcccaggagtttgaggccacagtgagctatgactgagcaactgaactccagcctgggtgacagaacaagacatggtctttaagaaacaaaacaagaaaaatattttggggaaacagcagaaaataaaaatacaattttttttaagtcctgtcctcatctaagaagtcagaagaaaagtgcaatggagaagaaaatatcaggcaagctgggtagacaggaaaggtcacacaattttaaatgtagtgatagaaagccttaactcaaagttgacctttgagttaagacatgaaaataatgagagcaggcatgtggatacctaggaaagaacatcctaggcagaaggacaaagaccaggaaaccacagtccactgtgtggataagctcaaaaatggagatcatttagagtaaggatagaactctgggaacatcaacactgaaatatgggcagagaagcacaagtcctcaaaaaaaaaaaaaaaaaaaaaaaaaagaagcaagcggagaaagggaatgactaaacataattaggtatgtttaatcagtcacacacacattaaatagtgtgactaatatgtagtcattagaaattaaaaatgaaagattttaatggcctgtgtacatacttatgatacaaaggagaatgctgttaaatattccgtaaaagcaaatatttttaaaactgcaagaaattatcccaaaatggaataagaattttttttttttttttgaggcagaatctcactctgtcacccaggctggagtgcagtggcacaaactctgctcactgcaaccttagcctcctgggttcaagagagcacatccagctaatttttgtatttttagtagagacagggttttatcatgttggccaggctggtcttgaactcctgacctcaagtgatctgcccaccttggcctcccaaagtgatgggatttccagcatgagccaccatgcctagcaagaaagtcaatcttaagtgatggaactacacatgaatccctgtacattccacatattttaaaatgagcatatactgttttttcctatcaaattgaaatgagtataatttaaaagaatcataatggcttagaaaaaagaaaactaagaataaacttgtcttttttctatcttgcatgcaaaaaggcatgccaataaaattatctaaggtgaaaataaattcttaattagaaaaagacttttttttttttttaccaagtaaaggacaaacttgtactgcatcctactttttagtaggcaactaaagcttaaaattatttgatcagacttttaaaacctctatgacaaacctttacgagtttctcaaagcgtggtctttaggctactgaaatttccaaagttcttctggaaggtttaccttttatatgacagcaatatgagactcactgccactagtcctacagtaaattaaaactatatctgcaacttcccccagacgtcaaatcaccatctaattattgtaaggatttttttccagataacaatagctggaatggggtgtttcagggattttttgttcaccccagtgggtattgttgaaatttgcaccatttccttcctatctccccaggaccacctatcaagagaagccatagtaaacgctcaacaaatgcttgataaccgataaaactactttaatctgctaaagaaaaataacctaaagaattgaaataagccttgtccttgttaaaatatatcaatcttttcactctaaaagtgctctccagcttatcacacacattttactggcatttacttctacatttagcaattatgcctgaatactgccaactgacttctcagctaaacttcaaactcaaattgccagccaccagctgaaaatctctgcctgcatggttttagacatgtctaaaactaacaagcctcactgcaacaatcatcatgctctcgtgtcctgtctggtaatggcatcaacatgcccttttttgtccacagtagtctccagtacccttctacctccacaagcttcgagattggtcccaccacttcctgccacaaaccgtcaatttcaggcactcctccccaagcctgtcactcactgggtcttcctcattactcttctgcatggaatgagctccacagaccattgaggctggcatcctgctgcaagtcatttccctcctctaaggctgacttaccctctccatcctcagatatgcagacagctctttgtttgaaacttggtttaccgtattcatcactacctacctgatcttaatcatttgagtccatatcgctccatgttcatgagctactcaagagcggggaccgtactttcttaatttttttttaattttagtgtcctcaggccaggcacggtggcttgggcctgtaaacccagcactttgagaggccgaggcgggtggttcacttgaggccaggagttcaagaccagcctggccaacacagtgaaaccccatctctaccaaaaaatacaaaaaaaattagccaggcatggtggtgcacgcctgtggtcccagctacttggaaggctgaggcaagagaattgcttgaacccaggaggcagtgagccaagatcgtgccattgcactccagcctgggcaataaagtgaggctctgcctcaaaaaaaaaaaaaaaaaaaaaaaaatttagtgtcctcagccaaacgtaaggacacagaagttctccaagatatcagctgcatgaaactaaactgacagcgtctcaaagtgaccagagaacagattgtgctaaatctggaaaagtcagtcatcttgccctagcctttgaacctttacttttctgtgcctagtcagaaagtaaagcaagcagttctctgtggaactacaataaatagtgggtacagaatgaatgcctcacttagttgacaataatccttctccccacaatcgtagtccaagaaggcaaagcatccccttaacaaaaggcaattctgtttcagttgtgttattctcttagtaagaacacaccatccttatcatctgctgattacagacttccaaggcgggggtcctcactgaatactcctacaatgaaacctgcctataatgagtaactctacctatcttctctgctccagaagtggttgaaaggcctttcattcaggccttgttttctacctaacaaaaggttcacagatgccaaacacgtgctccaaaatgcccctcctcccgtcgtctgagacccagatgaagcagggtccttgtggcaataatattctctgcaatgctttttgtcgtcttggttgtcacacagctggaaatagttttcttattcccgtttacaatagccagacattcattatcactctgacaagaactcttgagtgatgtcatgctgcacatgctgcaccagttcaagaagggcccatgcaggctcttccagcttcaaacttctcactcttgatggcagcctcaagtatagcctctctaaagcaaaagaaaatggaggcaggcacagacagatacacacacaaacatacatatgagtatgtataaacatatccacacttatcccacacacacataaatatacataaatattaatttttgtaggtttgtataagtaaaaggacaactatggaaggctatggaacaaactgatatcagatgggtaaggttaaagtggcagagagagatttttacatttactttagacacatctatagtgtttgaatcattgcaaaaaaaaattttgtaaatgaatgcagctaccctctcctggttgggatgcattttattgtgtttgtatccctgagtgacttcaagatcataagtgaaatacattagtgaagcaaagcaccatgacagggtgacttcaaaataagtattagccagatgcggtggctcacagctgtcatcccaacactttgggaggccaaggtgagaggatcccttgagcccaggagtttgagaacagcctgggtaatgtagtgagagcccatttctttaaaaaaaaaaaaagaaaaaaaaaaagaaaagaaaaagaaagaagaagaaagaaagaaaaagaaaaaaaatagccaggcatagcggcacacacctgcggtcccagctacttggaaggctgtagtgggagaatagcttgagcccaggaggtcaaagctgccgtgagccaggattatgccactgcactccaagaccctatctcaaataaataaaaaataagtctgactttctacaggcactaggtttgaattattctagaaagcaaactatatactgagcaaagaatctcaaacacaagttgggttaaaagtaagaatagggaaaatgagatggaagcaaggcagggctacagataaaacacagctatgtctatctctagactttaaaacagataaatcctagcaaaatatttcaagcatataaaatgaaaaggagattaccgggctctgtggtctccttccttaaaagggaaaggccaactcacctcaaagtattgagactaccttggagaaaatgttcctaaaatggaagaataacaagatacatatgcctgagtttgaaggcattctaaaagaacttctcttactaatgtcatatgatagagggcaagctccatgagagaaggggtctgtccacatcttgtttcctgcagtgctatcttcccagtacagggtgggtacaaatgcctactgaatatggaagaaagagtaatataaaggattaaggaacacatagtaaatgaaaactagaattaccaaccagatatcagttcttattcttattttccagatgtaaaaagagaggcactttgacctacccaggagtagcgaaactggagatagaaagcctcttgatcccttttttacctcttctaggcttggtttatctcccaggatccttccagatcctaaccttccaggagcattccctgacctccaccacctcaccgctgagggtcaagtgcccccgcttggtgctcccgcaaagtcttctctctcataacacttgttacactgaattgtaattatctgttaatcgtgtgtaagctcctcctggagggtgggaatcctgccttattcacactcacccctagtaaaactagcacaaagcctggtatatagcaggcagtcagttaagtgctcctgagatggggggaaaaaaagtttcctctgcccctgaaccatttctccctccaaagacccaggaatatccttcaattagagcagaatttcagaatcagggcagttaagggttggtcaaagagaaccacctaggcataggggaagaaaatttagtagaacagatcgatataaagtctaatctagagcattgtttagacacataagttaatgaatatagggaaacttgctataacaggaatggttcacagtagcaatctcagcatagcaaatcctaaactctaagagacatagcacacataatggccataatgaacaaaatttccttcaaccaacagctggaaatcccacccatggccaggtattattagtcaaaattttttcttttagagaaaaatgctggttttgaaaacattttcctttattttcataatacaacaaacacagcttgccctgcctcatgcaggcttattgcacgtttgttttagcactggactaaagttaagggtctgccctgtcattatatcacttttttaaaacagtatcacaaaaataaaataaattataacctaaatccatgaatgtagtaaaatagttctctttcatttctggaaaaaaataattacaattttacatggacttcagggttaaagtttctatagcactgattagatgacagggacatgcaagtattaagacaatattctttggcccagccccacaagttgataatacaacaacaacactactttgaaatcatactaacctgctaaaaaatgccaaagagtttaaataaaatcatcaccaccaccatgccacccctcctcctctcctaccaaaaatgtatcctaaaataaagtatactaaccttgggcttctccaacttaattaacttaatttattaaacatgccaaacataagttcccttgcagaagataaaacaaactgctgggaagatcattcattaaattgaattcacaaggtaattgaaagaaattcagccaccttctttttctttttctttttcttaagttttttgagatggagtctcactctgtctgcccaggctggagtgcaatggcacaatcttggctcactgcaacctctccctcctgggttcaagtgattcttctgcctcagcctcctgagtagctgggattacaggcgcccagcatcacacctggctaattttttgtatttttagtagagacagggtttcaccatgttagccaggctggtctcaaactcttgacctcaggtgatccacccgcctcagcctcccaaagtgctgggattacaggcatgagccgccgtgcccagcctcttctttttcctgtctgtctcctgggtaccctagcatctccagattcaacagcaattcaaagacatccaagtcagttccacctctgacatgcaactgaaaaccagtgtatatcctcctgtgacacagaggtactggggagcaagtgtgaacctataaagctcctgaatacctctcccaaatggatcccacagagtgaagataatgagttaaatgctttagctctagggatttaaaatatatagaaagcaagttacttctactggaagttaaacttaaagaattctcatggttatgtcatctctcactgcagtaccgagtgtgctacttggcttccctctctccttccatctactgccttgccctatcatttacagaggcattaatgccggtttcaaactaataataattctttttcttctgtgctgcaaatacccaatcactgtggttaaataccatgtataacataaacagggtcaagaatgccagctgccagaagagtcatgtttaaattagcattaaccagcaagcccttccctaaacaaaaaagagaggggaaaaaaaatgttttcttggacagctctgtgcctgcagaatgacttcaaccccacatgttcaaaaggctccacaaggtccagctataacacaatagcatcattaatttttactaaattaaatttctcaaaagtataaagcactatcaatttgcggagagtagggaggaagaaactacttattagtttattctacaacctttatataatttgagtaaacaggcaatagtgtcttaaaacgtagcagccataagttacacggattgtaatggaataaaagcccagtcctccatccatcatcgcacccctcactctgccccaatatgtgttactcagtgtctttccacatcttgaggttatgtaatacttcctccttgcctccctatccccatgtagcataactccttaaaataacatcagaggtcccccacaatttgtcccttcgtaactttccagccttcatcaccccacactctcactttgtcttcattcccccaccattcatcttttaaaagatatgttattcttcaagccacatttataaattcgtcccctgaatcaaaacgtaattctccattccctggcatgccaaagttcttggactctacagctaccacccagttacacaacactgcatatacatattcggtatgaaccgtgaggctcactgcatctttcccccctgtgttgcagttctttctggagcttccttttcaccatccttgcatctaccacatggaaggaattcaataattgtttgctgaaatagaattacctccttttctctcaactttctaagacatccataatagttttccctaagatttttttttttaagagacagagtctctctgtcacccaggctgtagtgcaatggcacaatcacagctcactgcagccttgaatcctgggctgaagccatcctccctcctccgcctcccaagtagctgagactacacgcacatgccaccatacccagctaatgtttctattttttttatagagacagagtctcactatgttgcccaggttggtctcaaactcctggcttcaagcgatcgtcctgcctcagcctcccaaagtgttgagattacaggcataagccaccacacctggcccgggatatttaaataagagggtaacatgatatgtaaaaataagaaaccaaacagtagtatgatgctgacttaaggccagagaagactattggactttaaaccaagagcttatgtttaagtttttattacatcacagttcagcttttacaataaataatgttcctcaagggtgtaggcatattgataccaaaacatcaaagaaaaggaagacaggccacacatcaaacacagacattaaaatcttgacctcaaactaaattctgaaagttctgttatctgctgaatacttggagcttcccagtgaaaatgatacagtgtattctgcccagattgcaactttccatactaagcatttgaaatgattcttggccctaaatatcacttacttcagactgaatgtcactgtgtatcaaaaacactgagcaagtgagatttttattctttgaacgttccagtaggtcactaatggaatagattcagtaaaaccttgcagcctacggtataatttgaaacaacaaaaaaatcaaatcactttttggaaaatattaggtttgaacaaaaatagaagtttcgaaagggctgccacttacattcttacctctgttagttctttcccatcactcacagggagactgaaatccatgctgagtgcccacagacctgggcaggagctgttcccttgagagacaatgatgcaaatgagtcaagtgatgcctagtagaagtcagactgcaaggatcaccttgacctcaccctagtgcattagctaagcaaactcacaagctttaaataataaaggtaacaagagattgatctgaggtgggggaagtattattgagtcccttgaggaaaggaaaaaaaaaaaaaaaagaggaaatgagctcccagctcaagaatttttctcctccaagcatcctctgttgcttgttttcttccatcttcctggccctctggacctctcacttccccctcctaccttttcctactgctctaacacaataagataacctcccaccggtttctcgctatttgggaagctggaaggaacagcaacgatcaccaaccccttccattttccggatggggagacggagaccaggatctgagctgacccgactggctgaggtcgcgccgctaggggacgtggtgtaccttgcgggctcggatgatgacaacccagccttccctcctcgctcctcgcccgtgccttcctgcctcaagctacctccttctcttgccacttggtgtttttatcctcaaatcagacaagtatcaagaaaaaaatgcaaccttaatatacttacaatgctgattattattcataattttgcatttggggcaattatactcgctcctactgggatatggaaatcaagggcagaaagaactaggtgacattctacctccctgtgtattttaatgatgtttagtttggttcaaataaccatacctctaaaatacaccctttttccttgggacccactcttctatccggcaagggaataacttcttaaaaaacttcgcattttccaagtgtacagtctccccttaaccagaactgcagactctgaatcacagacctctggcttaccaattatgcttagctgagcaaacacacttatgcaaatacgtgaaaaacaaactgttagagcctgaaggaatagaggatttcgctgtgatcatcaatatgtgatcatcacattttcaatatttatgtttaccaatatctatctaaccccataggaaacgacgcgtccatagtgaaacaagccagcacccacatttatgaaaaaatccacggatttcaacaaaaatgaagagaggagagcagaagcggagagccacaacctcaggccccagacagcaggcagcagcaagtcctgaatgccttcactcttaacattgcaaagaccaaatggcagcaaagaaaaacaagaataaactttaaatccattcaccacaaaggagtcctacgcaagtcaaaggagccgtcgatttcaaaaccatcaactttcaaagccaggtccctcccttgccttacaacctcctgttacttgttaagcacgtttgttaggcggctggacagaaacttagttaaaagtcctcagcccggtggtgggggacaaccgagtcgtcagtgggaagcgagaggtgcggagccccaggggcgcagggacccctcggaggtgcaagtccagcgggacgaggttttgggagaatttcgagggcccctcgcaagccctcccgcgcacccaccccgacccaggtaaccggaggccacctacgtgtcactgggcgggccccggggcgcactgacctggcgcgggacaggagggccggcggcccgggcggctgcggcaacttccctccaggggctcggtccgccgctgggtgcgggaggccaggggagcctcgcctcctgcaggccggctcgcaagaacgcacggccacccacccgcgccgcggcccacagcgcgcacccacactctcactggcactcgcacgcgcgcccccaaccacaaagcccgtccgcggcgggacagtgtgagcccagcgcgccgtgtggcgggccgagcagtcgccgcggcctctggcttcgcgcccagggggcgccgtccccacacgccgcgccggcccccttacctgcgctcgctgccgccgcgcgtccctctcctgccgcccccgggctggcttcaggccgcgcgcccagtcccggcggcccccgccccaccgccagccgagcccggccctccgcccgcccctcggcagtcgcccagagcggggccgccccctgcgcccaccccgccggggtcccgtgctcggccgggcggcggggagggctccgcggctccgggccctggccgccccagatccggcccgcgctccgcagcggggctggagacggagtcgccactcagggagcgtcagccgccagtcggcccctactgcccggctttggcgcgctggcaggaggagggggcgcagagggagggccagaggagcagcgccgacgccagcctcctctcttcctccgccttccttcttttctgcttgttccacgtagcacaagtcagcaacacccgaacccccagagtccgccctccccgctcccaagctggaccccttacctggtgtggcgcccccagcgcccctgacctctgcgccccctcctccattcattggctcgacagcccacggtggtggcagggccggggctggggggtggccttagcctcccattcattatctcagcagcctcccccgccccgcccccgagtcgacacacccgcagcgggagacccgtggccgccagctcgggtcccacccccgcccctcctgcgcttaccccagcgccggacagctggcaggactccggtggacgccccggcacggggcattttcacgttgtcgctctcctcttcccactcgaaaagctctggaaaacatcgcggggcccgcaaaaccccggaaatgtggcctctctttcgtggctcactttctaaactttccagaaggcgcaaagtttctcccagcgccgccctgcactggaggctgcgaagaacgcagaagcggctttgctgctaggaaggtgcatacgtttctagttctgatttttcacttcactggatctgtaaacgaaagcaagtgtgtctgctcccctagttctccatatccacgattataaatttctcttccgctttcccagtgtagctttgcaagtgtaaactatcaattttagtgagagtaattaagggcggggactgcacacctggaggtgtgggtgggagcggcgcgggactaaggcctagggaacattctcaggagagtggcagccacagggattcgcccaggtcttataacacacccactcgatggggtctccctagccacgccacctcacaacacccatctcccacttctggcttcccaggatttccggagtgatcacaattatcggcctctcgctccacagctaaggccaccgcatatcaaaaatagcagcgtgtgagtaaaagtttcatgagccctcgccttgaaatggcacagaggacacagcacaccagcagtaaggcatggggactcggcaggactgatctgattgagagaaacgcaggacagcgaggcggggctatgttggtggtggccaccaggtaaccgtgggctttgcagaagagaaaggtcactgcaaaccgtagctggacggaaacttttcaagcctcaagtgagttatgctgtgacgggaccatgaccatctcccaccggtgactgcttagaaccttgaccaagctcgtgtggttttcacaggatgctcagggctgagtcctggctgtaaataatttactatctaaagctgtttccttttaaaaacaatggttctaatcttttttttaaaaaaaatcattcaaatcttttttaaaaatccactttaaataactttgctttctatacctttcctacgaatatatgatttattttataacctactatgtgaaaaaattgaaattttagtacatgcacagtgctaatatgttcatgcacaatgctacttatgtttgtgtacggcatgcagaaatgtgtatagatatgtatacccatgaatacaaaccactcccttatctcacaaataatcataggggttgataccaaactataagaaatattatattgggatgaataggcaaatgttcactataaaatctcagtatcataaaaagtatatattggtaagaaaaaaatatactcgaaagaggtttccatatatttttaaccatagctctactcaagtcaaaaaatcacttattagctaattttcccgtctctttcttcctatacactgtacttactatcagatttcttaacaccaatacttctatatctaatataaagacattttaaaattaattatttccatgtttagcctttccccataaatcaaaggtaaagtaaaaggagtttcttacctaccactcaacttgaatatttttaatatgttgattttgtctcttaccttcttaaggaatacagttgcttctgttttgactatcttaactactctgtggccccttctaacatcaaattgggaggcctgtccgtacaagacatgtgtattcaacagtaagttatttgctataaaacacttcatttcctctttatttggtctgctgtggcctgaaatgaaatatagaacaaactgaaaggtctgcctggacagacctgtcttcctgacaagcgtggacctgtctaaatgagacagcttctgcagccagctttagatcgataactctaaaattaaatgtaggtatgtacatccagtagaaaaggacagagaaaatgaaatacaatacagaattcagttcagcatctagattaatccataaaacctagctcattatgttccaaatgagctacttttctcatctgtaaaatggaataatggtaccagtgcagtcttttatatggttccaagttgtcttttatcaaagtaaaataatatatttgggtgggcttctgaagacactaacattgatgatgaggtttcaacaggaacaaagaataccttgataaattttcttgaatgttttctcctgtctgtagtcctcttgtcattcagacattccctttcttggagagtcatcctgatgctttctgtcctaacctttctctcctcccctctgccaagcagtatttctttagatttgtttcttcaaatgacttcagcagaggtaaagacccaaagacagctggcgctgtcaaacatgacaaaaaatattcttagccacagtggctcatgcttgtaatcccagcattttgggaggctgaggcgagaggagcgcttgagcccaggagttcgaagctgcagtgagctgccattgtgccactgcactccagcctgggcaacagccaggccctgtctcttaaaaagttttaaaatttttaaatatatatgtatgttcagcaaaatgaagccaggcatggtggctcacacctgtaatcccagcaccttgggaggccaaggtgggcagatcgcttgaggccaagagtttgagaccagcctggccaacatgtctgtctctactaaaaccctgtctctactaaaaatataaaaattagccggcatggtggtgcatgcctgtagtcccagctgttgggaggctgaggcataagaatctcttgaacttgggagagagaggttgcagtgagccaagattgcaccactgcactccagcctgggcaacagaacaagactgtgtctcagaaaaagttcagcaaaatgaaacattgtgatggatatttcaagttcaggttttacattaatatctggaaggacaccatagactttgtcagactattgatataagctagtgatccaaggactataatttgagaagcatttcgggtggaaaaattggctgtcactgcctttggcactattatttgttcaaaaggttccccagtcatggcacactcatggaagagttctctcttcctccctctgttcgcttccctctggcaaaaagcttttgaaattttctgttcgagagtaatcaaaactatcagcaaaacgatctgttggaaactttccctccagtctattaaggtagagactgattcaaagacagtattttggtgaaacaataccctgagagaactcagccttttccggaaagttttgcagatgatgcctccaggcatagttttcttcctccttgaaatggggtatttgtgcctctccagtgtttttccccttggctaggggggaaaaaaaagcattctccttaggaaacctttctattttaaaagtccagcggcaaaggtgggtggggcagcccaatttagtaaaaagtaataataataacactcttcagagtgcaggtggcataaggagattccaagaatggagagaatttgggtttgcatgcagcagcctcctgcaaggactaggctgcaatgaaagccccaaacagagtaactctgtgttcacctttttcttatcacatacatctgcatgaatactctgggtaacatcagaagtaggtcaaggctagcagatcctttctctgtagtctccctcatccaaaataaaaaaggcttagatctaaaacagagtgaagaaagacaaggaaaaggaaaaaaatatatgtgtgttatatatacaactataaagctaaaaatggatctggatacaaagaaatcatagaaagggtcaacaaaacaaaaacctagttctatagaacaatagcaagatagataaatttctggtaaaattgacaatgaaaaaagagaaaagaaggctatgaatatggagattataattacagtttcagtagaattttttaaatcctaagaatactatgaacattaaaaaacttggctgaaatactttcttcaataaattaatttttaattcaataaaagatgaaaattaaaataatacatgattttacattttcctttgttgacaaagatttcttttaaataatgatacttgaaaaataggtgtaaactcatgcaaactctctgtaatgtaatttagcaaaacagtacagttacattttgtatgattttaattgaagtacatttatttaagacggagtttcactcttgttgtccaggctgcaatggcacaatcttggctcaccacaacctccacctcctgggttcaagtgattctcctgcctcagcctcccgagtagctggcattacaggcgtgcgctaccatgcccagctaattttgtatttttagtagaaacggggtttctccatgttggtcaggctggtctcgaactcccgatctcaggtgatctgcccacctcggcctcccaaaatgctgggattacaggcatgagccacggcacctggccaaagtacatttaaatgtatgataaacacatcaagaaaattttactttatgtgcaaaatttttaaataatacaaagctcagtatttttaaaacttgaaaaacagcaaaattacagagctgaaatactttttaataaattgtaaaattgcattaattcaaaaataatacaaatgtatttaaaaccattaaataatttaaattcttatttctaaataaatatgcaaaaaagttcaaagttttggttggtaagacttaccaaatcttcatggacaaataacctctattcaaatggttgcaaagcatagaaaaagaaaaaaagcaccccagtccattataagctaataaaattttgataccaaaacctgacaaagccatagaaaagaaaatactagaccaatctaataaggaataaaaaatgataaattctacatatagtattattaaaccaatttcaatgtgttttcacaatatgcataataaacatattgggttgataccataaatgtaaagatggcttaatattagaaaatgtggcgggatgcagtggctcacgcctgtaatcccagcactttgggaggctgaggtgggcagatcacgaggtcaggagttcaagaccagcctgaccaacatagtgaaaccccatctctactaaaaatacaaaaattagccaggcgtggtggcgcacgcctgtagtcccagctactcaggaggctgaggcaaaagaatcacttgaacctgggaggtggaggttgcagtgagccaagatcgcacccctgcactccagcctgtgtgagactccaggggaaaaaaaaaaaaaaaatatatatatatatatatatatacacacacatatatatatatacacctatatacgtatatatatgtacatatatacgtatataggtgtatatatatatacgtacatgtttcatgttcaggaaattcctccctattactactttgctaagataaaaaaatgagttgtgaattactttacattttcatatatatatatgtatatacatgtacacatatacgtaagtgtacatatatgtatatatgtatatgtgtaatatatacgtatatatgtatgtacatatatacgtatgtatatatatgaaaatgtaaagtaattcacaactcatttttttatcttagcaaagtaggaatagggaggaatttcctgaacatgatagagttgctaccaataacccaactccagaagcattatttttaatgttaattcattcaatatttttctttcaaaattgacaacaaaacaaagatagcttttgccatctccattcaacattgtactgaagccacttgtcaatataataagacaagaaaaacaaattagaaggtatgaaagttagaaaacaagaaaaatatgatttataggttatatagttgtctgcttaagaaatccaagcaaatccaataaagtatctaataaagagagcttagcaacattgttgaatatgagatcaatatgcaaaaaagccacacccccttagaaaaaataatttttgaaaggcctctcacacatattgatacagaatggctgagctcctggctaaaccccaccctcaagcctagaacccctaacctaagtgaaaacagccgatcctgaagggctgggcttctggctaaacctcaccctcaagcctggaaccttggccctaagtgaaaacagctgaccccatttttcgtcccaaataattgccttttggcccaccctgccccctatcctgtgcccataaaaaccagaccagctggcagaaaaaaaaaaggaaaagagaagcacaagcagctgactggcggggatacaagcagccaagcagcaagcagagaggcaactaagcatcagaggctatggataaatgtggctaacttcagagggtgcagtttcagaagggtgcccagcaagagacagctgggcttcagggaaagatcacctttttcccacaccatcccctttccagctcccctttcaccaagagccacttccactgctcaataaagtcttctgcattcatcttttaaacagttcatttgacctgattctccctggacaccaaacaagaactcagggtcaaaaagggcaggtgcaggaggctgtcaccctgacccttcactgagctgttaacacttagccatccatggactgcaggctgagtgaaatgagccactccattcctgtccatgaagggggtcaaggtcaagggaacaaataccatctcaatattagcaacaaatttttttaatttttttatttttttttgagatggagtctagctatgttgcccagactggagtgcagtggcactatctcggctcactgcaacttctgccttccaggttcaagtcattctcctgcctcagcctcctgagtagctgggattacaggcatgcaccaccacgcccagctaattttgtatgtttagtagagacggggttttaccattttggccaggctggttttgaactcctgggctccagtgatctgcccaccttggcctcacagagtgctgggattacaggcatgagccactgtgcctggcccatattagcaacaagtctttattataactttaatggaaactaacaggaaagtacagtgcctatatggaaaattataaaactttattaaaatacataaaaaggcctgaatatgcaccgtgtttgtggatgcaaaacctccaatatatgtaatgcaatctactcaaaattgcaatagggtttttcacagcccctgacaacttgattctaaaattcaagggtaagcctaataagccaagaataatcaagagaattctggagaagcttaaggagggaaaattttccatccagctatcaagataatctaaggcttctttctcaaattaaaaaaaataataataatgtggtattggtgcagtggctgataacgtagcgaaagagaattcagaaacaactacatgtaaatgtccaagtccatgtaaattcatacatcaaagatgatttgcttaaaacaacaaagctgaaggccaccctacccaacttccaactatacaacagggctacggtaaccaaaacagcatgatactggtacaaaaacagacacatagaccaatggaacagaataaagaactgagaaataagactgcacacctacaactatctgatctttgactaacctgacaaaaacaagcaatggggaaaggattcccttttcaataaatggtgctgggataaccggctagccatatgcagaagattgaaactggaccctttccttacactatataccaaaattaactcaatatggattaaagacttaaatgtaaaaccccaaactataaaaaccccttgaagactgcctagacaatatcactcaggacataggcacaggtaaagatttcatgatgaagacaccaaatgcaaaaattggcaaatgggatctaatcaaactaaagcgcttctgcagagcaaaagaaactatcaacacagtaaacaacctaccgaatgagagaacatttttgcaaactttgcatctgacaaaggtgtaatatccagcctctataaggaacttaaacaaatttacaagaaaaaaacaagcaaccccattgaaaagtgggcaaagaacacagacatttttcaaaagaagacatacatgcagccaacaatcatatgaaaaaaaagctcaacatctctgatcattggaaaaatgcaaatcaaaaccacaatgaggtaccataccatcttacaccggtcagaatggttattattaaaaattcaaagaataacagatgctggtgaggttgtggaggaaaaaaaaaaacagtgtatacactgttggtgggagtgtaaattagttcaaccattctggaagacagggtggcaagtcctcaaagacccaaagacagaaatgccattcaacccagcaatcccattactgggaatatacccaaaggaatacagaaatcattccattataaggacacatgcacacatatgttcattgaagcactattcacaatagcaaagacatgcagtcaacctaaatgcccatcagtgacagatgggctaaagaaaatgtggataaagaaaatgtggtacatatacgccatggaatactatgcagccataacaaggaatgagatcttgtcctttgcagggacatggatggagctagaggccattatccttagcaaattaatgcaggaatagaaaaccaaacaccgcatattctcacttataagtgagagctaaatgatgacaacacatggacacatagaggggaacaaaacacactggggcctattggagtgtggagggtgggaggagggagaggatcaggaaaaataactaataggtactgggcttaatacctgggtgatgaaatagtctgtacaacaaacccccatgacacaactttacctatgtaacaaacctgcacatgtacccctgaacttaaaataaaagctaaaaaaaaaacatgtgttgttgcttaataaatgatgctgagataattggcactttatatacaggaaaaaaatcagttctctacatcacgctattttttaaaaggttgttaaccttttaaacataggttttgacatagggatccgatatttcttcctctttaagaacctttaaaaaatagtgtgacatagggatctgatattttttcctctataagaaccttttaaaaagtag

SEQ ID NO: 265 - DNA, 75828 bp, Homo sapiens
gtagaaggaggcatttgggtacagatttgaaggagctgaggaagtaagccatgtgcagatatatgggagaggaaccaagagcacaagggccctgaggcagtagcatccctggcatgttcaaggacaagcaagaggatgatgtaatgggaatggtgtgagtgagggggagagtagaaggaggagaggtaaagaggtgacggggtaaatcgtgaaggtcgctgacatcactttaataagatgggaagccactgcaaagttcagagtggggagtgacatgacttgacttgaattgtaaaaggctcactctggctggagtgtggagaataaatgtaggaaagaagggtaggggctggaagaccaatgagagggtatgcaggaatccaggcaagagatcaaggtagcgcagaccaagaaatagcatggggggctgtgagaagtggtcagattctggttttacattaaaaagaaacaaggcagtttgttgacatattggacaaaaagtgtgagaaaaagagaagtgaaagaggagtctaagatttttgaccggagcaatctaaagaatcgtgttaccatcaactgagatgggaaagactgagggtagagttgtttgggggcaggaagaaatgtatgtgagctgtttaagtgaaattttctacatgagtttggagtttgagagggagaggtcttggccatagatagagatttgggagttgtccacatatagatgttatttagagccatatgattggatcagattatgaaaagagtgagggtagatagaaaaaagaactggacaagcggcagtgccctccagcatttacaagccagggagaagagtaaaaaccagtaaaagagacttggaaggggcaaccaagggaatatggtgtcctggaagccagtgagctgtgtcctctatggtgctagagtctgcatttaactctgtgggaatttcctccatgtgatgacaatggagtcaaccccttagcagtccaggtgacaccagtcctagcactcccagttacccttaacacgtcctctctagctaaacatattttgcctttctgcattcttctgtaagggaaccaaatggattttaataattaaaaaataataatggaaacaaaaatcatggagtatgcttcaggatagcaataataatttttaaaggatgtctgtaattcatttatataatctacagaacatgtgtatctcatacacaaatgtccttgaagtcattggttcttcggaaaattctagttggttccatagcaataatgagttttataccatatgctgcaagatgtataaaggcaatccaagtggcactttttgatagtcataaatctggtgagagacagcataggcaatcggtgagtatgttgctcctttcttgcttcacagtatttttttttttttttttttttgagatggagtctcactctgttacccaggctggaatgcagtggcacaatcttggctcactgcaacctctgcctcctgggttcaagcgattctcctgcctcggcctcccgagtagctgggactacaggcacacaccactacgcccggctaattttttgtattttagtagagacgatgtttcactgtgttgcccaggctggtcgcggactcctgagctcaggcaatctgcccacctcggcctcccaaagtgctgggattacaggcgtgagccaccgtgcccggcctattgcttcacagtatttactggaagagccttagtcattaatgtaagtgctttttgagctcagggtccattttatttccctcactatctttctcggttcccagcacactgttcagcccatggtagatactttatacaagtttgctctataaatggttgaatagtgcaagctgcatcaatgagtgacttaaactaaaaagactttcttgggacagaaactgaaactcagacaagcataacaattacacttagaagttgccttttatgttgaatttattgcatactttctggttgggtcatttgtagtccttttctttctgtaacaacaacaacaacaaaacccaaaagtgaatgctttctacccaaggacaggcaagatacatgccaccttatttgaaccacatgtatctcccaaaggaatacctaggcaaagaaaggagaaatgcagctttctaatcagcagcgctgatgaggacagatgctagtttatttttcatacaccccatttttttccatgattttacattgactgtgagcacacatattttatttttcatgctctaattcaggaattatgattttccatattatcaaagcaaaaaaaaaatctctgtgagaaggcaagcaaagcaatgttgtcactgagcacatcacacaggtgcagatgagaagctgtatccacaggccaaaggggcataaaatagagtgactctgcaaaccaatcaaaaggaccatttccataagcatccatcttattaaatgtatcatcaacaatctacctagggcctctttctgtgggagaagtggggaagataaagattcattttgtcagtatattgtagtttttcttatgattcttagctgtgtctagaattttttttcagcattcagacagacagctataaaactgattggcttgaaagccaaataaaataaaacacagtagcctactttatcatttaacactagctatttattatgagcagtgctgtgttgggatatcgaccctgagattaaagctggggaaatatagattctgagattctgtggacacataaagctcccaagccatggtgacaaataataatgagcttatactcaggggccatcttttatctcaatggagcccaacagctatcattttttaaaaataatgaattgtataaacaatgcagggaacattcacttagctattctgcaatgcaacttccttgggccctgagtacatgctcagccgcccagccaactggccattgaagacagacactctcctaattcatttattccttggttggttggttagatcattcattctttcatttatttcaacccatttggccctgggaggcatccttctccctgaatattccctgaattcctcatgttctttcttgcctccagagctttttttcctctagctaggaaaccctcttacatctccaaaataaaaattctactgctcctttaacacacaactgaagtcacacatcttccacaaaatcttaagcaataatcttagagtaaattgtttctggattcaaatcctggccttactccttattagttgtggacctgtgggcaactcacatcctcattctcagtctcagcatatttactctaaagtagaggttaaaattcttatctccaacagttgtttcaagactaagcatatacagtgtttaacacaatccctaacccattgtaggtactcaatcaatgttggttccccctccttggctcctgttctctgaattacaatagcagttaaatttatagcttacgcttatgtaattaaacatacactgaatttttcacagctgtatttcctggagctcaggctcttcactgtaccttcccttcaccctcttgctttaatccatggttcccaaccctggctgcacatgacaatcactttgggtgtatctatggttgggcccaaaccccagagattttgatttaattagtggagcccagacattgcctgacaaaataattcaactctgtctacagcataacgacatccaggcagctagatgggctggaaaggacatatggcctttctgaatggtagcaccttaaatctgtgccccccagcctcactgagggggacttggtctagcagccctactaagtctcctggtccactcactgccctactcctcgggagcgtgatttcttaccttctcatctcctcaaacctcctcctttaccattaccctctgctaatgatctggggcactcactgataagacaggagagaaaaaagtgaacattctcaccctatcttctaactccctgcattcatactctatcttcctcttcttactatggatggaatgtccctgttcaggtcaaaaaccagactcctccacctatatcctaaagcccattccttccagcaattgtcaccgctcacctgagttatcacttattccacctgtatacgtcccacactgggtcattcccaccaagagctaatatgctgtaataattcccatcttaaacccctccctcgacctcatatgcccctttaactattgccccatatctctggtcccttgtcaggaaaaaacaaacgaaaacctcaaaaatagcctgtcctcactgtctccaatcctctcctttcgttctcccttgaactccttccagttaggctttcacccctttcactctactgaaacagttttgtcagggtcaccaataaccaccaataacctctcaagccttgacttgcagtatctgacatggttgttctctcctgggtctccactgacttctagctctcttcctataccactggcttctccttctcaatctccttaccaactcctcatttctctgagttcaaacattggcagccctcagacctgttgtaatctctatcaacactcactgtttaagcgattttgtctaatcttatgacctcaaacagcatccatatactggtgattgatatctcctgtgtggacctcttccctgagctttgtatttacctggctgccttcttgacatctccacctgattgtgtctctgtgacattcaatgtcatacatctaaaatggaattcctgattcccacccactcccaaatctgctgctcctagcattttctctatctcaggaaaaagcaattccacttttgtggtagttttaaccaaaatttttgaagtcatccttaaaacacatctcttggtaccatagccaatccatcaacaaattctacattatacatgtttttcaatattattcacacctataactttaaatcactatatagaatccatcaataataataacagcaaatacacagtgcccagcactattctaagtgctttacataaaacttaatctccacaaaaactctgagataggcatgattgctattcccattttacaataagaattgaggcacaaaggaacttgcccaaagacacaaagctagccagtaaaagagctaagatgaaaatctaagcaatttggttccagagtccatgtacttgactacagtgctttatatttatcctgtacttaaatatttagattgtttagaagtttccagttcctataaatcacgtcattttagccacctttgtgtacaaaacctcttcctaatttagaacaatttcttcaacatacattctcgggagctgaattactcaaaaagcacaaacactcttaatccctaaaataggctaattctcagtaaacattggctctttgaaatctgaatttatatccagtcattcagaaactaggtttgtttttttttttctgaatagagaaggcctaaaggagagcttagagagcagtttgatccttgatttaatcactatgtattctgctcattcaatcttccagtctttattttcttcatctgcaaaatcaagatcatccctaagtcacaacttcccccacgatgcactaatgagactcttatttctatattaaaatgttggtcttatttcccacaaatcctgaaactttgatctattattgttccatcctaagaaggttttgatccattgcatcttttaagatcatagaacaccgagtctgacttttaaagtgactttgcatatccaaattttacacctccctttgctcattcgttattgtttcaagaccctattctactcaccatctggaaagctaaaggaaagattatgtattgatgtatttgccatggttttatattaactgtgaccacacatattttatttatcatgctctaaactcaattttgatatcacagatttggatattgaatagctaatgataagtgaagtatgatttttttttgaggtggagtctcactctgttgccaggctggagtacagtggctacatctcagctcactgcaacctctgccttcctggttcaagtgattctcctccctcagcctcctgagtagctgggattacaagcatgcgccaccatgccctgataatttttgtatttttagtagagacgaggtttcaccatgttggccaggatggtctccatctcctggcctcgtgatccacccacctcagcctcccaaagtgctgggattccaggtgtgagccaccgcgcctggcctgatgttatattctttttaggcttttttccgttcagcctttggatgatccctatactacaatgtggaactcctatgttatatgtaccaatatattattattattattattatcattattattattatttatttttttgagatggagtctcgccctgtcacccaggctggagggcaatggcacaatctcgactcactgcaacctccgcctcctgagttcaaatgattctcctgcctcagcctcccgagtagctgagattacaggcgtccgccaccacgcccagctaacttttgtatttttagtagagatggggtttcaccatgttggccaggctggtctcgaactcctgaccttgtgatctgcccgcctcgacctcccaaagtgctgggattacaggtgtgagccaccatgcccggccccagcattttatttttaagaaaattttcaccttactctaaaactgttatattatcttcttccctcagtcataaaaaactaatacaattgttcttagaaaggagaaagttccagaagccaagaagacccctctccccttcatttgtttccttctctgtgtgccagcttgtctgctgacagtgagttttattgctgttcctttctatgctgtcccctgtatctgaaaggctggaagcctgggaactatatttcccagaatacacacccagtaaatatctcagacaattactagagatgaggagggcagagggaagcagaacacatattcttctactagtggcagatttgagagtttggagtggcctgtggtgtccttccacaactcacagcctcagggggcactttccagtagtttctgacctgtgtggcaataattccctaaaagttaactgcaaatctgagagctaactatgggcttcctttgcctttgtttcctctagcctttccaactgttttataagcatctgtctgttttcgataccttcctgcttcaaatacccagagtggcttctgtttttctgactgaatactgactgataagtcccatctttaagacttatgtaaacctgtggtcagacatccacctaagcaagataaaacagaacaaacaaataagtctagtttacatcatcagtatcagatccccaaatcataaactgtaaaatgtctttaacccaaaaagaagcctatttagccggatgtggtggctcacacctgtaatcccagcactttgggaggctgaggtgggtgggtggattgcttgagctcaggagttcacgaccagcttgggcaagatggcaaaactccatctctacaaaaaccacaaaaattagccaggcgtgatggcgttcacctgtagtcccagctactcggggggctgagatgggaggattgctcgagcttgggaggcggaggttgaagtgagctgagatcgcgacaccagcctgggtaacagagtgagactctgtctcaaaaaaaagagaaagaaaaaagaaaaaaagaagcctgcttatatgatttccttttattcctctaggtctcagataattatatatcaaattacagaggcccaatctaaaaaccccaatgccaatagccaatatcaccagtgttccagtataatgccttgagggtggctaaagcaatacaaacatgtccatccttcatatttcacctccctttcactttagttctcttatttgtgtacttgtgcatatgcttgatttatgatttttgttttttcttttaagagcaggtttttttgggggaatgggtctccagcacctaggaaatgttctaaagatgttggttaaattaaatgtaaaataaatgtgtggttttctattaggcttgatggagtaaacagcagctgacacatatcaaattaagttcactcaggaaacataagcaaatcatcaagctcttaggttttccatatgggatggcggttccattttattttgaaaatcctttttcccctgtattgatgatgaatttatgatgacatatctcacacctgcctgaggcacacagattttaggttatctccctaggtaattctgatgcacactaaagcttgatgcagcaaatgaaaacagagctccttttctttgaaatctctatgccaagagtgaaatgcacagaatccaaagacttgggtctcttttccaggattcacatttgggagacgaagcacagaaagtgaattttggagctgaaaaggtccttataggtcatttaatttaagcctctcatttagaagatcagcactcatatctagagtttctttggcattttagggcagaacagaattcagaacacaggtattttgaatttcagtccgatgtgttatctccatgtgtcagctgtactgtggacaggcatacgtattagcagagttttctggctggtagcagtaaagtttttccaatagatgcaagcatcttgaggaagagatatcatttttctaatatgcacaaagatgtaacatgggcttgtggcaggcagccctccccctttttctttcatatatcttattaatatacagtgtggaggctctaacctcaataacaaaatacaatacagatgcattttaagaaaatttgaattatacaaagttgaaattgctgattcagaaaaatattacaaagttttgctgcataaaattgcaacttcctaaacaactgccaaggactgcaaattataaaatgggctggtgcagtgaattgcaaaccatgttcatggactgtcatgcagaggcgctgcattgcagtagtaggatgtgacccacgcttttattgacgtacactggaacctgcctgcatgtgattccagtgaccgttgtgctattatttgtacaataaacttgtatttaatttaattaataattaattcatttatttttgagacagagtcttactctgtcacccaggctggagtgtggcagcacaatctcagctcactgcaacctccacctcctaggttcaagcgattctcctgcctcagcccgacgagtagctgggattacaggtgtgcaccatcacacctggctaatttttgtatttttagtagagacagggtgggtttctccatgtggccaggctggtcttgaactcttgagctcaagcgatctgcctgcctcaggctcccaaagtgctgggattacaggcatgagccaccatgctcagcctgcactataaacctttaactcagtagttatagataacataacactctgaacctctaacaactgccattagtagcttaccatctgttaatttaggagcaagcatacaccagaaagcactgaagagaatggtgtaaagataaaatatggcattagggccaaaaaaagaaaataacccacatcaacaacatctcccatcgaatgtttatttatctgtgaaaactagccttaaattatgagtatttcaaaccatttaatgagttcaggagggcatccctcacacaaaaattcagcttccctgactttaaaaactcttctttactcctaagcctgaaagacaatgtgtaaaattggaaggagcctaggggtttccaatttaacacatttctggtccacaaagggataaaattctctggtaagtctcctagaagtcagatctgcttttgcctgtttttaattccttttagcatacagtgagatgcatcatcatgtgtttttactccaggctctaacagggccggagtttgtcactaagtcaccttcacggcatcttcacagacctcaccttcattaagtctgctcaaccaattaaaaaagagagccaagtaatcttattgtccccttcccagaatgattagaggattaatgagctaaacaaaacactctcaagctcaggaggaacactggtctacaaacacggagcatggcacgctctgtggtctccaaggggtgacatctgcagatgaagagaaccgcaccccctgcagcgcctgatgctgctgccgccaactctgtcgggtccttggtcttggtccatccaaccggggccgagcgtgtgctcagtatgctgatgaagctgggacaccagaatttctaaattttaattagtatgtataaaaagcatcaaggggctgagtgtgaggaaaattagaactttactggaggcttacatttattttaaggtttggtattgtttttatttggaattacatgaatgggggcagggtggtgtgataatcatttccgtgcttagggcttctcaaggtcacaaactggttccaggcttactactcacttgaaaaaaaattcaccaaaaaattcaacaatttatttccacaggattatttctttccaagcaagctgtcttcatgaagtactaaattctttcaccagtacagatttatcagaacatcttggacagtgctacaaatctaagaagaaaattaaatatcatttagctagggagtagcctctgctttgagtcaagggctggtctgatgaggtctagatgaaattttcaggaccaccatattgataacttgcagataagctttggatcctagaatctgaggacacacaaacacacagaaagggccaggtctgtcaagggtccttggtgagctctgtgacccctgccactcgtcatttctaaatattcccgacttccttactcttgtgcccttgctgagatgtgtgtgtgcatacaaacaaaagctatatatttctaccctgagtttccacactttggaccccctccagacaccattctgaatatgacactctgctgcagggtactaaaaattgttctttcctcaaaataaaacctttaaagatcccttagtagctatttggggactggaattcaatttcagttctccaccctttggccagctatagattcaaaatgcttacataaaacattgagagtatgtacttcatggcaaatttgatttttcttctgcaatagaaatttatgctgtagttaccacaaactatatttttacttagaaaatacacaaagcaataatgcacctcaacaagagagaacagatcttttaaaattttattttataggtagcttcgataaaagcttcagatagacccacatactatacagagtttgtgaaatctacactttcaaatcataatattctctattttaggctattatatttagaagcatgacatctcaaatccttttattacaagtagttcttgcacataaatgttatatcacaatagcaaaaaaatgtaaacttcttttgcaaactacataaatactataatatctaccttgaagttattctcattttaaatcagaatacactctaaatgttttacatagaaaactctcgttggtagcctgtgtgtatgaaacatcattttttctttcttaactacttgtctttcatgttgcctacttaggtctctgaaggagaaaaattcaaaatagaacccagatcaaaattcagttcacatgtaagccaggtaccagaaggatgccattaaccttgggaaaaataagagatgggaaattattctacatgctaaatccaacatgccaccagttggtatggaggtaactgaagataaggactggggtcaagctcatatttcattctatatggaagggattcagcctgctcttcaatacagcttttactctgatgtataaaaacatctgttctcaaatgaacacctctttctcttttcttgtacagcacaacagatcattgctacagctctagtcctagactggaaagtctaggtggcccgtgaattgatttcaccttcgctgtccttcgagtttttaaatgcaaagtgaagttgtttaaatatacacatgtgttccctgacattctctagtctttttttttttttttttttttttttgagacagagtcttgctctgtcacccagactagagtgcagtgctgcgatcttggctcactctgcaacctccacctcccgggttcaagtgattcttatgcctcagcttcccaagtacctggtattacaggcatgtgccaccatgcctggctagtttttgtatttttagtaaagatgcaatttcaccacattgcccaggctggtctcatactcctggcctcaagtgatccacctgcctcagcctcccaaagtgctgggattacaggcatgagccagcgtgcctgacctctctccttgattcttaacattgttctttggtcctcttattcctctgtccttttgctgggttttctctacctgctccttaaacgttggtgttctcttggcttcttttgctcttactaggcaagattatcagctggatgttccataggcacttcaaacttcacattctcttctccttgttttctgcataaaccctttactagctctccactgtttttcaccatcatgagggaaaatgagaactaatgtggactggcgggaggcagtctggggcggtaaccccgtatctgaaatactccagggatccatgtttctttcaatagtcagattaagcattccccaatccaatccccagatatctttgaacaaaatcaataaaaatcagtaaaaacaggaatatatatatatatatatatatatatatatatagacacacacacacacacacacacacatgcatatacacacacatgcatggaggaccatactaaggcctttttcaggtcaaaaagggttttcacattgaccttttttacttttaagtatttttcctcagaatgttccttcagttaaaaatcaggtttaatctggagctcttactgatttttctttgattcctactgaacacctagctactggccatggtttctttgaggaaaaaaacaccattgctgaagcatttctaaacatttttaatgcatgcagaaagaactacatagactctccaagcagctatataaggtggctcaagtaacattatgatttattttggtctaagccctttcataacgtccttttaaaatacaaagagaatggctacgaaatggtgccagaacccagaaggcccagctggactgacaggagctctgagcagttcataggacaagcagggacccgccgaacctctcccgtttctgtgctttctctaaatgcagcaggtcctctctttactgcccatgcttttaaactatgaaaaaaaattttttaaagaaatctagcagtgattaatggagacctcaaataacactgtacatgggctttgttagagacaggtaatcattcttaacagctcttttcccagaggaggcctgggtgggccgagaggcatccagagtttaggaagtgcttttattgcagactgcaccttggctaatactatcctctatgtactggctgcctgtgtcactcctgctgaggactgtggaggggatgcgagagggacgcctctctgggttctcctgagagaagcagcagatcatcttcttcatggtgccatacatgtcctcgtccttgtaggagtagatgatggggttcacgacggagttgagcagcgccagcagcaggaaccaccttttcacatgctgcacgccacactgcctgcagttcaggccgtcgaggagcagaaccaccaggcccggggtccagcataccacaaacgcccctgcaaggagagaagaggaggcaacagatgctcagaccttaggggacttattcaggttttcttctctcccagcctttagccagtggcatcaaggggccctcatgatttgttttgacaactgcaaggcaaacttccacctaccatctgagcatttgagacctacgcttggtacaggcaaataggtgggaacctccttgactatcaatcacatttcatttcactttcttttctgcttacccaggtcttgtgattatgagagactcacatttacattctgcttaggaggcagtgcacatgcatgatctccgttagttctctgaaccacactgggaggctttgttgcactcattatccacattggacagataagaaaaccaaggcccaattctagggggagatgagaggagaactctctgactccagggctcccatacttcaccctacattctgctgttacagaaatcagattttctaaatgtgctcttgaaaataagacacaatgagtctacggcattcttctagtagtttaaccaaatcacctgctcataaatttcattcttcataaattcatgtggatgcttagtaagcactatattctttttgacatattcacgggccatctgcataatcatctgctctacatttagattttttggtcagaaataaatctttcatgatgagatagttaaaaatctacttttcagactctgcaattgaatatgaaccgtagtctcttctgagtctctagccacagcatcatacttaccttatctctaaatttcatgatatttttctcccattaagacatgggtccactatttccctactattatcataacctcagatagcaataacgactcatctttatacagcacttactataagcgaggcactggtgcaaacgctttccttgattaactcacaggaccacactatgacattggcattattattatccccaggaaaccgaggcacaagagaagttaagtaacttgcctatgatcaaataactcttaagagacacgattttgaacagaggccgtctttctccacaggctgtgccctgggccactatatgacccgcctctgtagtatgatgtggttgctttcggcgaatgtccttgtcatttctaaatgcacttgcttgtccactcataaatattcatctgaagctaacaatgtgccaggagctgtactagacagtgagtgaggtgaaggccacgcactcagggagctaaaatactaacagagaagacgacaaacaagcaagtctatagatgatatcaccaactactctacttgttagaattagttctgcatagtatttctcttgttgctttatcttacttctaagagatataataccaagcagggaaagacaaggattataaagaggcagtgtaaggcagggaagagccacgaactttggggtcagacatgtatgcacagctcaacctatgagtgacccgaattatgggaattacttcacttttctcagcctccattccctcctttatacaataaagttaataaacccaactatgtgaggtggtagttgtgaggatcagaggtcatggaaagtggtacccaacactgtggtgggttcactgagcagcagttatcatgaggtgctctgtttccacaaaaaatatctatatgtttagtagctagcaggggggttgaattccttatttcataattacggttcagcagtggttcccttttttctccaccttgtattattattttcggtctggctgatatatgtgaataaagaactggacttggagataagagatcagagatttgggttctaattcttcacttactgtacaactctgggagacccatgtcattgcgctgggctcagcttcctcagctgtaaactgaggactgactttaggctaggtctgagtttttctagtggtgggtcagaacttgttagtgggtgtgcaatcaatgtgacagattcagactggttttttgttttattcagactggtttgaaacaagtgaaggaactggatgggcagccaagtttgcaactaccaacttgagaattcatattagtaagtttttagccataccacccgataattgtgtctgagaaacaaacaagtcaaatttgtttgagttttatggagagttaaaagccacagtttcacagaattcggcagtttcctacttggaaaagagttcagaagccgcttagcctgatctttcattcataggaaaaaggccttccctttgtacatctcagaacaatccaggcaaaggaaatgccctggtcaagggaggctcttcaactgctgaacaatggtttcttctcttaaataacttcatttaggctgggcgtggtggctcacatctataattccagcactttgggaggctgaggtgggtggatcacccaggtcaggagttcgagaccagcctggccaacatggtgaaaccctgtctctactaaaatgcaaaaaattagctgggcatggtggcaggcacctgtagtcccagctgcttggaagactgaggcaggaggattgtttgaacccaggaggcgaagttgcagtgaaccgagattgtgccactgcactccagcctgggcaatagagcaagactccatctccaaaaaagtaaaaagcaaaaaaatatataaatatcttcatttacttgaaaagaaggcttgcatccaaactctgcctgttgtactcttccatttgttttgtgtgatcctctgcaatagcccaggaaaagtctgtgctttctctatgtgatgcccttcaggtttttgaagacagttaacgctttctgtctttctttagccttttctccaggagacacatattgaattttatctactagttcccagatgcgtacctctggacactcattcatatttgttaatgctgagaattttttttttaaagtaatctgggcatcacacaaactcttctttgaaccctgctggttcccagcagtcatagtctgagcattgaggctaaatactcaaaagacattccttttagtttttttcttctggatttatgtagattggtaggcaactaagtgataaatattttccaggatctatcacacacacacacacacacacacacacacacccctcacttttaagaattagtccagttacctgtttgaatgttcctgacatctccacattctctatgaattctccaagactacagagcctagggtgtggaggtgcgtggggaggacttatgtttaactgctaacatagagcaaaccccctcaaagtatgaactgttagataaactgtgcatctcttctgagatgtgtttggagagagatcttggcctccaggtggaggaggcttggaacagctgtttcccagggtcactgccggggagcatctgcttaaggcaacatctctgaagtacctgttctctagtttagccacctagtatgtttgtgctgttctgtcgaagaacatttgccttttgttgttcattggaaacagcataaagatgagatcagcagatttttatttctcttctgacaccacggccagccaatcagccaatatttttgttggattcctttggattccttccctccttccatctctccctccctttcttcctttcctggccaaaaaaaaaaaaaaatctttcctttaacaaccaaagaatgatgtaattgtgatatatgtagctttatggtcagacatgacatactacggaggggcccttgaagtccagaggtaccctcctactcctccttcactctcttcagtagtaagatgctttacgggccacagctgagcagcctagcacaaagtcaggaacatggctctggtgccaggctgcctgggttccaatcctggctcttccactgatcggctgtgtgcctttgaccacatcacctaacttctctgtgctgtagttacctcaggcttaaaatgagggcaggattagtaccattcccaagggtttttataaaaattaaatggattaattcatatacaatgattaaaacagcatctgacacaagatcattgctcaataaaaagcttataaggttttaattgaatgaattattttatgtaattcaacgaaaagggaaactatataggaattatcgtattatgacaaaaagcatcaatgtgaagacttgtttggagtgttgggtcacaagattaattcaaaacagagttttgtgctggggagaaaactttcatgacaaaaaaatcacgtcattaaagaacaaaaaatcacattaaaaattcacatctaataatatgagagtggggctttaggaaaacattggcaatttatttttatccttttttgagtgtgtgtgcgatgcacgcatgccaggggggtgtattatattattcaaacaaaactacaaaaaatatagtgaactttaaaaaataatgcttaaaagaataaaaaaaataagaatacctgtctacttaccacccaacttaaagaacttaaagaaacttcaaagaacactatcgtatctttagagcttcctgggtgcccaccccaggagccctctctcctgttgagataaacgtatcatacattttgggctaatcatcttcttgctttttctcatggttttccaatatacggatgtaatgttagacatcatattgtttagattgatctgttttttaactgtaccgtgatttgcactgattttagttatcaatatattggaattcacttctagcatcttattttgttctttgtttcatttttttctatgtttcgcttttttccccctctcttttttcgtattgagatcttttattttttcatttcctttggtttcattttcccccttccactggtttggaagttgtagactctattaaatctcgacttacatgtttaacaaagtataaagttggccagtgtttgtccttccttcccgtcagcataaggaccttggaacactcccacctggattttttggaattatacaatttcatatagaaaggactcttcacatcaaagttggtagctatagcttttgatgtctggcttgtttagtttttctctcttgacaacacagtaaccctctcttgagaatagcagagagaataaaaatgttactgttatgggaaatacagatcactggagctgggtggggccttaaagattaccagtgtttttcaaacttttgaccaagccaaatgaaaattaaaggaacttttaaaataatgcatattctctggtcccacatcagacccaatagtcagaatctcgggtgggacacagaaatctgcaggactaaaaagttccctgggtgatcatgatgcacagccagttttgtaacctatttctccatgctgacccaaaatggtttaatcaagctgactccataagcaaaattatagatgccatatagacttagcaaaaagccatggaaaagagagagggagcacagttttttcaaatgagaaaataagcatctctagagatgaatatcttcaatttgcatttgggaaaatgtttgagcacatacgcaaaaataaatatacaaagagtggcagcaaaagtagtctacaggcaaggcatccacagtcctcctctgctgctctttggctcgccgtgccaggaatgccttctcacctcctaatctgaggtctgcttttctttctaagcttagtgcatactctgccttctccactggagctctcccatctcttccaccacagtgtccatttcctcctctcaactcctgtagcactttctacctatagcattcacgtggcactgggcacattacctgcttaattcctctctagcatttcctgagaactctgggtcaggcagtgtgctcagggctttacatgcacttcccctgtaaaactcacagccttacaaagttgctacttttattattatcctagactaacatacaataaatttgaagtttagagtagctcaacagtttgtcctaggtgcacaagccaaaaaatagaagttatcatttgaactcaggcctgacttccccatgcaaactcttgagcattgagctatactagaggtagtttttaatacatacgtcttgtgtctcaggtgtgttctaagctccctaagcaggtatgctgtgcctcatgtgtttgtattcttagaactaagtatctagcccacactcagtagcacaggagatgagccaggtgaatgtgactgaaatttattaatcacttcagggattgacagggacagaacctggacctgacgactctaactcctgtcaatgagggtctcagtcgaagtgacactcagttgagctggtgctgaagggcaagaatgactgtgcacaggtgagaaatagcgtgaagcatctgggtaattccaagtggttcaggatggttttaacccaggaagatgattgaggaagtaaggtaaagtctgagaggtgaacacagggctagattgagaagggccctgtgtgcaataatcaagagtttggatttattacagatcagacactaataagccttttttaaccaggagttcatgcagaaaattaagtctgaatgcccttaggcacccattgtatgtaatgaactaacttctcttctaagcatctagaatggtgtgagttatgtaccacccttgaaaagattaagaaaatctttctatgttccttggttcataaaggaaccccactgagaattgctagatcaaagtttttccagacacagtagcaattcagtgggttgtgaaatcaatttagtgagttgcaaccagcgattttttaaaaaaaatgaaatagaaacagaaaacatcagagtgcatcaagtaatagtaagggcatgttccataaaacttgtttcaattacacagaaaaataagtgtgtgaactgggctgtgatacaaaatgtacactatttcttactgtgggtactgctttttttttttttttaaagtttgaaatccacttcaatagatcagtggttttcaaaccatttcttttttttttaagtagaggaatacttttcccaaaggaaatatctcgttaaacttcaaaatcagagctgctctgactaaagaaagagacggaggagagggggtgttaactaaagccctatgtagcagaatgggctctcatcttcatactccaaacaccctctccccatacacgtccacacactgaggcccctctgagggactcttggcaactctactgaccactactttaaaaatactgttattgaatggtagttcttcgaagatttttaatcagggatgtgaacaaatcttatattttagagtaaatttttatctaagtgctcaggacggactagaggtatttgtggaactagaagtcaactccagtctgcatcaaaatcatctgggctgcctgcttaatattctgatttcttaaaacctagtcctgccaaatgagaaagtgaggaaggtgtgatctaggcatctccatgttagccatctccctagggaatgcttttgcgtggtaaaatttgagtactgctggcctgcaaagggagattcatctgaagactagctaaaatccaggtgaaactatcaggatctgaaaaaagcagtggttgtggagatggtcagagaagctgtaagggggaaggaaatgtgagacctgatgaatatttggatctaggaagtgaggggaggaaagactccagggtgagtgggtagcatgtggctatgataactaagcagggagacaggagggacaggtttaagaggagacagtgttcagttttaggcatcaggcacttagagtgtctgtggcttctccagttggagatgtgtagaaggcagccaggagcatgggtcagaactctgagagctccaaattgaaatgctgatttgggagtcatcagcagtaggtggtaactgaggcaaatgtccttctattaataaatatttactaagcaattacctaccatgtgctagtgaatgcctttatgaggactcagtttgtataacaaacctatttccttctgtggccaagtgacaggtcagttatattgataagaagcaatttttttttattttaatgatgttctacattccttcagtacctgtttaagagactcactaatagttcaattagactataaataagctttcctctagtaattaaataaactagtttgagagttgtactcaaaaatcaataacgtgagttcaatgttaatttttaaagttaagtgaatagcatgctagaatattcaattacagcactgagatgatatcttaatgactgcaatttaaggtaatcagaaacatcaaattaaggaatgtctaacactttggaaggtacaattatattggtgacaagcgaagtaaaagatcttgcaaagtacctagtcaacattattgtttacatactcgataacaacccccacacccaaatttggaagtttacaaaatacctcaaatagtaccttggtgaatacctcatctccacattataggaaataagaagggagaacaccctcccatctggagaagcacccttcactggaacgtatttaagatggttcagcattcctggggttttggtgatggataaggtctcagtttacacaaggcctgttcaacattcaaacttttctattccttctatttagacttgcagccatatttccatctgtttaaaaattcacacatgcaattaatcaaagaacgttgacatatgagtggcacacaaataaaacatccataatgataaaaacaatcacgtagaatactctcactttgccacatggactactaatttcatcacaagggaggatatattttaaatctgttcactgtcttaatctttgtttttagtccaggaaaaagcagcagggcacaagcaataatactaacctagtaagccgcagggccatctgatttactaaaatagaaaattataactctacataaaagtcaggtttgtggacctcaacctagggaggcattcttcttatttgaaaaggaatttttaaagtagaatttcaaagtaagcatctacttttggttagaagcattataatgtgtaagtcacacattaacagaatatttaagtgaaaatgctcttacgacattaaagaatttgtttaacaatttaaaaattaacactttcagatgtggtatgcagtcaaattcatattcatttagcatttcagaagtccaataactcagaaaatagattgtcaccgatgtgaaaggaatgaaaatatacacctttagtaaatctgatttatatttttactgtagaaaaaaggacaccaagatgcttcaaatagatgatgagcagttaaacattccataaatgattcatttaacactatcgttactagtgttgggtattttgactctaacaactggttttagatacttgttttaaacttgtggccagctttccagctttgaaaaactgaaaatcttgataccaagggcaataaaagataaaatttaaagcagaggcataccagctagaaccactgcctagacctaattctagtgtttaactacaggcaacagctggaagttataaaccatgtaagaaaacaccatctccacctccagattccactttaagtgttatgtgtactaaacagcaatgcctcaatacttcactagctattatatcaagggctctgtggcagagctacagagaaaaggtgtgagatcagctgtgtgtactgacagagtagcagctatttgcctggtataatcttaaagaatgacagatcccaactaaccttcccaaggattggacattcttcctgctgaagtcactcctttggattcagaagtcctctgttgcaacttacctagaaatgctaacatattaggctgtgggcatgtaatatttaatcacataaactgtcatgagcatagaacagtgccctgggggaatgtataagagatgtctctaatggggttgaaacattttgaaaggactacagcattgggcattgcacaagaaacttgacctacctaggacacaacattctggacataacagatggcataaaatatcattctgagctcagaggaaaggagtatgaatgaagtggcaggcactggggtagcggttgaaaccatgctgccttacagagagatgggcctggaagaactatagcatggtacagttcaggaatgacatggtcctgacacaggataccactttccatcctccactcatgattaagaaaccatgacactatttgtttctgggctcagatatgacctagaatctcttgcagcacaatgctccaagcagtctctggcaatcaaatagaatcagccttgaaatgaaacctacttatccccattatagtaaaatgagcataggcttgaaatcaagcagaccctgagttgaaatcctggttatgactaagggcaaatcagatcaccttcctgggcctccatttcttagctatggaaggagcatgatgatatgacccaacaggatttttgtgaaaatggaatgagataatatgtggaaagtgtccaacacagaaagcactcagagaatattagttgtgactacccagatagtgttggttacttcctctgctgtccttcttaggcaacttataagcagatctgggagagtatttcagttgctgctgtgtgcccacacatgtgtgcgcacacaatttctcacactctgccctgtttctgtatccatctggctgtcctgctagactgacaccctcaggggagatctcttttgtgccttattcaacttagattacccagtgcttagccaaatgctatacacctagtggtgtttaataaatgtttgctgaatgaaggagcaaggagtcttgattcaagttcagatcctggactagagtgtgagttttaaaaggccattctatttctctgctcccagtatctccatctatatgtcactgggattggatgagaatgccctgtaagggtcctgtctgctgttacatttgatggttgtggggttctctcatagcttcctttagtcacagccaacatgcagtgctaggaactgaggagaaagacaaacatggatgctctgcattgtgcaatgtgagagaatctcgtggtaaaatttaagacgcatgtcacctgactccagcaaaaactgggatcttgatggagtacaggaatgctctcagatattcaatatctaacatgcaatgggcatttgttaagtgtcaggcactgtggctcatcactgggaatagcaagataaggagacagaggagtaaatgattccaggcaagatatacccaagatgatgtaagggcacgctgcctaactgtcttcacaagggctgaatttaatgttctctgcaaggccaccatgttctgtgtttttaaatggacaggaatgttaagaatctctctggttgggcattataggaggcgatgcaaaggggctcactgaacatccgctccttctccaggtctccagtactgtactttatctctctgatcttctattctagtcacaaatccatgattgctacactatgtttataagctccctctgtttaaaaatgcacctctgtttaaaaatgttgccaggtttgatgatgacgctgaggttcctatctcaaacagagaaaggcccaggaggccgggcctactatcctgccttggtcatcagtacggtgcgcaaaccctgaggatctcaatccccgcttactgtgggtactcagaaaatctgataatgaataaaagaacaaatgtataaacaatattccaaagttacagagcaatcacactaagtagtaatagaacccttcaggctatttaagtgatgtgaaaaccagtataaaaactccatatggacatgactttcctgagtgtaaggtcttgctgggtgtgcactagagaatataatgataacggtgctttgcggagttgtgcaatgtgaagaaacgtcactacatcactactctagagctcgagttattttacatatatttttgaattatgtataatagcaacatataatatatacatattatatgtatatatatacatatatagtgctcaacagctatatcttaaaaaaagaataaatctgatttttacagatagtctgaagaatttcactcatttcatcatgctagtatttgtcatttttgatgaaatcatatcagaaaaattcaacaagaactttcagcttttaggtcacaaatactctgggaatactataggttttcaagattatttttcctttctagctgacattttctttgaatggttgacagaacttatttttttaatcttaaatttagtaaaccataaaatctttaagtctttacatttagtaaactcagctatatctaggaattttataatgcagctaacacccctgaaaatcatgattcatccaaacagtgacatactatacagctattgaaaataataatattgatatgaaagatgtttattatttattgtttttaaccaaaaaaaaaaacaggttacaaaacactatgcatagtatgattccattctgactacattaattcactaaataaactgattgataaattaagcaggcatctgtgcatatgtgtgcttaaaaaagatcctgaaacaaatatcccaaaatcctagcacatataatctataggcaacatgattcaaatgatttttacctcttccttacatcttttattgttctcttaattttttgccataagcatgtctttcttttaagtaatacatcttcactaaaactactcctgttgccattttgggaacaaatacctttgcatgcactagatttctacggcaagaaacactataagattgatacaagttaagaaactctaaagtcatgactgactttcccaattaatcttttaatggcagtttcacttaattttatctacagtttactaaatagaaaaatgcaccgcaatgcattttgtatgagggagtcattcaacggtaaaaccacaacataatctttgaagtggaaccaataaaaatcaattgtgtacaatgtgtgccttgttattgcagtattaatttaaaatttgttctattagttgtatattaaatcacaaaaagcacagggaaacatattgtactatacactgagccaaaagtcacaaatgatcattttccccttctctccaagagcacaactctggctggtccccattggaaaacaggggctgggggagatggaagtcactacagattatgtattatgggggtaggggttgttaaattctttcatttattatcagaggatgaaggtcaatgactccatcttccagataaccaaagcttaaaaacctttaaaatagaagcataccctcccttccttgagaagtggagcctactgctcacacctctgtcttttcttgaccaactgtcaccaccatgagcatgtcacccccagagtgggcgatatgactggagagctgcccttcacttgtgccctcatgatgcagccatacccgtggtccctgtgcccctaacaggcactgctgaccattcagtttgctaatttacagttgacttagaaagcagatgaccgcatctggtaagaactgcaactaaataaagtcaacagagctctgaagaatgacatcatgaataaagcacattgaaaggcttagagacaactatttgtgttcagaggacattttctaccatgggtgtaggtgctaaaagattgttttatagattaaataagtccagggacaccaagaacacacagttcatatccacatgggctaattttaagaattcattctttctcatgaaagatggacaatactccaccattgtgactactgaaaatcaaacaaacaaaaaacagctaaaccaaaagaagaagagggggtggaggggaggagggagaaataattatttagcaagtatttatagctcagttacaaagtttcatctgagatctggacactaccgggaaaacacattcatctctctctctctctcttttttttctattgcaggccctcactaaaagcaggctaagtgagcgatggacacacacacagatgtagagatatgctgctgtgagtgtaccctgataattcttaaatagtcagcttctccaatactgcattttgcttttttatgctttttgctgccaggaggggaaaaaattcgaatggcaatcatttatagttttaaattggcagcagtctgattcagagcagcattcaaattctattgaaatatcttccacttgtgacttctgatcatatctaacttttccctaagcttgttagaattggtatttattctaattttcttcaaagtgatgtaatataacactgtctttgttttctaaaggctttttaaaagtttactttgtaatatacaaagcaatgttagtaagagcacagtgctcaatcccaagaatatggcaataattactttttaccctttgaactggcaggtcataaggccagaggtgcgagcatggacttgttttcttcctctccttgttcctaagctccttggctgtcccatggccaccccctccaggcctcttttctcacatgttcttctttatacacttttcttcattttctctttttcctcaggaattctgcttcttgcagaatttcctcagatattctgtaaatattctatttgtgatagcaacctctcttaatttagtaacccctttgaacttcaagaacactccattgattccattgttcagattatgggtacgacattgctgtccaaggacttcatgcataatccaacaagtatttattaagcccccaccaggagccaacgttagtgctaatactcaggacacaggtaaacaagatggacatgagctcttccctagcacctgacttcctcagctccttttcatagtttaggtctcagctccaaggggatatctttggagaggtttttctttgtgccatgtaaattaatacccagcccagcagccattccctaaaatattattctgcttgatttccttgtatccctctctgcaattttttttttttttttttttttttttttgcttattggttgattggtggatggattgatttgctttttgtcattaccctagttggaaagtaaacttgaaagtgggaactttgcccatttaattcatctagaggtaacttccatgtataaggtgctgtctagttcccctctagagattctgattccatgagtctggaatggggcccaagaatttgaatgtctaccaaattctctgagggactcccatgctcaggtgaaagtgggaggtgctggagtttatacaaacccagatctctaactcatctgccaatccaaaagtttgatgaccatatctgcttccatcccactgtgggatccttctgctaggaaggaaaagatcttcaactgtgatacactctggaggctcttgggaaatgtcacttggtaataatgaatggcatgggcctataggaacttacaaaagatcacgtcagtcaggctcatgctcaagaaaaaaaaaatggtaaggcacaatttggttaataatgtactataatgacgaaaatatgcatccagaaaaagaaaaagaaacactctttggaaatgttttcttaatttgcactgagcaaactttcaaagtttgacagaaggaatatgagggaatgggagtagagtaaggaggaaagcagaaagcggccaagtaaggcagaggacataaatagaacatgtataagagacagcaagggaaggaaagcaaggacagacagggcaagcagtacagggcgatgccattaaggtatcccataaaaacccgaagagagaagaaaggctgctctttgagttaagccctcaaccaaagtcaccatacagagatattgtagtcccacacctgtaaaacctttactgaaatctgactgaaggcaatgacatctcagaagaaagaatgtcaccggagccagggatgtctagaaggaccctatgcaattcccagggagaaaagttcttggtcaaggtcaacctgttctcgtagctagttctgctagttctctctcgttctgattctcttcaaaaggcaacctgtttgtaactggacttgccaagtattgagtatctgaactccttggtaattatacttcctctgtccaaataaacacgcccccattccagttaattagatacataaacagactacccagagacagggcaagccaaagggaggagggaaagaggcaaattagctgggacttccatccctcattcatattcttcctcctgccactgttaatgcctggtgacctcctcctcattctttgaaagccagctcacttgtcacctgtgtgcgaatctttccccagtcactctcctctaggttgagtccaacgtttcccattccacagcacactcttacacacttattgtcaaatcagataccatcagtggattatccatctggccagctagactgagagcacctcaagggcagaaacactgccattttcagcttggattttcgacacctgatcagaccagacgcttagtaggtgttcaactttcagagaggcagcaaaggaaagctgaaatgtcagagaggaaacacagaggtaatggaatggaaaattaaatgtgctccctgccaggatttcatgtagaatggctcactccattctactgttttcagacggaacatttctcaagcaatcaaccctgatcacctttaccttacccccgggcaaatgcgaggctacagcaccacaggagacccactttatggatttactcaatagccaattctgttcccaagctttgcaagctgattgtttggaattcaaaagacactatcatgagcacactgatacatgtggctcatagggcacttaggaaagcctatttcacctatatatagttgattactttataggcaattccagacttagaacaatttaatttgtagtttaaaaaaaaattcttggccagttaaaccttttttacccttgctaatgtttagaagaagttccaaaagtctcctctcaaacagtgaacctcaccttgtgtgagaccctgccagttcctgcaaggagtagaactggtctgtctttggttttttggttatttcttcaagacccctcagtccttcccaccactcctgatatctcttacacctccgtatttgaaaataagctggcctggtgcagtggctcacaccgtagtcctagctacttaggaggctgaggtgagaggatggcttgagcccaggagtttgaagctgtaaggagctatgattgtgccactgcattcccatgtgggtgacatagcaggactccatctctaaaaaaataaaataagccaaattaaatcttaaaacatataactaccctctttacattgcattatatatatatcatcatatatcatatatatcatataacaatttacaaaatatttattgttgtttacacattttgacttactcatctcatttgactacttaaatagtacaagtaactttttaaatagaggattctttcaaactatgacataatgtggtttcaatatatctgatgtatccaaatgtggaaacccatggcctgtaagaagagcctcacactcttctgttctaggttataataaaacgttcaaaattagaggagaacccctagctgcccagccacctgtgataacagtttctttgggtaaactgtatcatatatatatatataatatacatatatcatacatatatgatatacatatatatatatacacacatatgcacatacacacacatactttaaagatacaggcttgctttatgttatatataggtaattcagagtcaataaaatagaatattggtaaaaactcccattagagaaatgttgaacattccagactcttgggtggaaacctagttccctattaagacattgctcctactgaaaatttgaccgaactgagtttctatcattttcttctggaaagcatgcagcaagctcaaatacaaggaccacctgcgctaacagtgctgtactgccgatccaccatgatcccccacgaaagggcagtcacagttacaatctgtgttgtcagccataaacaggccccctccccatctaggaacactgatataaaattctaatgtgcattttcttgtttcttcctacaatcatcaactcatttatgaatctctgtaataagtgtcgggaagtcaagatggtttgaaagacaatacctttcctccaagtgtttgccctctagtaagtcaaaatgggcacacacatagaaataactgtcataggcaataaatgacacatattgtataaatggaataggcgaatgagtcaggaacttagagaagatatcacaggttgaggtaattgaagacgacatgataaagaagatagggtgtaggggcagggtcatgaaggagttgcaggaattgaactattagggaaaaggagtattctcaatttgtccctctacccctctggccaaatatgtaacatataaatacaccaaacaccttcgagatcaggcaccatcccttggtgccgtagtaacaacaagctgggtcaccttccagtgcacgtttcacccaaagaaactgttatcacaggtggctgggcagctaggggttctcctctaattttgaacgttttattataacctagaacagaagagtgtgaggctcttcttacaggccatgggtttccacatttgggtacatcagatatattgaaaccacattatgtcacagtttgaaagaatcctctatttaaaaagttacttgtactattttagtagtcaaatgagatgagtaagtcaaaatgtgtaaacaaaaataaatattttgtaaattgttaatcagtgaagaaacttctaaaccacataaatataaaggctaagaaagattaacgcttaaatggttctttctttgaattagagatcgtctgctttggttcaggatacaggagaaatcaaacaccctaagttcagtaatgggaacgtggtataccatctctcttaaactgtggaactaaagatatcatgacactcaaataacaaaaagctcacattcatgtcctttagactttcctgctgccccctaggaaaaacattaaaacttcctgtttcaaaatattcctttttattttcctgaaacaaatgtgtttattattgtaaacaatgactcatttggcatttttacctaatgatatagacaaactgaaagatttactagttaggtaaacttgggtaatactccctaagccttgtttcctcatctgtaaaacagagacaataaatccccctcctgggattggtaaggactgagcgagagaatggatataagccctccagcattgggtcaccgtcatgatcattagcttgctttattactccaggaaaggcctcgtggggtctgatatttgaaaacctagaacagcatcggtcagaggggcaaatggcacagtgttttagcagcgtggcttctagagccagaccgctggattcaaatcccaaatctatcacttccttataggtaaccttaggcaaggtgtatttaacctgttagcccacctgtacctcattaccttatctgtcacacggggataataagaacacccagctgcaggggtggctgtaagggctaaatggcttatgatacctaaagtgtccagaacagtgcttggtgcagagtaagcctctatctgtcagccattcttgctgttgacactgctctccagctttaaagatggtcaaactcaaactcaagagtctgggaagagctggaaaaaatgcttagacacgagagctaagtgagatgcagaaactagctattcttttctaactaattctggaggggtgttgacttttcaaaaaataaatttagtcatttagaacaaagctgtccagatggagttaagtgaaaaagacctgcgtggtagaagtagtgtgctgagactgagccatgcagtgtgtctctattaaagcctagccatgctgcaaatattttttaaaaattttcatgtccactttctcaactagatcatataggtatcagggattgggactatatattggtaccatttactttcatacttccagtatgtagcacagtgcctgtcataaggcaggcatttaatcaatatttattaatgagtaaatgatcaaatgagtgcataaatgaacaatctgaagatacaggtagctatttccccaagtgcaagaagacctttaaatactaataagagtagaatttgacccttaggtaaccaggttggagacgatagcaaatgagaagatagatgagcagaagtgatgttactatacctggaaaatcaactttactgttcctatgggtccattttactgaacagaggttttattatgaatcaccttgtttgcttggcaattctagttagtccagccaaagcaaatgtatttcatggggcctttggcaagactgctttccttttctttgtatgtgtgtacaagatgattcataacacatacccatgtaattgaagtatttaatgtttgtgcctagctaaaatgagatcaggtcatcagcccattcttatacaaagtcttagcaataaatctcataaactgttttttggtagaatcacagactctgagacttgcaagaattcttacagggtgcctatctatcctcccactctatgaaggaatcccctaaatggcactacacacaagggtcatcaacatctacttaacacttcccacaaggacttcacctcactgcaccaggctgccaggtccactgcagaggagctccgatttttagaaaagtcttttgacaatgagttaaaatattctttctgtaacttctacttggtcctagttttaacttccagacctctgaaataaaattccttttccaggtaacaattcttaaaatgttttaagagaattgctatgtcatttcttctctggtgacactcccccaattccttcatctgttctggatccttcaaaactccagttaccttcctacaggtgcttactacactgactaaattcctcttaaaatgtgatggccagaattggccttaagatgcaccgtggactgatctgtttccaaagaaagcaaaacaatttgttctccaactctggattctacacctttgattaacgtgcctgcaactgcatgtccctttttggagaaccacgtgggcatgatgtaatctaccccacagcatttctggttcatagaaacccttaagtcttttgttttccttgaacatgcactgttatcaagaaggtcttactcatctttgtggagttgtgattcgcaaatgtgtgtacgtgtgtgtacgtgtgtgtacgtgtgtgtgttttatctaaacaatgagcatatctagtctcttaaaatgctgttcttgcttgttttggcataacatttgactctgttgatggctatttagatctggaacctcctacttaacctattagctattcttcccacatattttgccacttacaagcaatttttaaaatatcttctacaagtccaatattactattttgctcaaaaaatatagaccaagtacaaatttctctggcactccttgagattcttgctagattgacgtcaatcttgtcttaatcaccaaacttcaggtgtaactgttcagttattgatgaatctcctaactgttctagcaccctgcccacacttcttggtcaacagaatattgtgtccaattatcaaaggccttctggacatccatatactacatactttctagagcattttctttatttaactagcaaccttatcacgaaatgtaaactgagttaatttgtttaatttacctggtgttgtatgaatatgaatgcccccccaaccccggcctttttttttttttttttttttttttttacttagaaacccattctacatggctgggtgtggtggctcacacctgtaatcccagcactttgggaggccaaggcgggcaaactgcttgagcccaggagttcaagaccaacctgggcaacatggcaaaactctgtctctacaaaaaaatataaaaattggctgggcatggtggcacacgcctgtagttccagctactcaggaggctgagctgggaggattgcttgagcccaggaagtcatggcctcagtgagtcatcatcgtaacactgcactccagcctgggcgatacaatgagatcctgtctttaaaaaaaaaaaaaaaaaaacccattctgcaattttgctgagcatctgtcatcaatctgtcatcaaacattaaaatagttaaccaatataaattcatgtctaatataaaaccactcatgtataaaatatttccaatcttctgaatgtggttagaaaatgaaatttaaagttctactgtttaaaactgacatgttcctttcttctcaaatatacatacactatgtcctggggaaggataataacatttcattttcaatcaattagaataacttatttggaatttaatttagaaaattagaacaaaatcttaaaatcatagttctctctgaagctgagatggcctttcaggaagaccaaaacaaaacgaaatgacagttctcaaatttaacagttatttctgtcctttctacttgccttattttatagatgagaagactaaggctaagtaaatattagcaaataatataatgaaagctactcttatcctgcaaattaaaagccctatattatttatttttgttttaaatggatacattgaattgtacacatttactatttacaattggatgttttgatacatatatacattgtataatgatccaatcagtgtagttagtatacccaaaagccttatattcttaagaaaaaaataattctatcactaaaggaaaaaaccttactttatcaatttttttttttttttttgagacggagtctcgctctgttgcccaggctgaagtgcaatggtgcaatggctcactgcaacctccacctcctgcattcaagtgattctcctgccttagcctcctgagtagctgggactacaggcacgtgccaccacacccagctagttttttgcatttttagtagagacagggtttcaccatgttagccagggtggtctcgatctcccaaccttgtgatccactcacctcagcctcccaaagtgctgtgattacaggcgtaagccaccgctcctggctactttaatttttaaaaaccacacttgatataaatatcacactttaactatttaaagaaagaaaattcccctaggctaatcccacatagccagcaggtatgcttccctgcaggttctgagccagtctggcgccagcaagaatttggagtcttttcccactatagaaaaaaaacaagacaacatcacctctgagagagtcaacagaggagtgtatacactgccaaacttaaggcagaagtttctcattataaaacatggaaatacagtgcattagcgaagtctttattatatatgttattacacctacacacaaataatattcgtaagtttgttgacactgaaaagaaagtctgaaatgctaataatggtggtaatgagataaagaaacagaagggcagtaaggctagaagagtttctgcaggttgtaatcaaacttcactttcttttatataccacttcttttctggaccactgcaaaatcaaagggcatatggtttccatctctgaaaagaaatgtatgttcctatttgcacaaaaccagggtatctgttatttggagctagaagaaaaatgatacaattcagaaatggtatccttagattatacataattcatttctaggacatctacttgtgaaacatcctggggttgtttaactagatggctcctatggttcctactagtataaggtgatgtgattaaaacatctccttagaacactagagctctgcaaaacacagttctagcatgtattggggcataaagagcacaggccagctcctggagatacaagctgtactcacctcccacaaaagtagtccttgggagttggggacaagcaggggatccttgcggcaaaaggtatctgacggtgaggatcactgttgccaacagccctgtgccaatactctagccactagcctctgtgcatgaatgctaagaaaactgtgccagccagcattgacacggggatccatggtggattctttcacagatcaccctcttgcatggtatactccaccatcttctcatggtcccattctcaaagattacagactgcgctcatatatgggctacatgctttgagttacagtgaacagtatcactgtacacccagttgtccaggatagaaatttgggtgtcatccttgacttccctctccccatcccaacatgtgaaaaatcagtaagtaccattgactctgcctcctcagttatctccctaatccatccatttctttctaactattctatccctctgatggtgattacatcagaccactatcatctagagtctgaattagtttaatagccaaatggccttcttgcctccagtctcaacctctctaattcattctccatagtgtggtcaatcgtctttatattaaatataaggtaagtctgacaggactatctccttgcttcaaagtcttccagataagggccaaaggacacagccggacaggcaggtgttcatgacttctccccgactgacccgcccacctctctgctcctctgactaacctctcttttaaccccttgttcctgtcttgtcatttgcagtgccccggactggccctgccatctttcatttccgggctttgtccctgcagctacctttgccttcaacatgccttacaggtccacaatccagatcctcagacaccaccacaggtttcagtgctctgtttcatgaaaatggtaacttacacttattgtgcagggttccattcaaaccatttttatgcattctgccatttaaccctcacatcaaccctccgaggtaggtattatcatggtctcttttcatagattaagaaactggcaccatttagatagcatttggtgtagaaaccaagtgaatgatcttcaagtctggatcatatgcatcttctatgtgctcccagaactcccagtgtttattataaaagttagaattatgtgttttcataatgatctgttttcccaattttttgcaccacagactgtaggttcttaagggaaaagacatgtctgattttttatggttccctagattaagttcaataagtgtttgctgagttaataaatgtggactgggtacagtagctcatggctgtaatcccagcactttgtgaagccaaaggtggaggattacttgaggccagggattcaagaccagcctgggaaacataatgagacctgtctctgcaaaaagtagaaacaattagttgggcatggtgcacatctgtagtcctagctacttgagaagttgaggtgggaggatcacttgagcccagtagttcaaggttacagtgagctaggatcactgcactccagcctggatgacagagcaggaccctgtctctaaataaataaatacgtaaaataaaataaaataaaataaatgatgacaacactgtgcaatatgatgcaagggttaggtacacatcccaggaccaaagtgcactcaaatcttagctcttccaattactgtgtgacctggggtaacttatttaacttctctgcttagaataggaatggtgataatacatacttcatataaaaattaaataagtaaatatccatagagtgcttatttaagctcctggcaaatacaattatataagtgcttgcttctatttttaaacagggtgtcactctgtcgcccaggctgcccagtggcaaaatcacagctcactgcagccttgaactcctgggctcaggcactcctcccacctcagcctcccaattagctgggaccacaggtgtgtgccaccacacctggcttatttatttatttatttgtagagatgggggtctcactatgttgcccagctggtttcaaactcctgggctcaggcagttctcctgccttggcctcccaaaagtgttggaattacatgtatgagccgccatgcctgaccagtgcttgcttttattagcattagtgttaatgaagaaaccaaaagcacttgtaagactaaatgagtatcattaacgcaatttcacaggcaagaggaactgatcaagataaagtgacaattgtcaaatatgtgctggtcctagaattaaatatcatcaccccaaaatttgttacaaagcatcaaatatctagcttaaggattcctttaaaaaatcttatagaagacttttaacaataacaaaaaccaacaatggcagatgaatgagttggctccttgcaaaccctgaagaggaaacaatccagaagtatcagtcagagcccacttacttatacaaacaataaacttttatgcataaggaccaaatttataataaagttacaaggaaatgtttcctcagattttgagaatgtttaggaccaaagaaatgccattttatgaggaaacttttctgaacaatttagtcattgacattgaaaaaaaactgcatcctcagactttgacaggggattaagttgtatattcttcaaagtgaagctgatgcctctttaaaacaataattgtgtttaagaaaagatataatcaaaggagccaacattgtgccaggattttgtagtgtaattaagtattgcatcccttgtcagggacacagtcttttgctcaaagattactggaatagaaaccccatttcctgaaaacagtggccggtttttaccaaagaagatacagaaacacagaaaagttttattcactgtagaccttcttctgagcaagccaaagccttgatcctcatgtctacaacatattgaaaggctcactggaatttccttgtgaaacagttaccagaccttttacctcaagtggtaaccagtccttcagttttcaacagttatccaggctttggcaatgaaaataataagtattcactgagggatcctttctttctagatcacagatcaaaaatgaattcccgaaactccatttcccatttttgtgatacatattaaatcctacttaaaacacagcataatcatgaaaatttgtatttacttaagaggtttacaaggacaaccgacggccccttatgacaattaaggtttgctttactcattattaaaaacattttgaaacaaaaaaacccattacaactaaaaatctggacagtccctggattaggctgtggagtttgtcctttggaggaaaagaaaagtgaatgaaacccccatgagagtctaggaaattctcagtggttcctgtcagtctccaagcttctatgtctatactttcaggtcatttaatgttacaacttcatgttttgagattaaaatcgacaccttctattcaatgttataccagaaaaactaaaataaataaataaacaaaatagacatctacaagtcaaagattccctcttctatggtaactgcttctacctgcacacccctctcaatcaaactcccgtgtgtggctacacaaacacatatcctccattcatacggtaacacaggtgaggctcctgacaaatgtgatttcactcctgaccaaaattgttagcttcaaagcacctgaggcagagtggtctgctcataagtccttccctggaccccagctctggccagacttgaatgatataagggttggcatatgattccagtctggagcagcagagtccattcccagaaaatttgcaaaagaaagaaagagagaccttgatatacacacttaggagctactggctgccatgttcggtacaacataagcagaagaagcaggacagaaaaaaaaaagtttgtaggggaagaataaaattagcacatggagagaaactcagatgagaagtgaagagaaagaatttcctgaataacacagggctttccaacacctagttccaggatgttccttaggcatggtaatctccacacccttgggttgtatgagacactagtgttcctctcctttttcacttaagctgacgtgagttggttcttgtttttgcaatcagaagtatagttaatacattgaatggacttctacatttaagtatagggcaagaaattgaaacacacagttccttccagataagtcataaccaccactatcggatcaatcatttgctatagttctagagtcccaaacaaaagaaattcagtcactggtcaaaagccaaaaggtttccagggtttgaaacaaacctataacgtatggttatgcaagctgaattttaatcatgcaaatgaatgagcagaaatcattttccttacattgcctttagctccataagttataggtttgaaaagatgttttaaaagaaatgcacttaagtagattagttttcattttgataaaataaaaagtattagtgcaaattataaacttcatcagtctgcttattcatagcactcttaaaaattgtcttctgaaaaaatttatctgctaaagtacttacaagtaagcacattttttctttatgtaggcaaataagggtagacttgggagttcttttcagaagtagaagataatcataacagtcctatgtttgaatttcaagttcaagatcacatttggcatggatttcaaagtcttccaggggtgctgttttgttcacaaggaggtttttcttgtttgagctctcttgcataagactcttggaggagagcaaagaagaaaaaaaaagattccctacatgttgagacatggaagaattagattgcaggaaatgaaagccacccaataagcagtgcttcagtccctgtaagcattccgtcaaggcaatttcaatcctccccttaaaagatgaggtctgagagggggaggaccaagtactgaagagaaagtgagcttccgccttggtcttcatgctgcttaaaagtcaatcaagcctggggtggggacagggctgagccacaagtgcaacgcctgtggagggtctggcctgcagaaaatctaactcctgtcttcaccttcacatttaaaactccatttcttcttttgttcctgtcctcttttgccctccacacagctatgcctcatctcctgctctcaggccaatactggaatcctgagtagggggtagtagtgtactattcttagacatccaagaaacttcccaggcttggtaagtgaaagtttctctttgtgaccaccttccaacaaacctcttttttcaactgtgatttcttctctccaatggtattaaaacacatttaatgaactgggttcttacaaggcaaagcagcagaagaaggacttgccagtcatgaaagtgtgttggtctagacttttccaagctggaggtgcagtgggtctattctgcactggtataagtttcaacaaggacagtcttgagctagggagaggggttgcgtgaaacgccacacctgctgggtgttggcagagactcgctgatggattttactggttaaaatactaccctatgctaataacatcacttttctaaagagatctaagtgcttcacaagttcatttgcccaaacatggcattctataaagaaagtaagtagcccaattatcctctccggtaaatcaaaagtcagtgcagctttggggctattcctggaacccatcaagctggctcctttctcaggccttttgcatctgctgttgccagctctacctggatgggctctcccaggtggccagtgggctcagtctaccctgcatctgggtttctgtttaagaagtccatgaccacccagtctaaagcagcctccctacctgcatcctaccacccttatctctctccccactttcttaccagaggtcttaacaattcttgacattctgttctaatttatttgttgatggatcacctgcactagaatgtaagcttatgaagccagggactttgtcttgctcatcactgtgttcccagggcctaaacagggcctggcccattgcagacctcagcaaatgttatatgaatgaatgaataagaatggtggccaaatatctcaatttctagcttaacatgtgctcactgccctgtcagctttaatttactcttctatgcttcctgcccttggtttgctgacaggcactgacagacagctagatagttctggtcttttcaaatgtcttgtgctgcagcagaaatgtttcatttagatgtgtgtgaattataaaaacctgatgttgatggaaagcataaggagaaagatttactgcactgtttgtgggagtggagattgatgcaatctgttgaaggacaatttagagatagcttaacaaaattttaaacatgcattttcctgacctactaattcttgaataaatacaattcacaaaaatagacccaggaatgcttggagatgtatataaaacgaccctcattgcagggatattttaatggcaaaaaattagaaatagctcataaaatatcatcaatcagtatgtaatacaatgtagccttatatagccactgaagagaattagacatatgtttatacagacatgaaaaaatattcgtatgttgtcaagcataaaaagatggggaactattatgactattaagaacacatttctgtacaaaaatcattactctgtgagtactatacacacatacaaccccgaccccgccacagtcttttattatttgcagggaaagtgtctgcaagccagcatattaacctgttaacagtggttctaaaatctctaaagagagaactaagggggacttccactttctaaatcatatattctacaatgtgtacattttagaaacaagcaaattacatccacaataacaaaaacaattaagattttaaacttcatttaaattctagtgccaaagcacttcaatatttataaaactatttaaattctgagctctgggcccaatgttcacattaacaaatctggtaactcctccaggctttatttattcctgatccataaaatgaggctaaaagtgcttttccttctactgcttagggttattggatggctaaataaaatcaatgggaagaacattgaaaagcatttttaaatcactaaattaattccaagtggccattatatacattgtttaagcttcttgttagcattctacctgtatttcattgactcataagaatacactctaggagggatttgtgttacgacttttacagatgaggaaactgaggtgtagagaaaacgaatttctttcttggaaagcagaactagaatcaaacactcagactttatcccacactttattcctcttccatctcccacactactcagagcaggtaggtataaaggccctgtaaactataaatctgtcaaacatgaaagggactaggattatagtcaggagcagtaataagcaccttttgaactagaaaagaaaactgcagtgaaaaaattgtatgtttcttatcctgcactgtgttggtccatcattaccaaaaccaattaatctttttaattacgctcaaacctttttatgcactccaaattagaaatcagaacagtttaggaaaacctctccagaatatatattcaaggttttataaaaagaaaagaaaatgcaggctttgataaactcaacatgtatttacttgaggaaaaatgagatttttagaaaaaagtaggggcaagtgaattcaccaagctgtgaaaagtatactttatccactgggaagtttctgtgagtttgcttgttacaggaatactagcaatatatacaaacaaggtacacaaacacagcgacaggacacgttccaccaattccacacagccacaatcctaagtcattactcttagcaaagcctcatataagagggctcatttctaaataaggtgggtaggctccaattccctcagcttcaagtaagcaaattttggtctgatattacaaaatacaatcaatttcccggtaccacaggtccagtaagaaaataaataaattcaagattgtaagtttactgatcataaaatatgtcaaaaagactttccagacaaattctcatgttaaaaaaagccattttaaagatgtttcagctacataaagggatagtagagaactacgaatcacattgctccaattaaggttagaaatgctctaatttgtgtttccttgaaagttccagtcttattagagagtctcaaaacacaatattgcagaactgcatacaattttttattttcgtaatgctatagtgataggctcctgtgtccaattcagattggtgacatgctgcttgaaactagtaaaccttgtcatcaggctaattttacaagtcccttctcccctctcatttatagctacttatatttctctgcttttctttatgactttccacatgaagcattctctaaaatatttttgggcaaaacttcattccatgcttcctcaagagtgcagtaatattggaagcacagtttgcaggtcactgtaagaggtcagtgagaagtctcctggtgttaatagcttgagtaatattgttttctcctttagatcacaccattaaattgctttcattacccacaaaggggttatttgtgtcagagcaaataagatctcattcaaattcaaactggataatttcaacctaataaaatagtttatttctaataactagaagaacaagacaatgacaaaaaattgtaaagtctttttaagacatacaagcagaagagaagaaatgtattttttaaataggtcctacaagagttttaatgtgctatctggaaattttggagggggctaccctgtagtttattctcctagaaatgggagggtatgaggtatttcccaaaggttttacaagaaattatatcttatgttccctgggaatatcagagattccactttggacttttctatttcactgagtttcctccatttctgacccaccatcttctttgttcttttagtcatccaaatttaaaacactgaagctggattcatccttttgctactcccctcgggctcaatgtgtcactacctcctgaagtttctatcattttaatgtattttaaatccattcttccttttgttttttcactgctttcatagtaactcttgcttctgaaatgtttgtgcctggggtaagggccttcagaatacctcagttgtttcttcaaaacagggatgtcagggctgtactagtggatcactggattagaaaccagcatgtgtgtgtgggagtggagggagagctcatgcatacgctgggcacgttgccctggtgatgttgacacaaagcaccacaccacctcctgaaaccacatttctatgaagaattgtctgggccagccctgttctggcaaacttccaaacccaagtgcctggagccagttggagtccatcaacaagcccaggaagcaagtccagctcctatcagggaatctgaagacccccctgtcctcagctgtgcctgctgattgggacctgggtgtctgttttatatcctagctccactacttggggtctccagggtagcctgaatggtactctagctctgctgatgccagggtcctcctcaactcctgtcagtctttcagggacttaccatcactccagaggatgcatctacccttcctgattcccaacctggcctacagccatggccaggcctcattaactgctgccaggtttccctgacgctgacttctaactacagggcccaaagtggatttaagcacctgattgctaaaggaagtagcatctgtggtccccgaatctcctgcctaggtcccaccccttccttgttggctcctgggcactattctagggcccaggtttttgtgggaactgcagttttgccctgtcatctaggagctgccacttaacactggtctgtctgcagcactcccttaacaccacgttgaacagcaggcatgggcctttgtgagtctgcccagatctagccagttccttccctctactgaactgtccaacaagcctggccacagcctgccagtcacctaagccttccacccactgcagagctcagatagtggctgttggaagggacaagtgttgtccatctggatgtggccagccaccatcttatatagcttccttcaccttaaatgcaggtcccgccaagaaagccttcaacttaagaaccccagaatgcccctgctgggccctgaggctggccactttccctcccaaataacagaagtacagaatccagtggtcggttcttagcactgtccctgtggaccacattcacagagcctccctgagccaggaggccctgtgtgatcccttgtcatgcagaggccagcaaagaagaattgagaagccaaaatattctccaggctcacccaaaagctaccctccctgagctgcaagttgccttagaccagagacacaatatttcctttccaagttggaacaaatgaagaagggtccagttaacaccccataaatgagcattaacctcttgtaagacaatctctatgtccttctgagagtccactccatgcaactgagaagacacagttttagtttctaagctgcatgcaaactcaggtagagcctccagaacaacctgggtctgctgtgtcacctcagcatcttcactagttctcccagtcccagcagaaggcacagagctccactgtgagacagcattcgttaagtttgccacatgtcaggagtcacagagggatgtctaagcagtcacgcagatcctaggaactctgctacatgttttgcaacatatggaccctcagaagtaaactcagtacgtctctggagcatctttcaacagaacagtacaatgtctagagatccctcaatagaacatcaggcctaactgtaagatgccctagaaccaaggagcttggaacatatcctggggaggaaaacactgaccttccaagggaagagttatttaacttgtataaaaagttctggctgggcacagtggctcacgcctataatcctagcactttgggaggctgaggcgggcggatcacgaggtcaagagatccagaccatcctggccaacatggtaaaactccgtctctactaaaaatacaaaaattagccgggcgtggtggtgggcacctgtagtcccagctactcgggaggctgaggcaggagaatcgcttgaacctgggaggcagaggttgcagtaagccgagattgcgccactgcactctagcctggtgacagagtgagactcatctcaaaaaaaaaaaaaaaaaaaaagaaagaaagaaaagtcctgaactttggtctggggcctatttataggattctgaggctgtaaactgagtcatgaggaagactgttctggatataacacttttatcataagccttgtcatgggcccagataggcagactcagcacagatagagagcaggaacactgtctccctgactcattggtgagtccagttctgaaagcccaataatgtagaaactctaaggggagtccctgggatccaccagttgctaagataactggaagaaggtctctgccacgtagcaccagtgtccctcctgctagtgctcgagcctggtgataaggagtctcaccctggggaaagataccagccctagaaaagacaaagaggcctcaacgaaaatacttctcaaaaccaaggaggctgatcagaggcaaggtacacagctaaccctctaaccctcatgatcccaggagagctaatttaatgacatctaagtctcctgaagctccctggatcatagtagggttggtcctaggctagctaaggccaagcattccagggccggcctctcggatgggcggccctgtgtgatcacgcagatctgtgctcagaagggcctgcacttggttgacagctctgctgtcacgttcttgaaatcttcaacaattttctctttgaacttgtattttgtaagggagccagaggagcatgaggatgagcagaggagacaggcggaagaagggagagagctttatattttagtaccttcagtggcacatctcccctgccttttgaacaaaagacccacaaattatgtagcaggctgtcagcagtcctgatggaaccccctcccatgtaaccagccaccgcacaaaggagggagttaaagactaacaatcaagctgggagcactggctcacgcctgtaccccagcactttgggaggctgacgtgggagaatcgcttgagaccaggagactgagaccagcctgggcaacatggtgaaactctgtctctacaaaaaaaaaaaaaaaaaaaaaaaagaaaaagaaaaagaaaaaaaatagctggacatggtggtgtgcgcctgtactcccatctactcaggaggctgaggtgggaggatcgcttgaacctggtaggggcaaaggttgcagtgagccgagattgcactactgcactccagcctcggtgacagagccagatgttgccttgaaagggaaaaaagaaacaaaactaacaatcaccagggactctagagatcccccaacctctagtcccaaccctaaccaaagaaatctttcatgcctttgggtcactcacagaagtcaattccagacccaggctaactctgtaccacagatccccccggctcaggccaagataaccactggttagaaccaggacacaggaggcctgcattccaggaagcaattcatggctgatgcgcagagttagtaagaggggtcccaggtgacatagaacgagttcttgtagttacgatcagcacaaggacccaggctgagccagtctgggtggaccagcccagaaccactgtcacccaggctgcctctcccacccgctgtgggctggtgagatggtggctcccagcactgggaggagggtatgccctggggcagggggagcctttaccacaacttgatatatgacctggggcaggtttccatctctctgggcctccatttcctcagatttaaaataatggcagcatcaccttctaagaggattaaacagagtatgtataaatgcctggcacaaagtggtggtcaatttttaaaaatcccttttttctcaatagagttgttattagaaatgagctgttattagaaatgagacaattatccataaaaatgcctgacaattcaaagtgcttcataaatgtcgattctcttccacgttctccttcccagtccctcttacctttgttcttgtgaccagaccctccactaactgccagttcccaccccaggtcccacccaataagcatgtttgttggctcattatataaacatttactgagtgcctactgtgtgccaggcactgtacaagtgaaaacacacacacacagtcctgtccctgagaagctcacagtcgggtaagagaggcacttagcaaataaattttaatagagtgggttacttttatgagttaattcttttaatatataaatagtatactacagaagcactggataatcaactctgccttggggagtcagagaaaatatcatagagaaggcagactcttgagtcggatcttgaaagatggacaggagtttgccatgctacagaaaacttcgaggagcctcaggcagtcactgcacatgtgcaggacagtgagaagcttggcatgacagaagcaggggctgtgtgaggggagtgcatagaaaaggaggctgggaacaggactgggaaagcagccttgtaatcccaactaatttgggctttatccagtttggaagagtagacaagaaaagatcagagctaactgtgctttttaggaaaatgcctcagctggtggtgggggaaggcctggagcaagaaaatgctggaggagggaatccagacggagatgaccgttagcaacacacagcaagtcttggactaaaggcgtgtagtaggatctgagacaccactgaagtagatttggtgactaattttttttttttttttttgagttggagtctcgctctgtcaccagggtggaatgcagtggtgcaatcccagctcactgcaacttctgcctcctgggcccaagcgattttcctgcctcagcctcccgggcccaagcgattttcctgcctcagcctcccgagtagttgggactacaggtgtgcaccaccacgcctggctaatttttgtatttttagtagatggggtttcaccatgttggccaggatggtctcgatctcttgacctcgtgatctgccctcctcggcctcccaaagtgctgggattacaggcatgagccactatacccagccaatttggtgaataattttagatttggtgattaattggttataggtggtgagagagatggtactaccaagacttccagcttggaaggcaaggcagatgaaacccattgcagagatcctatttaacaggtagagcaggtctgcagggcagctgaagcttgtggtgcctccaggacatccaggtgtgcacgtgacagcagctggaaacagagattgggatctcctgaaaggctgaggatggagaggctgctttgagagacgttcacatggaggggttggttcaagctgcaggagtaaaatcacctggaaagaacttggggacccaaaggagaaggaacaaagggcatttcagagatggtcagaaatgggagagactggacaagcagcagagaaggaacagaaggaggaagacactatcaaagggagcatgaagcaagcaggcacataacaggaaggtcaaggtagatcactaaatctggcaactaggaagacaatggtggcttaatcaaacacagtagtattagagtagtataggaagaagctagcttactacggtttgaagtattaagaaaagaaaataaacaagagtaaaaaaatcagcggggcacactggctcgtgcctataatcccagtactttgggagactgaggcagaaggatcgcttgagctcaggagtttgagaccagcctgggcaacatagggagaccccatctctaaataagaaaagaaaagaaaaaaaaaaaaaaaccaagaacaaaagtctggtagtgaagggagggagagacagagcagtagttagaaggggagttaaggtcagggcttacatttttgaacgatcaagctcataggaaagcaagaataaggacaagagtaggctcgtggatcccccagctcctggctggaaggaatgagccctagtgaaaagctaggatggtaaggatgtgacctgtgcaggtggactcagatatgaaggaagggaaattaagggagttcatgccagatgaagaaagcaaagattgggaggtcagctggggaatgagacagggcaaagctcaaagaccttggggaaagtggcaaggcttgattaagtgttgctcttgcctgaccctgcctctgaattttagttcccatgatggatccctcttcctgcttcttctctctctgcctcctgccagatttccataagctcacgccccactggcctgcttctcttctcctcccctgcagccccgatgggccttctagctgctgctgacaaatgtgccttcctacaacatctaccatgatggaccagctctgcctctctctggcatctgagctacctcccatccccagatcctggggactctcctattgtctcctaagtgatctctccctctccaacccacctctcatctttctaaaaccctgctttgcattttgcaactcccaccttctcaacactcaagatcctacatgggctctttcttgccagatgaggcagttcagctgtgggctgaagactggccacaggcctatttaattgggcctgcatggtcttttaacaaaaaatgaaactgattgtctttacacagggcatgatctgtctagttagccacaggcaccacccctccctatttccttatatccactccagacccaattcatatacccatgttatctgcctagtctctcttagatatctgacaatgaagtccacaggaccctaggatccaaggccttccagtctctggctcccttatgtctctcaaaccagattgtcattactattcaaactccttattccagaaatcagtctgcccagtctcccctttctacccacggccctggcatggcctccctagacatatgtatacctgtctcccaccctgcctttcctcctatctgcaatgccttcccctttcctctccacctgttacactgaaatcaggcttatattctaccttctcaaagaggcctccatggaccatccaagcccacagcattttttcagcctaggccccctcattcagcccttatgtatatttctttgtgccttcagttatcttttttgagtacatttctcatttcctcaaataagcctggaaatagggttctctattagtcacacacaggaaaagccacacagaacaggtctgcctccatgtcatctatctctcatgtgacacaaccgttgactcataaatcttggtcatttcctgacaaccataaaccactagagcaagcacagattcacagtgccttcagggtagaggccatgtctcatagttagtacactgcctaaaacctagcaaggtagtcaataaatgtttatgatgagaaaatataaaatgcagaaaaaaacataaagaataaaataggttcaccactgagcagtaaattctctgacttgatgaaaacaacgcctgttgtgattcactgtcactcaggcatccaaggacaggtatattttgccaaggcaagaagttgggacccactagaagaagcaggaactagaaggtccagagctgcagccacaatgctgcagtaatttacaaagtgaacttggtcaaatctctcaacagtattgattctttgaggtaatgggatctttccgccacatactctgcagagttaacaacaatctggtggtgagggagagcaggtggctgggctggagggacaactgtcagtgcaggagggaagatgactcctgccaataactcttggttcccttaccccttatcccagcttctgtgttgatccctaggtccacgacagggcataattccagcaaacaccctttactcccagttcccacccaacatgtttgccatagatacacaatgaacatagtagtccccagctgaaattttcgaagtacaatgttaacatggaatttgataaaattctaccattggccagcacacaccatactattccagatgttgaattagcccagtgatatgacgcctgagtcacagacgatgaccacatttctcctttggcagaaatcaaagccctaagagagggtgttcctgagttctggaacatgaaaccttccaggaggctgggtgttggcaggagggttggatgtagttgggtactggaacctctccctataccttcttttcaaagaggtcaaatttgagaaatgtttctccaccttgcactcagaaaatattcaataattgtttgtttcagcttaagaggaaggtttcagttttctaaaaagaagaaaagccagaagttctgaagaagggggcatgagaggggaataaaagaagctgagtgcatttggtgtaatggaactgaaggggtctggaccagaggaaatggaagaagtaagagggcagggcagtggttacattggaaacaagaacactgatttgggaaaagcacttctaaactgactgccaagggaggtgtctgaaacagtggcgtggggggaaaagaaagaaccaagagccagacttgaggtaacaaatggctacatatggcagagacagaagaaagaagacagactcctggaaatgtggtgttggaagaggtgtcaagatggcatttgaacaagtgggatggagtgccatatgagggattttcttttttaatttgaagctgtcttccttccagcatcagacactgaggtcatctcagtccccacgttccccgtcagaacaggaagggatgtgtcaaacagcagcgtaggggcagcaactgagtggcaactgcatttttgcacccaccgattgacggcctgccctgaaaacaatgcctccctcccataggcctctgtagcaatgccatgaagcacacaggaaaatcatctgtgacaaaggtgctcctgggactagccatttcaagacaaaagtacgaacacccccggactcaatgtactgagtactggtgcctggatggcttgactctgaaaagaatcaccctccttctgatatgactctctgcacagcaacaagagagcccctgtgtgccaacaatctgttcatttcactcagcatttcttaaggcaaagctttaactgttttctttttttctattttaacagatatttgattactaaggcatgcaggcagtaaacattgaaagcaggcttctgtgttgcagaagcaactacaaggccacagaagctgaaaacaaatgtttcagaattcctcacgaacttaggcacatgtactttttttttctctctctctcttttttaatggagtaaggacagttcatcgatgaagcttatgaataataccaaaaggcctgtgttttggtcccaactcttttcagtcacagggcaaactttccaatcctagcaaaggtgataatagcagctgacgaactagctactctcgaaggatttgttagcaagagggggacagtttcttatgaggaccatcctataatagagctctatacacaagatgttggtgctgtatcacaggactcttgtcaagctaatgctttgtggccagggtctcatttataatgttttattcataaatgttgcaaaagtgaaatgaattattaatggaaagatcatctgtcagagacaggaatcattaacagaatttcgtaggggagagggtggtttatagggactagcaatgtaagcacagagcttttcagttctgtggtgaccatgtgttcagactgtcctgggtctccagtaacagagctggtaccatttgccatctgtcaaggcagcctctgcaaagcacacccggtcagcttcctcttggctacttgtccattttataaaatctgccatcatgatggcaccaacagtaggcttctagtccctgtgtccaggttacttggtgatagaactggacataaaagggcattctgcttgaatacagggcatggctctttagaatcaaactaaggtctaagagtagctaatatttacttagtacttactatgtaccaaacattatgctaggtgctttatgtgtattaactcattgaatcctcaacacctcaccatgccaaagatactattatccctttcttacagatgaaaaaactaaggcacagacaggtgagatgaattgctcaaggtcacacaacttggaattgacaaagctaggatttaaatccagttccccccgccgactccaaagcccctattcttaccaatgattttaataagcataaagtttgaagagtatagagctgtcattttccaggagatgttttcatagctgtcactagcatgctgcaaaacatttggatcaagggcgagctaaatgttgaaagagcatgtgactttacagaaatgaactttatagaaaccaagggagatacaagttataaacttcatgacttgggtccaatcgttccagccccctcacttccaagagactattaactgactctgaaaagtagagtatggagccagtctcctggggttggaatctcagctctgctactaaccttgagcaagacattgaaccttttcgggcctcagtttcctcatctggtaataacagaacttccctcaagggttgtcatgaatgctaaatgaaataaaacatataagttactcagaaccatgtataccccacaatgaatattaactattaataattttatcaatacgggtgtgtgggcaagaggctaagtccactcgaatctccttgtcttaaaaacagatctgcatagagttgttatgagggttaagtgaaataaaatcctaaaagcctggaacacgctgacctcatcataagaagcattcaaaaaatgctcatttcttttctccttcccaagataatactatcgcttaaccttcagagacctcggcttctcatattataaaattataagataaaacaagggccgggcatggtggttcatgcctgcaatcccagcactttgggaggccgagatgggcagatcacttgaggccaggagtttcagaccagcctgggcaacatggcgaaactctatctctactaaaaacataagaaaagtagctgggcatggtgccacatgcctataatcccaactattcaggaggctgaggcacaagaatcacttgaacccaggaggcggaggttgcagtgagcggagatcacaccactgaaactccagccttgggcgacagggcgagactgtctcaaaaaaaaaaaaaaaaaaaaacctaaaaaacacgattcttacctatttccctcccttgtctacctgacaggcatgtctcagccagagcccatctaaggccaagatggaagtgaggaaacctgggttctgcttttagctccagcatttgaaaagccacttaccttcccctcagcctcaatttcctcatttattcattgtagtacatctcaacaagtgtgtgccagatagggtgctagctgagagtactagctgttagatatgtagagacagataaataaggtacagtccctgacttcgaagggtgtatactctagtgcaaaataaaggcatgtaaacaattaagtacgttgattgttgtatggacaagactgacaggcagcccaagggaggcagtaatcagatttactccagtagggcaaaggaagattcaaagaagatagacctttgagttaggtcttacaaggtgaatgggagtttcccaggcagaactaggggaaaggtatcccaacatctgcaaaggcttaaagagacaaaatgggggaagcgcaaataattcattatagcttgagtataggatacatctaggggagttgcaggaaaatcggataataataccttaactacttgcttggcaggatttccatgagaccaaagagaacagtgtattaaaactgaaaaagacacagtactgcagaaacatcatgtgtgattattattagtactctggcaaggctctttatggtacttaattttcacccatttcctcctagcatgagaacttgagctatcgtttcgttgcttactgctactttgccttcttcctctctcccctaagagacaaaagaggatgatttagcatcaatctaagtggagaggagggaggaagaagtgagaagaaaaacaaccagctccctgttttaattaccacaagccctaagtcccttaacaacgataatgtttcatattttaaaagagttcagtgctttctggcagaaaaataaaccttgaccctcaagatcatggtttttcaaacgttcttgacgataactcatgataggaaatacattttatatcacaacccagcacacacacaggcacgcaaagaaaggttataaaacaatattgatacctgttaaatgcaacacactctgacattttctcttctttttatgtcattttaaaaagtgttgcttacaatctcatcagtgcatcaaaacttacagtttgaaaaacatcactaaaggacaggagggttcatggaagacttcaaaagaatggtttgcaagtcccttccctctttcttttctcttgtattttaagacactgcaaaataaagcaaagtccagcccattttctgggaaataacaaaacatttctgtgtgcacagttcacatggtgtgttgtttgacaataaattagacgtttccatgtggggtttcttgtgtgtttggttgctgtagctgattaggcttgttgacaagtaagatttcaaaaccctttcttaggcagggccttggtgctctttggaaagcaggatcgtatgtctccgatgtcttttcaatgagaacattcaataagcaacttttttcacataaagggccccatcacacattctaacccagaagtgagcaagcattttgcctcagggctgctgaaacgggaacatgatgccttgatgcctttccaatcatgcacacacagattgaaaactcacatcaccatcatcactaccaccactaccctcaaggaaagagtctgaatccccatgctgttagcttttgtgttcaaccaaaatcccaaagctggaaaggaacacaaaggtcatctggtctactctccttccaaagaggatagccaactaaactttgctggttcacaggtgagctatttttccaccgcaccacagcaagtatttgtactctgtggggccttcctcatggtaatgcacaagctttaaatgtttctatcatcacacttctgagtatgccatttctccctcttagaatgtgtcttcctccagcccatgcaaatcccacctatccttccagattacatcccagcccattaagaagccgtctccacactcaacagcccctgtccatcctttcctcttctgaaataagattaagctcactgaattcatgcaaccatgtacctcttagatactgtttaatagacagttaatatgtacttagagactgactttctaatatgtaaaagaagagggttcgtaagaaactttaggatttaattttttttttttttttttttttttgatacggagtctcactgtcacccaggctggagtgcgggggcgccatcttggctcactgcaacctccacctcctgggttcaaccaattctcctgcctcagcctcctgagtagctggaattacaggtgcctaccatcaaacccagctaatttttgtatttttagtagagacggggtttcaccatgttggccaggatggtctcaaactcctgacctcaagtgatccgcccgcctcggcctcccagagtgctagaattataggcgtgagccaccacacctggatggatttaatcttaaatgaatctttcctacaaaatatgtatcaaggagtaaatggaaatgtttagcattttatcataaagacatttaaatcctccaattattaaaaacatgagtattaagctattcatctccacataatcagaaccagtgattagatgatggttaatgccagcactgttgatttttctaatatactatcatttgggagatgcttgtttcaggcaattgaattcttacatgtagtatgtagggaactgggggctttctccctaggaagatactgtggtaggtgctgctgtcaaggaaagaggctctgtgcttggatccacagaaatgtttggtgctgccccacaagattcatattctctctctcaatctctctctccctctctctctctccactcttccttttcattcccacctttggttactaactgtcataaaggataattgaactttgtaacttgtaaagaacttaaagatggtctatgccacctgatgagggaatctaaccaagaaaagatgagctgatgtgctgcagatcacccttgtagaaaatgaaagaattgggggtaaaacccaaatctttctgttatctagagaaatcaggagctggaagtcttcagccttacaccacctagctcttgagtttcatttccctcgtccctgaacttcctgtcttccaccaggttcctctgtcttaccattaaggaacttctgaggtccttgacaccaaactgtctttcttccattaaccaattccccaatgttgtcttatctcaattgcatgacttctcttatcctacttggaaatttaattgttcattctggtttttctcttagtcaataccacacctgccaaaacctcccagctcctttcttttaaccccttccgtaactgttgcagacaaaattacatacaaaactgaagtttgtgaccatgactgtctcacaaagggtcctgttctctccacctaggattttggaatccttgtctctatcatgctgtatactatattataatatgatgagaaaagaaagttttctttttaagcaggcgggtaatttctcaagacacatagccaagcaaatgattatgcctacaagttaagcagggacagcagcacagttcattgacactatctgtaaataccaaagttcattctttatcaaaaacatcaatatcttctccagctcgaggggaaatgccgattaatgtgaaccctctttttcttgttcttgtccattttcttatcaatgtgtcaacggtgtcaaagcagaagacaggacaaaaagatgagcgtaaaaagtccagataaatcacaagtagccacagagtatggtggtaaatatgtgaactctagaggccagctgcgcagtgagtcttggttaacagctgagtgactggacacactgcttaaactctcagtttctccatctggtaaatgggtataatagtagcacctatctcacagggtttccatgagaattaaataagttaatgtttgtaaaaacacttaggacaatgcttggcacatattaagcactatataaatatttgttaaataaatcctcagtttgaaattattttaacaatcacactctgtgtctgctgacccccaaatcttactagcagtttcaggacctagaggcattgtgagggtttctataccacaccacacatactgtatcctccactatgaactgctacctgataattcattttataattccttctcataaggagtagacagaaatgtactcctgaatctctctcagcaacagtccccattgctgcagccacacacacagtgagaaacggcctctctgccttacaagacaagttctgtgaaaccacaaaagttcttgtctgcccacacattacaaattctacctgtaacccagaattagaactggggaggtggggcaataggccacctacttcagagaaaataaaacaaagggaaaattctacgaaaccacatgtcttcttggtacagggctcacaacctttctctcctccctttttttttttttggttttgtttttgtttcttaagacaggctcttactctgttgttcaggctggagtgccgtggtgtgatcacagctcactcaacctcaacctcccgggttcaagcggttctcccacctcagccacccaagtagctgggactacaggtatgcaccaccatggccagctaattttagtatttttcatagagatggggtttcaccatgttgcccaggctcttcctttctttctcaattttactccaatcaggctcttggctataccaaatgtgatgatctcaagatcagcacaagtccaccactttggtaaggccagcaacacctggtcttacaccacctctcaggggtaccaacactgctaatgcttcctctcctcgattgccttcttctctttcttctagttccccagagtctcctgggttttccatcccttctagggctcctttgctggctgccccttacctcctgacctccttacactggagggcctgccctacggctccatccttggtcctcctctccttcatatccacattcacgttcatggtgagctcacgcagtcctgtgatttaaaataccagtttccccccaggactctcaaatgtacatctccagcccagacctaaatcttgaattcctgagtcaaacatccaactgtccactcaataaaattgccacaccccttggatgtctaataggttcctaaatttagcttgtccaaaaccaaatcttcccccaaaacctcctcctcttcagtcttcctcatcttggttaatgacattccccaccttctcctccacctctcatcttcccctctaccttacccatcagtaaatcctttaaaaaatatctggaatctggccaggtgcagtggctcacacctgtaatcccagtactgtgggaggccgaggcaggcggatggcttcagctcaggagttcgagagtagcctgggcaacatggtgaaaccctgtctctaaaaaaattacaaaaattagccgggcctggtggcacaggcctgtaatcccagctacttgggaggctgaggtagaaggatcacttgaggccaggaggtggaggttgcagtgagctgagattgcaccactgcactatagcctagatgacagagccaggtcctgtctcaaaaaaaaaaaaacaaaaaacaaaaaaacagaatctgaccatcaccttcaactaccatctggccatggtgatctctcccgagtactgaaatactctattaacccatttatgccaggggttgcaaatttcttttgtgaaaaatcagaacttgtcaatgaccttgagcagtaggatataaataactcccacaagcttagcattccaataatggaacactaggcataaataggttaaacaattttcctgtttttgctattgcctcattacagcagtgtcttaaaacagtagccagagagataccattaaaatataagtcagatcatgtcactcccctgtttaaaaccttcccatagcttctcatctcacttgagactggcccagccaacatggagaaaccccatctctactaaaaatacaaaaattagctgggcatggtggtgcgctgcctgtaatcccagcaacttgggacgctgaggcaggagaattgcttgaactcgggaggtggaggttgcagtgagctgagacggcaccactgcactccagcctgggtgacagagtgagtgaggctccggcaaaaaaagaaaaaagaaaaaaaaatgaaaagctgaagtccttataaccacatgaccctacattatctgagtagcccatcccctaccccaccagctccctgacctcatcttctcctactccctctgctcgatccatgcagccatagtggcttcctggctggtcagggctcctgtgcttaccgcttctcccacctggaacacccttccccagacaccagtatggttcactccctgactgccttcacacctctgctcaaaagtcatcttccaggcatccctcacaacacttttttaaagtgcaaacgatacctgcttagcttagcactctccagctcccttccctgctttatttttccttccttccctgattgatttttccacaggagactcatcttatttcacttaatttgtttacccccattagaatacttattttatctttccttattagagtgtaagctccaggtgggtggcgatttatgtccgttcttgttcactgctgcattcttactgcctagtaagtgcctggtacaccacagatgctccgtaaagatttgctgaatgaatgggaatgatggcttgcttgggtcctcttacctacctaagacagtcatcaccgtcttcattagcttcatgggtgtcctccggcggctgatggacccacttgtatgcggagacaagacgttggttttcctcttgacgtacacgtagatccgcaggtacaccacaaccatgatgaggaaggccatgaggttggacactgtccagaaaacaaggtaactcctgctgtaaatgggggccagggaagagcaggcagagatgttgcagaggcaattccagcccagtgtggggaccgcccccataaaaatggcgatggcccagacaagcaaaatgagcagtgtcaccctctttttggtcaggttgctatggacccgcatcctcatgattgacatgtgcctctccacggcgataaccagcaagttggtgagggaagcagtcaagctactgtccagaagcccctgacggagaaaccagcggttgacagtcaaagtttttgaaactgggcctgtgttaaacatcaggaatacataggcaattccagcgaagaaatcggcagcagctaaattagccaacaggtagtagaaggggaaatgaaattttctgtttttgatcactgccgcgatgaccagagaattagaaaaaaaaataaacaggcagaaaaacgtcccaacacacaaaacaatcacaagctttgttcctgtccagtcatcgacagtatcagtgttgctcctattataaaaaaagtccatgtgcttgtcatagtgacactcattcattgtggagaagtgaacatcctagaaagaaatttaaagaagaaacaaatatcatttgtaaaatcagtcactaagccatcaattgctgtttctaagcccgttctggctaactcccatcaagggagttgaagacctgaagtgtcaggtctcagtgcaaatgtcctttggtccaggacatagcccctgacctcctaccacagcatttagcgcacattttaattgtttgtttcccaggctaggccgctcaggttaggagggtgtatctctattttgttcaccattacaaccctaggattcagttgctctgtctgcctcatggtgggtaattattggtaggttggctggctggctgaatgaatgaatgaattctcatggaggcatcaacagggcaaatgtgctgagccctgcaatatccactctgcactggtaacacaatgacaacacattatgttaatgcctcctcctggctcccagttcattagttatttatggatatgttcattaatcaacggcaggttggtaatttcaggtacattcttcccaagataataggagttgaattaccattcacataaccaaacagataccccaagagaccagttttctatgacttctgattccactcctgatcctccttttgccatcttttggtttcaacaaacaactctgatattcacatattaggtatatgatgcagggatggagactttggtcccaatatctcccttccttaccttttgttcacttcttccttatagtctcctaacccaaactgtaccaatgtgaacctgctcactggattttccagcattcctcaacacggcaggtggaggaggatcgggcttccacaggcaagactgagatttggaattggggcagatctccaactcaatgtggatgtgagaacatatctattaagtgagggcatgttcttcagacacttgtctgaaagaagaccccaaactgggatatcaggcagacagggaagacactaatcctctcagtaaaagatctcttgaatcccaaaagcgagggatcttggccaaggaagggctgggcagaagccccacggatgcccatctgtctacacgtggtggggaaaaccaagtgttctgcctcacagtggtctggccacagccatgaacggtcctacggaagaagattgggcttagggtcagggttctagcttcttggaagaatgaccatctgctccctcactgagaatgaggctgcagcttattccctggagaaccagagattcagtcggcagagggactgagcagccctctgggagctgtgacagtaaaagctcagtaaaagcccccagattttaaagttcctgaaaattctgaaatctaataccacaaccagaatcaagaagaccagataactattaagtagtacaaaatagaaatgtatctcagtcttttttttaatttatattttaatggtataatgatacttttacatgaattagatattgctttttggccatagcaaatgggaggtaaatatcattttatatgcttaaaaaaaactgggagtagtctcaagagacaaatggttccagtatctttcaattacaagaaaggaagactcaattttcataatgacaaaataaaaattactctctttggcagacagtcaccaatatttaactgtaaatatcaaataaattcatgataatatcatatatttacactatatcataatttccccaaattaaaaatacaggtagtataattttaatagcttcacaatattctattatatgaataggccacacctgacttaactaatcctaaatactggacattagggttgcttcctgtatttcacttttataagcaaggctgcattcttgttcattaatctttatatatctagccaattgtttctttaggaataacccatagatttcaaattgaagtaaaggatataaatctatttaagggtttctgatacatcttgtgaaactccacttaagagagatagcatttttttttttccaagatggagtcttgctctgtcgcccaggctggagtgcagtggtgcaatcttggctcactgcaacctctgcctcctgggttcaagtgattctcctgtctcagcctcctgagtagctgggaccacaggcgcatgccagcacgcccggctaatttttgtgtttttagtagagacggggtttcaccatgttggccaggatggtctcgaactcctgatctcaggtgatccgcccaccttggcctcccaaagtgctgagattacaagcatgagccatcacacccagcctgagagatcatatttttaattctaccagcagcatatgagagttaaatacaaggtgctaatctagtgatactcaatttaaatatttaaagagaaatacagctttcaaccatgttgaaagtatacagaaattcaagacaaacaatccgagaatcacttgctatggtctgaatgtttgtgtgcctccaaaattcatgttgacacctaaccctaactgcagtgatattaataggtggggactttgggaagtgaatgggattagtgcccttattgaagaggcctgagagaactcgtgagaccctttttgccacactgccattcaaggacacagcatttgcccccttctggaagcagagaccaggccctcaccagacaccaaatctactgatgctttgatcttggacctcctagcttccagaatagtgagcaataaatttctgttatttattaattacctaaagtatttttattattgcaacaggaatagactaagacaccacatgggaaaatttaataatacaattattatgtgtcttttctaattaaaaataatgtatatattttactttgtttcatgctctatacatctaagagaaacatttctaatttaaaagttatattatctttgactaatttattagaaatataaagatgaatatgtcacaaagacattggaattaagacactacaaaaatactactcaaattttcctaattttattttgaaggatcttaacattttagttttatttcttacatgtggtcgaatttttaattatatcaagcactaacacctcaatgatttttacttcaaaaatcttcaaattcaactgtcccttgtcaaaaccaaaacagtttaagacatgtttttagcaaaaattgccctgagactgcaaagcaattttgtctgacaaagttgagacatcacagaaaaactatgattagccagaactcccactaagcagcactgtaccctggttccagatcctacttttgagagaaacaggtaatgagagaaaaaaaacttcgcataggaaattggtgaaaaagattgcacaggatggaatactatacagtccatgaaaaacatactcactatgaagttgcggtaatacaagaaaaagcccatgtcattgctttaatatacaatacacataacaaaaatttatttgtgttgactatatagaaaaagataatgaaaaaaaatctcaaaatgtaaatagttaagaatggtggaactgtgagtcattttttaaaaattctttctaattttttccatctaccacattttctgtaataagtaaatcaagacttttaattagaagcatatattctacttaatgtattctatcttctacaattatggctttgaaaaatcaaaattaatgttcaaaggaaaagcctcaaagatttgcatatgttcagtttattcttacaagcacagcacacttcagggtttttcagtgacaacaaaaataaaatagttttctacttaatcttcacataaccaaaacttgacttgcaaaaccctgaccacacaaggatgtagctttcaccaattctcctataaaacattgcctaatgccatcaccacagatctccccagtacacgttatctacagattatcatactgtcttagctagaattaccaaaaatttttagcaagcttataacaaatgactgatttattattatctcttggcctcccttaacccttaaaatatgattctgtgattttgaacaaattaatcagttacttcagtcctagtctcaatgtcccctccacaaagatacttttctgactaattcaagatagctccacagctctcattctcagagagcccttggtttacctccatcagagctacccagttgcttgtgacccagtattttcttttgttgcttaagaatttattgtccatctcccacccctagaccgttccactccagcaaagcagggaacctgcctattatgctcatatctacaggatcagtatttgttgaatgaatgaatgaatctctgtcttacactatctttttccatgtctaaaatgaaaaggttctgtgaaatgcctttgctgacttatacatcaatcactaagtatgacaagtagcgagctctgtcacctattaactaagtgttttcaggtacattacttaatatctctactttattattactatttttcattattaatatttgagtgcttatctgtgccaggtgctgaactaagcattttacatggattatctcatggtatcctcccaacaatgatgtagatactattattacacccattatgcatttgagaaaactgaagcacccttgcctaaggttacacagctaggagtgggagaccctggattctattcaggcagcctcgttctacagcctgcattcttatctgcaacactatactttatctccacaggcatgtgaaacgccagacagaaccaaggactatatttatacttacaagagttacagaattaccaaaatagaatgatctgatcaaatcacattaaaagactgccccatgctataaaaaatagagggcattctaaatagcctttggcctttttttttcttaaccctgagaagacacttttctgaaaatatgttttcaacttttatggtaagtaggatacaatatggtcaatttcaggaccaggttaacattgctcaactttacttctgtcaaatcccaagctgttttttgtttgtttgtttttatactaaaggtttagagggtctgatagttctaacctagaaaaaaaagatgctaaactttggagcaattaccacaacttcaaacttcagtaatttaagacttcataaaatgatggtttagaaagtctatatgtggaatccaaatgaaaacttcatgagcaaagctttcatttagactcttccaaacttgcttccctgaaaaaatgtccagccagcccagaatgtggaaacaattatgagaattaagacatttgaaaaccactcaagcagcttttatttctagctacatcttatgagacaagttgctgcctggctttttagctggctttcaataacaatctctccttcctcctagaaagaagtatggtacatcaaagacatggtcagtcaatactgagcatatcttctttctctgtggttcacaaatgtagaccagtcctctcctcttaggaaactctatccagatgggagttggatgttaggttagttggtactctagcaaccaatcctgggtcagcaatcacgtctgttcactgaattccttttaataattcatgttaatggcaaaatcaggatagcatggaagatttaaatccacatgaaatcccagaggttcattttagccatagtttcaaggcctttgcacttgccattccctctgcccagaagacttttccccaagatacccagggggctcatttctctacctcattcctgctcaaattcatttcctcagagatcctttccctgccactctctaaagagcaccccaagcctccacccgctgctgcacttaagccatttaccctgctttatttttctccacagcatttctccatacctcaactatctacttgggctacggtctatctccccaacttctatttagtcattatgtctccttaggctcctcttggctgtgacagtttttcagattttccttgtttttgatgaagttatgcttaggaaggcagagaacgtatgttgttatggtgcctgcaacaatgcccagcacacattaggcactcagtaaatacttgttaaatgtagaattaaatgaagtaatgcttgtgcactcatgtctacatgctccctaacctttacccaaattcagcattattactttatgcttcttctgcatattctctaatttgggtctcacaacccatttattcctctggggagacttggctccaagtcctgcaagctgagaggtataaggagtgggttccctacctccagaaaagcagctcacctgagcagaccagtcagggtcgttctgaaggacagtctcacaatagagacctctctctattagtatgaacaccagaaacaaagattcctctttgaataatacttcaaaagagggacccaatggccaaagctacaacaatccaggcaacaaaataaagtagtactggattataacccgaagtataaacatccatgagtccatactgacataaataaattattgaaaaaaataataaatggaaagatgagacaaatctcccaggcagaagaataccaaataaataacatagatattccgctgtaaaggagggggagcatagctcctttatatgtaggctgtacacagggacctccttccaaagagcacaatatggaaatggggcgggcggtgggggcagttagtgacgtctcagcagagaaacttgacaaacactacttcagccagatgatcaaggtcaacatcaacagtgataagtcatattgctagtctgtaatcttgataagatgtattacttcatgatgaagatcagagagtaaatcacagtttactgtgatcttcctcccaaaaacccataaccccaggctaatcatgagaaaaacatcagctaaatcgcagttggggaacattctacaacatttctgaccagtactcctcaaaactggtactcatcaaaaacaaagaaaacctgaaaaacggtcacagccaagaggagcctaaggagacataatggctaaatagaataaggatcctgggtgggatcccggaacaccgaaaggataggggtaagaactaaggaaatctaaacaaagtacagattttagttaacgttaacatatccctatcagttcattaactgcaacaaatataccacagtaatgtaagatttaataataagggatactgtgtgtgggaggggttataacataggaactctctgtactatccgttcaatttttctgtatatagaagactgctctgtaaataaacaaatattaaaaataacttttaaagaggaggcatgttgttgactctactacactaattttaaaataaataaagcccctgtctttcataagcagttactttactctttgatatggtaaaataaacagaggagtggcaatttgttcaaaattaaatttaaacagacattgtaactgagaatgagatgcctctgatattcttggataaagcgaatatgtttattagaggggtgcttgttaagggtagggttacaattcggtttctgtatcttcatactctagatcatttctcttgagaaagctaaaccctcagtgttgctaaagtttgggtttggttactctgcttcttttgaacagttttttttgtttgttttgcttgtttgttttttttttttgagacgagtctctgctctgtcacccaggctggagtgcagtggcacaatctctgctcactgcagcctccgcctcccgggttcaagtgattctcctgcttcagcctctggagtagctggcattacaggcgcccgccaccatgctcagctaattcttgtattattagtagagacggggtttcacggtgttggccagactggtctagaactcctgacctcaagtgatctgccagcctcagcctcccaaagtgctgggattacaggcatgagccatggtgcccagcctctttagaacaaatcttaaactcagacacctaaaattgctctgatctggatcctgtttcacgtatcaacaaagtctccataatactggtcagtagaggttccaagaggagaagccacagagaggcaagcgtacaatgggtgtgcttgggaaaatacttaatacaaacgcaaagcttaagcatctcaggtcatcttcagctcagagatggtgacacgcagggaaaactgcagcctgagctcagcagaataaacaggttcttgtgtcagtgcaagttttggagacctttaggcagggaggacagcccatggcacgtcagggggctcacctactgttctctcccaatcaagtggggtttacagaaggtcttggtatatacacacagcttctaccctaggacttgtttaacaaacaactagaatcaaagatattgttccccagatgttcctgatggccaaagactgtcttaagcatattcattaaacaggaaagcaaacatgaaaacatacagaattgaactaaataaaagaggtgacagatgaattttatgggatcagcaaattccttgacttagtttatccaaacataacacaaatctttacttgtgtttgctttatataaaattttaatatttgtctaactcattaggctagaaagatgactaatacatcttgtcccttgactcataaaaggacagaaaaagtaaaagatgctaatcaaaatgcttaaaattaatattatttacacataatataactggacatggtctattatacagcaaataagccttagaccattgtataatcacatttcagtagctttactgtttgaaggggttgagaatgtcaattttttttttttttttttgagatggagtctagctctgtcacccaggctggagtgcagtggtacgatcttggctcactgcaacctccaccttcctggttcaagcgattctcctgcttcagcctcctgagtggctgggactacaggcccaagccaccatgcccggctagtttttgtatttttagtagagacggggtttcaccatgttggccaggctggtctcaaactcctgatctcagatgatccgcctgtgttggtctcccaaagtgctgagatgacagacgtgagccatcatgcttggccgagaatgtcaaattttaaagtgtgaacattcacagctgaaagagatattcttcttatacaaagtaccttgtcatatgcaaaaatatattttgagacatttcaaagtgcttgtttataccagtgacttctgctatggtataattatgccccccagagttcatgtgttggaaacttaatccccagtgcagcagtgctgagaggtaggacttttaagaggtggattaatggattaacactgttactgagagagtggatttgttatcacaggagtgggctcctgataaaaaagaatgagtttggccagatttcctctctgtctcgcatgctcgcctctcccttccacccctccaccatgggatggcccttgccagatgccagtgccaagctcttggacttccctgtctccagactctgagaaatacatttattttctttataaattacccagtctctggtattctcttttatagcatcagaaaatgaactaaggcaaattcccatgaaaaggaaattctatttctttacattgtaaaattcacaacagacaaaattttggtttaaagtatctgtcctaatccaactgtggtaccatattccctttctcattccatttttcataacctgtctcctgtctcctatcttgagaaggatagtcaggagtctcttgctccatatggtttgttccaaataatcctgttgccagtaacaggttaacagtgacctacagcaactccttcttgcttctggagatcatacacacccaggttagtgcctgtctgaatcctcaaactctacataggaaggaaaataatatttttaaagcatgcagctgtagcgggaaacagttattctaatcaaggcttcaaagatactaaagaagagcactgttactgctaaacaaacaagccagaggggctcctcgagaatgctatgccttggttaggaagcagcatccatcac

SEQ ID NO: 266 - DNA, 115400 bp, Homo sapiens
actctcctattttcagactcgcttttagatcagtctctagtgtttgaggcaaactaatttattttaaaagaaaaatatattgcatactgacctaaacactcaataattactttggcttaagaatgaataccttcatgtggacaaaatatgaaatttaagtataataaatacaagaattgattagatgtattatatgcttgtgaatttgaaatcatatattttgatcaagcctaaaaattgaccttaacctaaagcaagacttcattacctggcaatatcaaatgagagctggtccctactggatatcagctgttaaaagcccatctttttaactgaatacctacaaactcagctcaagaataatgcctacctcatctgagtagttagttgtacctgtccagtatctacagacctgagatgattccttaattccaagtctttggaacaacaaatacaattaatttgagagagtagaaataattccatagtggtaactgcatatacactgattgaaaccaattaacaatcatgggagggtgagaaacattgtttccctcctcttcattaaaggagggctaaattcattttgccctttgtggctaaaggcaaattcttgattatttttatttttatttattttttagtttttgagacagggtctggctctgttgcccacactggagtgcattgacgcaatattggctcactgcaggctctgcctccaaggttcaagagatcctttggccttatcctctggagtagctaggactacagggacacactaccaggccctactaatttctttttttttttgtagagaccaggtttcgctatgtttcccaggctggtctcgaactcctgggcccaagcgatctccctgcctcggcctcccaaagtgctgggattacaggtgtgagccactttgcccggcatattgttatttttatttttactcttttttggagacagagtgtcactctgccactcaggctggagtgcagtgatgtgaacatagctcactggaaccttgaactcctgggtgcaagtgatgcttccataaatgcaaattcttaatcctaatcttttttggcttagtcatatgtcccactcaccctgtccttttcttatgtcaaaagcggtcttcaagagcctccaaactcaagtggagatggtgatgtttaaataccatattggtgggctggagccagcttgcactaactcactagagctgatagttaaattttcaggaatttttgagccagttattagagactttattaaaaattaaattatgtaaacttacaattagataattatattaaacgtaatataatttatatttattaggtaaatataaaatgtaataagcactaaaaacatcacttttactttaccattatatcttttatatgatgtagatagtggaaattccacgtaatgtgctaccatgcatctcttcccaatctgcaatcagtaatgtcgtattggtagcctgaaatcaccacggtgggagtatttacgccatggaaatctgaaaacactacaagtcagaactccccacctcttctaccccagaacccattgttaacaccttaccagcacatcactgatacctgcccacagggccttctaagggaagttgttctccctttcccagaaactgcatctccatatgactccacacctttcctcccagacacagctggctggcctaggagtgaaaaactaacaaaggaagaaaacgtctataggccagaccaacctaatgctttctctttaggatttgcattaagattcatagagattggtagaattagtagccaagtcatgctcacagcagtgtgctagaatgaatgtccttgagctcttatgatgtaggtccctagagctgacccggttaccacacttcctgacacctcatagtaccacttttctctggattctctataattttatccttaaaatgtgtcttttacttgagctaatgcaattgctatttgattccttggaaattaatatgccttaagaaaaacggttttaaattccgtcagtttctgatgattgtaatgcaggaactatctagatgtagggcagaatatctaggctcaatttctggtagtataactcaaagaaaatcctttaacctggcagcctctcagtttcctcgtcagtcagtaaaaatggaacgagtgtatatttcagtggtatttaagccccagtagtctacaaagttacttcaggctccactgtgagagctgaaaaggaatctttaaatggacaaggtccggatttccctccttttccactacagacactctgctgttatctactttgtgttttggggcttaagaaacaagacttcttttggcaaacagttttcactaagcactcccctccccaccccacgcccaccaccccccaacaaaaacttagaaagattagaaaattcccagactgagctatctctaaattatttttggtcttctataactttatagggtaaatattaaatgttgccatgcatattacaaaaacatttgaacttttttttcagctgttctgttcctactgttgtttgcattatcttctcctagtagagcgtttccaaagaaccacggtggacttacaactaactcaactcagtcccaatctgatagcccagtcttagcagagatactgacctactttttcctgtgatttctgggcctggcctgataattttacttagcacagtgttctggacaaccaatatcaatcaactgaagttggcaggggatgaaactggttgccatcccactaaacttctgcaggtatgtacactgactaaccttatgctattcttgatgtctctaatggctccctctttattctgagctttccatctgttctgaagactgcccttctatttgtttatctgctcctgaagcaatttccccatccaacacctgacagtcgggggttagagccagaaccaagggtatgtactggttgcactaggccttacgatcacatacccactggctctgtccatatggacgcttcagaggagaaaatgctgcaagttaaagaagttaaaacactacattgtttgcttaaaatacaaagttccttttggtcttttccttaataaatacgaaaaatcactaatagtatcttcttagtagtcttcaagtagtaaaagatgtttattaaaatactccttggttaaatcttctcaggctatatcaagcttatataagctaaacttttcctttagtttccaattcttcaatcaattttattgttcttagttgaactcttttcaagctctacacattcctttaaagttgtatagttcataactgagcaaagtcctctagtaaataacacattagtataagagcattaggaagaaaatctatgttttcttctatataaactttttattgaagtgttacgtatataaaaatgttatagaaattataactggacagctctacgaatatttatagagtaaatacacgtgtcattggcacccatatcaagacacagaactcccaaagctcctttttctgccttctaatcacttccctgcacccagggagaccaccatcctaatgtctaatgttatttatatctatttgttgttgttgttgttgttgagcttttaaaatagagtaataaagttggttcttttgtgtctgccttctttacctcacttttgctttaaaatttatcccagtgattgcatgtagttgcaattcagtaattttcattgctttatatcatttcattatgtgaatatgccacatttttaaataatccaagccactgttgatgaacatatgaatagtttctggtttgttgccaattagaaatgatgctactatgaatattcctctatatgtctttttttttttttttttttttgagatggagtctcactctgtcacccaggctggagtgcagtggcgcgatctcggctcactgctagctccgcttcccgggttcatgccattctcctgcctcagcctcccgattagctgggactacaggtgcccaccaccacagccagctaatttttttgtaattttagtagagatggggtttcaccgtgttagccaggatggtctcgatctcctgacctcgtgatctgcccgccttggcctctcaaagtgctgggattacaggcatgagccacccactgtgcccagcctcctgtatatgtcttttgatggacataagtactcatttcttttcatgagtctttcacctaaaaagtgaaattaatgggtcataggatatgcatatgtccagcttcagtagacactgctaagcccagcgggcccaatcaaaactcaggcaaaggaaccactggccacagaggtttctggacaggaaaacaacaccccaaagatcccataacattttgctaccaaagtgtcactcttgtgtaatgggtgatcattatgttactatgaggttattctgcaccagaagacactttttaatggacatagaagctttaatcactatcagacatgaaaataggaaaagacaattgagaaagagcttccttgttttccggtgggaggctttgctggtagtaagtccgtcctgctattgcctgtgtcccaagtacataagaagtcactaccaccaaatggagaacaaagacacaggggattgtgggacttaaacagcagaaattgaacagtgagacaccatcaacaaagaccctggaaattatgtaaaacagactggatagacgtagtagtcaaaccgagggtgttactgctctggaaaggtagttaaaagtgtacaattgccagcttggttattgtccccagtgaaagatctaagaacaaaaggggaggtgtggccagtcaatcactgatgtttggccatggatgatgctgcattttcctcggaggaccaaaagaatggacagagccggctgggcactgtggcccacgcctgtaatcccagcactttgggaggccgaggcgggcagatcatgaggtcaggagatcgaaaccatcctagccaacatggtgaaatcccgtctctactaaaaatacaaaaattagctgggcatggtggcgctcgcctgtagtcccagctactcgggaggctgaggcaggagaattgcttgaacctgggaggcggaggttgcagtgagccgagatcgcgccactgcgctccagtctggtgacaaagcaagactccgcctagaaaaaaaaaaaaatggagagagccttggggaaaacctatggctttaaggctctagtccaggaggatacggccaaatcatagtaacaggataacttcagtgctagaatctgaaaatcacaaaatctgttcttgaatcaagctttctgcatgatcatactttgttgtccacccccctcccctttttttagagggtcttgctttgtcacccaggggctggagtgcagtggcatgatcatagctcactgcagcctcgaactcctggggcaagcaatcatcccacctcagcctcctgagctgctgggactgcaggcatgcaccaccactcctggctaattttaattttaatttttgtagagacaggttctcactatgtttctctggccggccttgaacttctggcttcaaatgatcctcctgccttggcctcccaaagtgctgggattacaggtgtgagccacttcacctagcccacactctatctgtgatccttctttgccagtcccttgctttttccctttggcctcccatctgtgttgattgcatttcctcattgatgtgctgcttggtttgtcagcttgtttagtgtctgatgggccattgtatttccttgtcacctaacttgccttcctatgttgacctccaccttccccccttttcaagacattgcttttcatttagtaaatataattgaggtcctaatgtgtgccaggaactgggctagaagatgcataccctggcctcatgttgcttagagtcagcttggctttgcctaatggaaaaagggtgagatacagatcacagtctttgggaatgagagctcatcaaaacagaaaacagaccctcagtgtcttgtgtaacttggtttccatagccctggatgctgaggaattgagttctagattgctggtgggtagcactttgaagaaaacagagcaagaacataccttccccaacactgtctcctatgtcagttttgccctaaggaagacagcatggaaggtggaaggcaatttgagaaaatgatgacaactttcccaagagagaagaagatggttgcaaccttgctctctgctggtagacttgagtggacctggggatggggtggttcatgtgccctgatacagatctcagatgtaactgctgctcttttaactagtcaagaatctggagctcagaatgaccaaaataaggaatgcagtatattttaatagaagttttgttaaacaagacattcctgcctattgcacttatattccactttttcaaacttttcaaaatcactaacgtatttgcaattttaaatgcagtagaaggttaaaataattagataaaggaatggatttttttttttttaaacatagtcttgctctctcacccaggctagagtgcagtggctcagtgatggcttactgcaacctccttttccccggttcaagccatcctcctatttcagcctcccgagtagctgggaccataagcacgcaccactatgcctggctaatttttgtattttttgtagagacgaagttttgccatattgcccaggttggtctcgaactcctgagtgatcaactcaccttggcctcccaaagtgctgggattacagacgttagcctgcgtggtccggggatggaattttaagttgaaagaataaaacaatcttaggccaattgtagattttcagaagagaaatgatacatgaaaaataccatgaagtatctttctatggtttactgatacacttggagcattttagttcattagaaagatgggttcaggggtgatcatctatttcaactccactattttagagactgtggcttccaaagcattataattaagatgcagcaaatccaagactggagtccagatttcttcacttctaatttattacttattcactgaggtatatgctttcctggaaaaccctttttggcttaatccccattgtttgaaacatttttattgtttcagaacatttctttttatttagaccatagtgaacgataagtggatatttctttcaaggtgtgggctctcactgtggagtaggggcattttgggggttattcttaatgctcagtagaattgacataaaagataagggatactgggttgactctatattgatccaacaatattacctgaaatttcaaaaaaaaaaggttccaaattcctaatatcatattttcttaaaatttttcctctgggaattaaactcagaaaaatatccacataacaagggaatttggttatttttgtgtagctatagttacagagcatcaaacgtgggaagaaaacagtaactattcttaaggaaatttcacctttagagggaaagtactgttgaaaattattagtaaagctgtttttgcacgtgagaggtattttatccaaagttctctgactgatctacaaacataaacttagcccttctcacagcagtacttagcttctaaccagataaattgtttgcaggagctctatcaaatttagaaaactatagagaaactacatagaaatctatacgtatgtgtctgtatttgtcatcttagatgaaggatgtcattttcctcatctgtaatgtgatgttattgtattacctccctaatcttctttagaactacttagcttttaacatgcaactagtaaaaattgatcagtttgtccaagaattctggcattagactataataagaatttatgagaaaatcaggaaatcatgttcagttcaaagtaaacagtgtcagaactattattataattttttttttttgagacagagtttcgctctgtcacccacgctggagtgcagcggcacagtctcggctcactgaaacctccacctcccgggttcaaacagttctcctgtcccaggctcctgagtagttgggactacaggcgcatgccaccacacctggcttttttttttttaagttttttgtatttttagtagagatggggtttcaccgtgttagccaggatgggctctatctcctgacctcatgatccacccgcctcggcctcccaaagtgctgggattacaagtgtgagccaccacgcccggccaatatgattattatattatatataatatatataattattacccagaagataatttatttggggaaactaccatttcacagaatatagagaaagcataaattgaggaaaatttggtgataaagcaagacgctatcagagtcttccttaggcattgactccataaaacccacaggctgaaactgaagaaaactcagagacaggttttaaaatacacaaaatttgttcatctgctacagaagatttttcttcttaccgcttttagcagctttaagaaagcaaaatgccattaacctctattaaaataagaggtaacagggtgtacctgatgtgctatttacatgcaaggtgttaggaatagaaattgcaggacctccaggagttcgaggccagccaggccaagatggtgagacccccatctctactaaaaacacaaaaattagccaggcacggtggcgggtgcctgtaatcccagctactcgggaggctgaggcaggagaatcgcttgaaccagggagacggacgttgcagtgagccgagaatgtgccactgcactctagcctgggcaacagagcaagactccgtctcaaaaaaagaaaaaaaaaagggaagaaattgtaggacctgagccagaaaaaactcatttggtcgtctctgaaagcctttagtctttacaagaattgccagaatcaactgatggtgtattctcttgtcactgcagcccaattgagaccactgtatttagttgtctgtccccttagatccacaatattttagggactcctggcaccattccatagtaggaagaaaaagctaacataattcaagttaccaaaactggggtctggggagagaaactgataggaacttcatctacactttctcataaaaactgatactgataacatagcaaacaaaaagtacagtaaaaacaaaaagatgacacaatacgcttctcatttattttatatttatacaaacagcgcttccctgaaaaatcagggtatcgttcaagattttatctttattcacagaagttttaaaatttttaacttttatatgcacaagacagttctgatttgttgaattaagtgaccgcgggtgtgctaatgcttctaaaaaacagcattagccttctcccatcaaaagtccggaagctgcccttcagtcgtcaaagtgtttgccttaatttgcaatcgttatgacttgagccaaatgcttatacctcatttgtgtcgtatatgtgaagatacaattgcaaatcgttcacgaccttgagtcaagaccttgagtttcctgaggtcaggagaccgttagggaatgtgagtgtcccagacgggcgctgagcccagctcggagacccaccccgcccgtagcagcggcgcgggccccagagagccccgcactcggccgcgcctcagttacgctgactcggctgtgcccgcagtgtcgcgctgtcgcgtagccaggtgtcgccgggctggcgcggttatttatgactgcgtggttgggctgggggttcggggccggggagcagccgggatccgccgcctcttccatgatcttcccgggccgaaccacgggaccgctacgctgaaggtggcgtcgcgggtccccggggccgcgcgagtgtaggggtcgctctcggccggccgcgaagctcgcggcaccgacttctcgcgagatttcggcgacccccccccccgcccccgcccctccgttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggtgagtgcgcgagcgcgcgtcacacctgcgcgggggatgtgaccttcgtgccgggtacgcaggaccctggaggctgtggggacggtgcaagcgctgtggccgcgggtgaggaacttcccgtgagcgaggctgacacctaggccggacagcctaggatccggtcacccacgtattgggaagaccagtgatgctgtccctgatgcatcaggaccttaaaggtggctgcagctaccaagtatcaatccaaacccaaaaccaacacccctccccctcttacaaaaaaagattcagaaatgaaggccatgacaggcagaaagtggaccgctgtaggtgtgggaaaaaggaactcctagattgcgcggggcgacagctaatgacccaggaggtctgttgcattagaatgagtttcgaagcagcggtctgagatctcaaaagccactactttagcatatgagaatttattagtcccaagaaaggaaatgctaaacctgcatgctaacgcccttatcatacccagggaatgttgatgttaccaggtctgaaaagaaataaaaaattgttcaaaaagagacataagtatttctctctttttccttcccccactaaagccagaatcccgttagtaggtaacgataaaacacaaaatggataggatagcaaatgtaggaggctgtgaatgacacaaactcctacagaagaaagtcacgtgaaaatgttcaactgtcattatgtagttaataatacaaggtaaagatgtgtgaaaggcaacagtgagtaaaggagcgtgattttttttgtcgcatcagtatatttaatagtcatgtaaatgactaggaaaattaaggagattttccttgcaaggctcgaagaatgtgaacggcgtagatgaaaataatttagaaaacagagagctatgctgtttctaatgcaatttttataggctttgttcttaatacgcagtggtgatctgatgtaagtgcatcatttcctttggtggaggttgtcaatgcaattaggttacggaatctgctttatggactatctagcagcagatcacaagcacataacataaagtccttttacacatgaatattcaaaatactaggaaataccctcaaatctccaccccctcccccttcacaaatacacatccacttttgtggcttggcaaggagcatagcgtttttcatgatggcagaacttttaattaaccatagttggtctaggaacagatcagcaaggtagggaattcaagtagtattttcttttctttcttaaaattaattttacttttacagttgagagatgttatcttgcagtttttaaaaagaccacgttcagaaagctagaactttggctccacgacttgctacttgtgtcattatggagaaattacttgacctgtcaatgcctgtttcctcacctgtgaaatgaggctaatagtctcctggggtgttatgagagttaaatgagttaacacagtatatttaaaacaatggtactactaaagaacattaaataaatttattttttggctgagcgtggtggctcacgcctgtaatcccagcactttgggaggtcgaggcaagcagatcacctgaggtcaggagttcgagacaagcctggccaacatggcgaaacctcgtctctactaaaaatacaaaaatcagccgggtgtggtgttgggcgcttgtaatcccagctactggcaaggctgaggtaggagaatcacttgaacctgggagacagaggttgcagtgagccgaaatcacacctctgcaccccagcctgggtgacaagagcgaaactccatctcaaaaaaaaaaattattttttattcgtttatttattttgtacttttgtgcagttattattgcttagtgtttataaaaatttctgttcattgttttagaagtcaaataatgttaaagtcctgtgtcttatgcttccctagcctctagtcctactttctgattgtcatgccttttgtatttccctctctgaaaacttttatgatctgtttatccctggtgcttgaaattttcacagtaatgagcttcgggatgtgtattttttcactgattgtgctaggttcttaagaggcctttcaatatggaaatccgtgtctaaaaaattctgtgtaattttcttctattgtttctttgatgatttttctcttctccctctttctattctctttttctggaaatgctgtttctttgaagttaaatttcctgacagatcctaatctaattctaatcattcttatatttcggttttaaaaaatattttcatctgtttatttgtttttatagcagatatcctgggctttatcttccaaccttcctactgaatttttttatttctgctattctacttttttaattcaaagagcgactttgtgttctctgttgttgatgagttatagcattctattttgctttctatatggctgctatattttctctttttgctgtaaggatataaattataactttgttttgccttctaaggatataaattataactttggccttctctgtgcattgctttgtttcttccaggttcttttttatttctgtttgattttataagctcttgctttcattttggaggttttcctcacatatctgtggttgttacctgtctcttacttgagaacctctcagagggtgtctgtgcataacatgtcctttcatctgcacgaaagggcttcttattagtgtaacatccaaatgtcagtattttacagctctttttctctgatgctgttgagcgtctacaaaaaataggagagatgagaggtgcagtagtcttctggcagcaggcacatgtgcacatatatgtaacaccacttatgttggtgagtattatgggcttcttattagtgtaacatccaaatgtcagtattttatacctctttttctctgatgctgttgagcgtctacaaaaaatagagatgggaggtgtagtagtcttctggaagcaggcacaggtgcacatatatgtaacagcacttatgttggtgagtatctaatgatatacttaggtattgttatctaatcctctgcttttagcccaactacttactctgattccatagctccatagttcccaaggccttgtccgttttgggattctgtatagcaaatattaataccttacttctatttggtctctgcagaactcaggtagtgcctctgttctcttaagtcaattatcactcctccatctcttcaattttataaaaattttataaattctcttgaatgttttagtttcccattcttttctctatcttagctcttttgtatttttacctttttatactcctttactgtgaatttaatgtggttaggggaagaagatgttgaaatagaatcatggagtcaatctgccatttttcagaaatactattttagtggcatgtgcttgtagtcccagctactcagggggctgagataggaggatcatgtgagaccaggaattcaagcctgccgtgggctattattgcaccactccattccagcctaggggacagagcatgacttggctcaagaaagaaaaagaaattttattttaaacctatgctgccacttcatttattattattattattattattattattattattattattttgagacatagcatcgctctatcgctcaggctggactgcaggggtgtgatctcagtcactggaacttcacctcccaggttcaagtgattcttccacctcagcctcccaagtagctaggattacaggcgccggccaccatgaccagctaattttttttgtatttttagtagagacagggtttcactatgttggctatgctggtctcaaactcctgacctcaagttccgcctgcctcagcttgcaaagtgctgggaatacagtcgtgagccgctgcacccagcccatttattatttttgatttttctgaagtgatataaatgattcattttgatgtttaaaactatagctaagaacttctgatttataaagtgtcttttaagtataatatgctgctgagcataagcctggcgtgtaaattaacctgtatgtgttataagaataatttaactgatgtaagtgaacagcagtaacttacagaaatacagttctcttatatgatagccttgaagatttttatgtcaaagacattggctctcaactcggaatgccttccctgactctatagatttgttgaaatatctctctctactttcagataatgtctttttttgtaattatttgatcattgtttgtcttctttacttgtcttagccccttaaggagaggcactgtgttcgtctttgtcacatttatgtcttcattgcctgttaagggtcctagcctgataggcacaatatgtatttgttgaataaataagctcatgctaaatatttgtatggaacatacactgagaaatgagtttaatattttgttcagctaaagcagttatttttagcatttgaattgggacgacttcagtaaaggtcaaaattccaggctttgggagatcagatcacgtggcactgtatttattttaattgtgcaagtttgggttgccaaaattttttagcaaactatggctttggcctttatttatattataaagagatgattctgattagaacctcaaagttttagccttaaagcactatttttattagtgggaaaaaattttgttctagaactgcctttttttttcatgcccagaataaaaaaacgattagattgcttaacatacttcagtgttttacttaattgtacagaagacatgatcttgttttatgatttgttcgccttaaaaagcttcaagcaacatatttgagtattactgtggagtggaaaactagttagacaaattttttatctctttcatatctgtaataattgcaaatagtcatacattattaagtttcctttaccatatgttttccagcctcttttgtcaaggcagcatatcttgagatgtgaggatataatgctttttcccagaatatcgaagaatttgccagatgcttacaggcatacgttttgccgtgcttcattttcttgtgcttcacagatactgcattttttacaagttcaagatttgtggcaacagtgaattgagcaaatcagttggcaccatttttccaacattatacgcgtacttaatgtttctgtgtcatgttttgataattcttgcagtatttcagactttttcgttattattttatctgttatggtaatctgtgatcatttatctttgaccttactattgtaattgtaccatgcaccatgaaccgcacccatataagacagcaaagaataaatgttatgtgtagtttcctccatgaaccagcttttccctagtctctttccctcttctcgggcctccctgttccctcagtcacaaaaatactgaaattaggtcagttactaatcctagaatggcctctaagtgttcacgtggaaggaagagttgcacatctctcactttaaatcaaaagctagaaatgattaagcttaatgaggaaggcatgttgaaatactacataagccaaaagataggtctcttgtggaaagagttagcgaagttgtgaatgcagcggaaaagtttttgaaggaaattaaaagtgctctttgtgaacacacagattataaggagacaaaacagccttactgctgagatggagcaagttttagtggtctatgtagaagaccaaaccacaacattcccttaagacagagcttaatccagattaaggccttaattatcatcaatttttttttttgagaccgagtcttgctctgtcgcccaggctggagtgcagtggcgtgatctccactcactgcaagctccgcctcgccgggttcataccattcttctgcctcagcctcccgagtagctgggactgcaggctcccaccaccacacccagctaatttttttgtatttttagtagagacgggatttcactgtgtttgccaggatggtcttgatgtcctgacttcgtgatttgcccgacttggcctcccaaattgctgggattacagtgtgagccaccgtgcctggccaactatcatcaattattttaaagttgtgaaaagtaaggaagctgcagaagaaaagttggaagttagcagagaatggttcatgagatttaaggaaagaagccttctccataacataaaagtgcaaggtgaagtggaaatgatgatgtgcagggggtagcaggtgatccagaagatctagctaggataactgatgaaggtggttacactgaacaacagattttcaatagagatgaaacagcctgttagtgcaaaaggctgccgtctaggactttgatagctagagagaggtcaatacctggcttcaaaacttcaaaggataggctggcccttttgttaggggctaatgcagctggtgacttgaagttgaaggcagtgctcatttaccattctgaaaatcctagggcccttaagaattatgctaaatctatgctacctgtgttatgttagggggactgcaaagcttggatgacaacacatctgtttacagcatggtttactgattgttttaagctcactattgagacctgctgcttagaaaaaaagattcagttgaaaatattactgctcattgacaatgtacgtagtcacccaagaggtctgatggagatttacaaggagatcagtgtttttatgtctgctaacacagtatccattctgcagtccatggatcaaggagtaattttgactttcacatcttattatttaagaaacacattttgtaaggctatagctgccatagatagtgattcctctgatggatctgggcaaagtgaattgaaaactttctggaaaggatttaccattctagatgccattaagaatatctgtgattcactggtagaggtaaaagtatcaacattagtaggagtttggaaaagttaattccaactttcatggatgacctcaagggattcaagatttcagtgaaggaagtagctgcagaggtggtgaaatagcaagagaactacaattagaaatggagcctaaagatatgactgaattgctgcaatttcatgataaaactttaacagacgaggacttgcctctatgaatgagcaaagaaaatggtttcttgagatgtagtctaatcctggtgaagatgctgtgaacattgttgaaatgacaacaaagatttggaatattccatgagcttatttgatagagcagtggcaaggtgatatagtttggctcagtgtcccacccaagtcataccttgaagtgtaataacacacatatgtcatgagagggacccagtgggaggtgattgaatcatgggggctggtttttcccacgctgtcatcatgatagtgaataagtctcacaagatctgatgttttataaaggggagtacccctgcacatactgtctttcctgccgccatgtaagaggtgactctgctcctctttcacctttcgccatgattgtgaggccttcccagccttgtggaactgtgagtcaattaaacatctttcctttatacattacccagtcttgggtatgtttttattagcagtgtgagaacagactaacagagtaaatggatactggtagaggggggtgctgttgtaaagataaccaaaaatgtggaagtgactttggaactgggtaataggcagaggttggaacagtttggagggcttagaagaaaacacaaaaatatgggaaagtttggaacttcctacagacttgttgaatggctttgaccaaaatgctgatagtgatgtggacagtaaagtccaggctgagttgatctctaatggagacgaggaacttgttgggaactggagcaaaggtgactcttggtatgttttagcaaagagactagtggcatgttgtccctgccctagagatttgtggaattttgaacttgagagagataattttggctatctgttggaagaaatctttaagcagcaaagtgttcaagatgtgacttgggtgatgttaaaggcattcagttttatgtattcacaaagatatggtttggaattggaagttatgtttaaaaggggagcagagcataaaagttcagaaagtttgcaacctgatgatgtgatagaaaagaaaaccccattttctcaggagaaattcaagccagctgcagaaatttgcaaaagtaaggagccaaatgttagtcaccaagacagtgggaagaatgtctctaggcaaggtcaaaggtcttcacagcagccccacccaccacagacctggaagcctaggaggaaaaaatggttttatgggccgggactagtacctttgtgtccggaattgatgggttcttggtctcactgacttcaagaatgaagccgcggaccctcgcggtgagtgttacagctcttaaggtggcacgtctggagtctgtcccttctgatgttcagatgtgttcggagtttcttccttctggtgggttcgtggtctcgctggctcaagagtgaagctgcagacctttgcggtgagtgttacagctcttagggtagcgtgtctggagttgttcattcctgccggtgggctcgtggtcttgctgggctcaggagtgaagctgcagatcttcgctgtgagtgttacagctcataaaagcagcgtggacccaaagagtgagcagtagcaagatttattgcaaagagcgaaagaacaaagcttccacagtgtggaaggggacccgagcgggttgccaatgctggctcgggcagcctgcttttattctcttatctggccccatccacatcctgctgattggtagagccgagtggcctgttttgtcagggtgctgattggtgcgtttacaatccctgagctagatacaaaggttctccacatccccatcagattagttagatacagagtttcgacacacaggttctccaaggccccaccagagcagctagatacagattgtcgattggtgcagtcacaaaccttgagctagacacagggtgctgattggtgtgtttacaatccctgagctagatataaagactctccacgtccccaccagactcaggagcccagctggcctcacccagtggatcccgcaccagggctgcaggtggagctacctgccagtcccgcgccgtgcgctcgcactcctcagcccttgggtggtcgatggcactgggcaccgtggcgcagggggtggtgctcgttggggaggcttgggccgcacaggagcccacggagtgggtgggaggctcaggcatggcgggctgcaggtcccgagtcctgccccgcgggaaggcagctaaggctcggcgagaaatcgagcgcagcgcccgtgggctggcactgctgggggacccagtacaccttccgcagccactggcccgggtgctaagtccctcactgcccggggccagcagggctggccggctgctccgactgcggggcctgccaagcccacgcccacctggaactccagctggcccacaagcgccacacgcagccccagttcctgctcgcgcctctccctccatacctccctgcaagctgagggaatgggctccagccttggccagcccagaaaggggctcccacagtgcagcggcgggccgaagagctcctcaagtgctgccaaagtgggagcccaggcagaggaggtgccgagagcgagcgaggactgtgaagactgccagcacgctgtcacctctcaccttgctgctttgtacattcttgagacttggtaccctgtgtcccagccatggccaaaatgggccaatgtagagctcaggccattgcttcagaaggtgcaagccctaagccttggaggtttccatgtggtgtatggaaacgcctggatgtccaggtagaagtctgctgcaaggacagagccctcatggagaacctctgctagggcagtgcagaagggatatgtggggtcagagcccacacacagagttcccactgggcactgcctagtggaactgtgacaagagggccaccatcctccagaccccagaatggtaaatccaccaatagcttgcaccatgcacctggaaaagccacagacactcaacatcagcccatgaaagcagccgggagtggggctgtaccctgcaaagccacaggggaagaactgcccaaggccgtgggagcctacctcttggatcagtgtgacctggatgtgagacatggagtcaaaggagatcattttggagctttaagatttgcctgtcctgttggattttggactggcatgggactgtagcccctttgttttgtacagtttctcccatttggaatgggtgtgtttacccaatgtctctaccccctttgtatctaggaagtaagtaacttgcttttgattttataggctcataggcagaaaggacttgccttgtctcagattagattttggactgtggacttttgacttaatactgaaatgagttaagactttgggggactgttggaaggcacgatcaattttgtaatgtgatttgggagggcccagaggtggaataatatggtttggctgtgtgtcccacccacatcttgccttgaattgtaataatccccacgtgtcatgggagggacccggtgggagataattgaatcgtgggggtgggtttttcccatgctgttgtcatgatgttgaataagtctcacaagatctgatggttttataaaggagagttcctctgcacatgctctcttgactgctgccatgttaagacatgactttgctcctcatttgccttctgacatgactgtgagacctccccagccttgtgcaactgttagtcaattaaaccactttcctttataaattacccagtctcgggtatgtatttattagcagcatgagaacagactaatacacaaggtttgagaggatggactccagttttggagaagttctactgtgagtaaaatgctatcaaacagcatcacctgctacagagaaatttttttttcacaaaaggaagagtccgtcgatgtggcagacttcattgttgacttatttgtaatcccagtactttgggaggccaaggcaggcagatcatgaggtcaggagattgataccatcctggctaacacggtgaaaccccgtctctactgaaagtacaaaaaattagccaggcgtggtggcagtcgcctgtagtcccagctgctcgggaggctgaggcaggagaatggcttgaacctgggaggtggagcttgcagtgagctgagattgtgccactgcactccagcctgggcgacagagcgagactctgtctcaaaaaaaaaaaaaaataaataaataataaataaataaaaataagaaattgacacagccacctcaaatttcagcaaccaccactctgatcagttagtagccatcaacatcaaggcaagacccttcagcatcaaaaaattttgatttgctgaaggctcagatgatcattagcacttttttagcaataaagtatttttaaattaagttatgtactgttgtagacataatgctgttgcacacttaataggctaattgtagcataaacataacttttatatgcactgggaaaccagaatatttatgtggctcgctttattgcaatatttgttttattgtggtggtgtggaactgaaccttcagtgtatccgaagtatgcctgtaaatggagaaaagtcccagttttttatagtgagggaagttacatagacatgaaattgaagataagctaattctatgtggaatagcattgttgtatgagaagctaaatagctgatcccctctcttagtttcttcaagtgcacgagagtctggatgccttataatggcctgaccatctaatagagtcacatacaatgatttgagtagagattacttttcagttttagtaaatatttgggtttaatgtgacttcttaattgattctcacatataatgctatatataggattatacatacataatttggggctggactattttataagtgctaagtaatatgtagctgtcctcttacagattgaatatgtaatttatctctagtaatttttgagaaatgaatgctattttctacccaaagattaaaggaaacatttgggatcattaaacaatgatattaaccctataaaataattttatatatttatggctcagtgtaatattttgatatgtgtatatattgttgagtgattaaatcaagctcatgaaggtatccatcatcttgcattctttttttttttttttttttttttttttttgagatggagtttcgctcttgttgcccaggctgaagtagaatggcacgatctcagctcactgcaacctccacctcccatgttcaagtgattctcttgccttagcctcctgagtagctgggattacaagcatgcgccagcacgcctggctaatttttgtatttttagtagagacggggtttctccatgttggtcaggctggtctcgaactcccgatctcaggtgatccgcccacctcggcctcccgaagtgttgggattataggcatgagccactgtgcctggccccattatcatatttttaaccttaaatttttaaagcttctttgaggaagatttattcattacccacgctataacatacaagtcttgtatctcaaaagattttaataaatccttatttaatgaccaaattaattaaaaatccagaaataaattacaatttttctaattattatagttcttccaaaatcttgcttatacagaatcatttcattcatgcaaatttacattggactttatggagatcagaagatcacataaacaccctaacagaaggggaaaataatagatgtctgttaccttgtattacctgtaagcattaatgattggatactgagtcgtagtagctttagcagtaatggtgaatttagtaacttacagtttcatgaaatagcaaatgcagagattatatatttttattttctcccccataaacatatgaaaaaaaattcattttctttagaggcatccttagacttcagtattagtggctggtcaaatgctttaatgtttttcttatttttatatagtggcacatgtaaaattatatatggtagtcccactgtatctgctggttaactttccatgatttcagttaccagtgaccaacctctgtctgaaaataataaatggaaaattctagggttttaggggtcaggaaaatggaagaatcaagggtgttattcaagtgttttgtcttgggcaattgggtggatttgctgcaattcactgagactaggccttcaggagaaaaaacaggttgggaataatgggcatggatgatgaatctgtaacttgtacaatagatcaaggtgtcttttggacagctgaaggtaaatttccatttggatgcataagtcagaagctcaggagagaaatccttactatagaaatagatttgggaatcatcacgtattaaaaatcataagaatggatgacattgttcagaatatgtagaatgagaagagaaaagcatctaaggagagaactctggtgagcatccattacttaaaggaccggcagagaaaagaaagtctgcaaaagctgaaaagttgggtcaagacaggttaaaaaaaaaaaaaagtcagggggccatggaagtcaaaaaaaggtaatactatattttcggaaaggaagcagtcagttatactgaaagctatccaaggaggtcaactgagatagaaatacaaagtgtgcattggatttagcaacaaggaagtcatgggtgattttgtgaagacattggaggtgataatcagattacagttggataagctgagtaaatgtgaagaaaaggtaaagtggactaagtgaggtaagtgttgacagccatatcaagaatttgtctctgaagaagagagaggatagtagcctgagggacatggaattgattttttttttttaagatggaagaccctcgatcgtgtttaaatgctgatggaaaaaagaagattaaatttaaaggaaagagaataattgatgtgataaggacccaggtgggagtaggagataaaaattaaagcccaaggaaagagtttaatcttagataataggagggatgctgtttccattatgacaggaggatggaatgcaaggacactatatgtatgcttagtggcaagtagttgaaggtgttcttcttgcctgatggcttctatattctctgtgaaataagaggtgatgtcatcttctcggagcaagatacagaaatatgcggagtaactatgatagaggtttgggggaaagtggaggattgacctagccactgtaaaaaactagaaaaccatgaaatctttacatttgttcatgttttgtaattgcaaggctcaatatgagctttttaacaatgaaagtaatttttaacttgctcatgaaatgcagttttttcatggtcacaacttttactattctaatttataagttgttgatgttatctcttttttgatttgtataaaccttagtaatctgatctaattagtactttttttacccatgatgcaatatttaacttacacagcaaatgcaccaaacttataatacaatgcagattttgttatttttgtttaaacttgatagacaagttttaactggataatattagatctcactgctctcctgtaattgtgccaaacgctgagaatgtaacttcattttatgtaaacactcctgtgataaagaaaaaatgtgtttaaaaaatcaagcaagctcgatttatggcattgtctatctagcattaaagaaaatgcctagtcatttgtgtattaaacaggattttctagatttattattttcttccctttcctctttaagtaagtccttacccctttattctctgatgtattgatatattatgtaagctaagtaaaatatggaacttcagtgctgaattgttttattggttaccatagtagtgctaccatagcatagtagtgtttttgctcattaaagagttatttttctaaattagaaaagtagaatctatgttttctgctttttttcctattttctaattaattgtcttctaacccttctaaaactccatttctagaatttagagtacaggaagtgtatacaaaagaatttcgaaacaatccttttttcctgtctgataaggatgatatctatccagttgacactgtaagtattgactaggtgagatatttgcattgtcccttttcctcaaagggttataatagatggtttaaactgcttgtagcaattcaaagtgattttttttttttttttttttttttttgagacggagtctcactctttcgcccaagctggactgcagtggcgctatcccggctcactgcaagctccgcctcttgggttcatgccattctcctgcctcagcctcccgagtagctgggactacaggcgcccaccaccacgcccggctaattttttgtatttttagtagagacggggtttcaccgtgttagccaggatggtctcgatctcctgacctcgtgatccgcccgcctcggcctcccaaatggctgggattacaggcgtgagccaccgcgcccggcctcaaagtgatttttttaactggtttcacatcagatcagaaaggtccttataatttaggcacagtttaagctagctccaacctattaaagttagttattttaaaataatatcatctaaacctcttccaactgctttaaaattattcttactaatctgacaataagaggttacttgtaattgtccatatacatacattgtccccaggatattgagaaaggttttgagatattactatcatcaagcttaaaaatatagtcataaggacagtgataggcaggttttggactagggcttgtggtgaatggagatcagtgtgacttaaacattacttcctttctggactcaatctttgctgtcacatgacctcctccagactgctttctatccaaataaatgggtcacattaggattttatgttcttatagtaaagaatacacttagtaaccttttggtccagtactgtgaagatgtgctatcaaatatgtctgtctgattctctctgtctgcctgctttgttgatgaacataaaagtcaagtaagagttttgattcaagtcttttataatatgaacttaacaaatcaaagtcaagacgtcctatttggagagaaaggtaaaatatatccttcatactttgattcaatattgtaaattttgtgagttataagtacaaatattgggttctaatgtgtattaaatagtgaactatgaaaaatatcccacatatatgtcaccaaataattaaaatcctgaagttattctgaattatagcagtcgtttataaatattctaaaaccttaggcaagaatgcatacttaaggttcttgccttttgctagcaaatgataggagagcaacaatttgtgtctttgttcctatacccacacctttcacatagcagaatttggaacatggttaaagccgtagattgggttgaacattgatgttcagtagagtggtcaaaatgggaaggatatgaacctgaaagttcattatctgaatgtcagatatataagagcagaagttacccaggtagtaggaggctgttgtttggttccaggctaatacagaagtcataaaaacatgtctcatatattttggtgataggttttactcaggaagcagtctgttaggatctacagagaaagtagcattcttagatggtactgtgtaattctagtatcttcttcagcagtgttttcttaattgtaggagagcagagtagctccctaggaattaaaaattttttttttggaaaaacaaagcactgaagacagagggatcagaggaatgtaacctagaaaaattggtgaaaacattgtggtatattgattgactgattcacagtactacatcctagtccaaaagcaatgtggatcttcatgtagttgtttagcttgtgcttgggaaaatatagatcttcctccttttccctttccacatgtcctcactttacagtgacctccttgcctgtttctccttacagttggcctctacagcagcttcaggctcagagattatagtgattaaggaaataacataggctgaaataagtgaaagcaggtgtaataaggagcagttggcttggggtgggtcaggagacctgaatgaaaatcatgatgctgccattccttacctatgctcctggagctaagggaacacgttttaattggccttccagaaattctcaaaaaacaattttatctgtacttcactggccaaaacttggtcaagtggccctgtctaactgcaacaaagcctgaaaaaggtaacctttatttcatatgtctggctaaaaaccagggctcttttttttttttaaaggaaaattggagaatgaataatcggaggtatctgctagtctttgttagatgaagcctatagtgttgagaaagaggcttttaaacgaaaatgctcaaaaataaattatggaatactttgatgttatgaggtagatagataacatatgtttttgtccacagttcctggctcgtaactaccatagtccttgataaacagactctctctctctttctcctgcctgcctttcacctgcccacagcaggactctaatctgattgaagatcataagactttcattccagggagcatcctgccccataccctggaggaaggaatgctgcacagagaggtcaagaagaatctgaacagacaggcctgctgggtttagatcatatcttttttatccagtcacatttcaacatggttttccatgttttagtcatgcttatgaagtccccataaaaaggcctcataaaaagtccccaatgaagtcccgataaaaagacccaagagggcagagtttgggagtttccagatagctgaacatgttgaggttcctggagggtggcatacccgggctggcagggaagctgcatgcccctttccccatactctatcctacacatctatattagtctgttctcatgctgctaatgaagacatacctgagattgggtaatttataaaggaaagaggtttgatggactcacacttccacaatcatggcagaaggcaaaggagaagcaaagtcacatcttacatggaggcagacaagagggcatgtacaggggaactcccctttataaaactgtcagatctcatgagacttagtcactgtcatgagaacagcatgggaaagacccgcccccatgattcagttacctcccattgggtccctcccgtgacatgtgggaattatggtagctacaattcaagatgagatttgggtggggacacagccaacccatagcatctcttcatctgtatgctttgcagtgtcctttataataagccgataaatgtaagtaagtgtttccctgagttctatgagctgctgtagcaaattatttgaatccaaagagggatcatgtgaaccccagcttgaagctagtcagtcagaagttctggaggcctggacttgtaaatttcactgaagagggcagtcttgggaactgagcccttaacctgtgggatctagcactatctccaggtacacagtgtcagaattgattggaggacacccagttggtggctgctgcagaactgattgattgcttgatgatggggagaacctcctcatacctcacatttggtcacagaagtcttctgtgatgattgttgtgttggtctgagagcagaggaaaaacatggtttaagcgtttacaaacaaatacctccttgataaagttttatcattttggttttggtaatatagaatcagtcataaaaatcttttaaatgtaactaaataccacactgtacttataagaaattgagagaaattgccagggacagaaataaagaagaaactaataactgcaatggtgtgtgaactgtgagttacttgggggaggagaggtgtcatgattcatggaattctaggcacttggactttagtgctcatgtggggacagaaaactagaccttgggaagctggaagtgagatgccacctacctaacgccagaattctcgtcaaaaggatggacaaggaaaaaaatcttatgtctggtataagctgatgacatgaaacctgcaaatttcctcctgggctcagagtagaaaagaagactcttctgagaatgtatacacatggctccataccacctcatgtgggctcagggttagaagttacattacccaagcagagaaggagcagacatagctggcagaaagaaaagcaaaacttctttggaaggaaaagcccttaacactggccatatgtgattcctatggataaaatctagatgagaatgagctcgtaatccaaagcacaaaatatatgaagttctgtgatcaagagtcagtaaactgaatgattggattcctaacagctggataataggataatttggttgagtctgttacttaagtatattcaaaatcattgaagatacaatgaaaaattagcatgaaaaagcagatcactataaagaatcaaatagaatttctagaaatgtaaatatagccattggaggccaggttggctagacagcatataagaactgtagcagcagttaataatctgaaagataattttgaagaaactgcacagaatgtaacacagaaatgaagatatgtcaaatattatgaaatatttttaacatgtggaaaatagactgagacagtccaaaattcatctattaggggttacagatgaggaggagagagaatgagaaaggcagtatcccaagagataatggttgaaaagttcccaggaaggaacaaagacattaatcttcagattcatatgtcctgagcaagatcaataaaaatatttagtcacattgaagtgaaactgtaaaatcaaagataaagagagacaggacagacttcctacaaagggactgcagttgacctgattatagacgaatccatcgcaacagacagaagccagaggacagtgggctatatcttcaaaagtgagagaaaataactgccacttagatttctatacctcggtaagttatttaggaatgagaacaaaataaatttattttcataagagactgagagtttaccagtatcagatcatcattgaaagaaccactgaagagtgcatatcaggaagaaatgaaatgaattaacataaaaaggggtgaaattcaagaagcaatggagaacaaagaaattagtaaaaatgagagcagttcttaaccattgattgtatacaacaacaattattattattttaaaagaagttacaatgaagtggatttcaaatagtgaacaactgatacgcaagatagtgggccatgacgagttaaagtgtttcatgggggaaaccaagatcccttcttcatgtcataattatccaggtggattagaatcctacatgtgataagtaaaactttgagatatttagaggaatatatatgtttcgatgttcgaaacaagataaaaagcaaaacctagaatggaaaatattactacatttcacttcatttaaaatatttaataaaataaaaagaagtcctggaatggaaaaagatatttatagtacatagccctcacaaggactacatatcctaaatgtgtagatctacaaattaataagaaaaagaaaacacgatagaaaaatgaaatagaaattcactggccttaaagaaggcaaaggagtagcaaaatcacatcttacatggaggcaggaaagagagcatgtgcgggggaacgcccctttatataaaaccatcagatctggtgtgacttattcactatcacaagaacagtgtgggaaagacccacccccatgattcagttacctccccttgggtccctctcatgacacatgggaattatgggagctacaattcaagatgagattttgaattgaatcttcttcacaactaccacttctttatttcattttattttattgagacagggattcactctgtcacccaggctggagtatggtggtgtgatcacccctcactgcagccccaacctcctgggctcaagatatcctcttgcctccgcttcctgagtagttgggactacctcatacatcaccacacccagctgatacatttttaaaaaaattgtagagacaggttgccactgtgttgcccaggctggtctcaaactgctgggctcaagtggtcctcccaccccagcctcccagagtgctgagattttcgacgtgagcaaggcacccaacctgtctttgaacctggcctgggtgcatatactctgtaatatgctgggaatttatgagcttattatggatccatgcaaataaacagtacacagttctgtatttcggggatggataacttactccatttctttgaacgtcagccgttttctcttctttcataagtaactgaatatttcagactgggaacatttcagacttttctcttcgatgatgagactaaatttctaaacaatactcttcaagtaaaaattttaacccatttatgcctagtgttccattgtatcctgggacactgagccaggaagaccgagggaagggtggtagagcatgaggcagtgaaacccacaagaaaaagccagacagtaggaatagttttatctccttggacatatttggagaatatctaacttatagtgccacagaggttctagatatttataaactttgtgcctggagttgagtagccaaacactatttctggacctagctagttaatagtacatcaagaggtagagtctcttgattctgtgggccaagggaaaaggcagtatttgcatgtagttttcatttaatctttacagtttgtgggcttagtatttatttgtccattttatagttgaaaatgctaaagtttgcagaaagttaagttatttttcccaaggtaacctaactaggaagggatgaagctggcatttgaacgtaggccggaaggattgcaaaacccatatactttcattccaatataacaagttgtgtaatgtgaaaaaacactgggttgtgtgttgtaatactgaagttctggtcccagacccatttgctgcctgtgtgaccctgttgaaggcccctatagattaagttaactcttttgtacagttgcactaataatatatgtctgcttgccttttaaaaaataatactccattccaaaatttatctacatctttacatacatatattcctataagacatgaacttttgtttttttactcatttttctacaacctgtttttttcaccctagtgtgtatcttgtgactgtttctatggtagcacctctagatctaccatacccctttccatagtcacaaactattccatgggtgtgccataatttatttaaccattgtcctgctgctggaaattttgattgtttctattttttcactattggaaacatgctgcagtgactatccagggatcttaagtacatgcaaatattgaattgtcggatctatagctattaaattttaatagaaacttaaaattatctttcagaatggtacgctaagatttacttctacatgtagtaagtaatgagcagttttcttacaagtgctgtatccctgaacaatatacatatatttttgtgaattttaaaaataatatgtccttctataatgtatatattttatttaatattatatttaggaaatttatacatattgacacatgtacttctagttaatttactttcactactgtaaaatataccactttattaatatttcattaaactgatataatttccatttttattgatatttttgtgaagattgataaatggtcagtttatatagtccctgtttattaaaagcaaaattaacaagcaccttattctgttactcagatcctttttcttatttggcttctctatttgatctgtccatttctagttgagatctattcaagtctcagccatgattgtgaactgataaattttcattgctattctctaacagtttttccattatgtaattttaagctgtttagttcatgtgtgtaatatctttttggtgagtttttctttgtcccatttaatgcttttgactcttaattccatgtattttttaacattctgggtaatgtttaacagtgactcttgtaggggacatttttatggctttttaaaaaacgcagtataagagttgctctttttcaatgggggggtttaaacctatcctatttattgtgattgagaacatgtttgcatttatttttgctgtgttattatgagcatgtgttaccactttatcacctggcattagattggtccagtttcttattatttctctccctcgagtagtttgaaagtcatgcatcctgtttctggtcttcaattggttacacataacatttaaatggttttttatatacatctgaaacttgaggaaaaatcagtatcagaaaattttttattccaaaaaagttcattgaacatgttttattacatggccctccccaccttatatttttctgaagtcagctacagtattagtaccacataggtattggttttttaatattatgttttaatttttttatattttaatttttaaagcaatcaccatttaacaattatagtaagctttacacccacattcacttattcatttattcagcaaatagttgagagcctgctagaagccaaaaactcttctaggcactggggaaactaaagtgtaccaagtaaacaattcctgcgttcatggaatttatattgtggaatgcaggagacaaattttgtatttctcagcatatttataatatttgaaggctagatgagatcatcaagtgggtaattgtagatttaaaagaggaaaggaggtccaaggattggccctagggcagtgtagttgggaagtaccagcaaaaataccaaacaggaatacccagagggataggaggaaaagcaagacagtgaaatcttacaaacagaaaataaatgatttcaaggggaaatgagccaccaactgtgtcaaatgctataagaggaaaactgagaagtgacctttggatttagcaacaaggaggtcattgatgaccttgacaagcagttttggtggcatggtagagaagagagccttgctggagtaagatcaaaagagaatgagaggaaatgtaaacaacactctccagtagccttgctgtaaagggaaggagaaaaatggcagggaggagagcaaaggtagctaaatagagaggagggacagggcactttctaaggtgggaggaatagcaccgtgcgttatgctgaaggagaagtatacagtggaagaggaaaaaataggttggcagggccagggcagtattgctgaaccaaagtctgaataggcaggaaaagaggaggtctacatgctgaaccactatgctatactgcctctagagaaaaagactttcatttatgtcatctttcaatcaaataatgagatgatgtatgtgaaagtactttataaacttgtaaagaaccctataatgtaagctactataataatacaagtagagacttaaatttttttttgttttttatcatgatacataatatttgtatgtatttatggggtgtgtatgatattttgatacatgcatacagtatgtaatgatcaaatcaaggtatttaggttatccatccccttgaacatttatcatttctttgtgtcaagaacatttcaaatcttctcttctagctattttgaaatatttgaattttattattaattacagtcaccctactgtgctattgaactctagaatttaatttcttctatcttactgtgtttgtactcattaaccaatctgtcttcatttccccaacccccactcacccttcccatagtctggtaactatcgttgtacaattagaggccttaaaaattataaatggtcagttgctttatctagcaacttttaaaaactttgatctcagccagggaagtactattagcttgtcttcagctgtgtgtatttccacacagacgcatttactaagcatcaaaacatttcacttagagtacttgggattttcccacactgggaatttgaggtttaacctttcgaccacccagcaagcaaagaaaatgctacctcttttatcttcaagatgcctttaaataagcctgaagccatttgggaaaaccaaatgtaatacttccatgaacatcttttttagctacttgaatagaatcccatgcaagtccataagattcttgcccagataatatagtgtagaaatataaatttgcaagattattttttatgttttataaaaatgttggtacagttgccaacatagggtaaatcctaataccagtgctcaattccctacatgaaattaatacattttaaaatcactctttaaaattttgaataaaacaaatgtgtcttaaagaaactaataaggatgagtaatctaaataatattggtgaatacaaatgattttaattcttctttcattgttcattctcatttctctgtttcacggttgctaaaaggtaaggtattatgcagagtaaggtattatgcagtttagataattgatataattgttttaaattgcctcttttagggtattatcagctggtaggcgtaagtttctctaattgtcaagtagtgaatcctttatctggcatttaatcttgcctccctgggaaaactagaccttaacacagagtaaatttttgaattgctgacctgaagtaacgtgagcctgtgccttggcaatgaacctttgttttctgtttttataggaaggataatgatgtactctgttgcctgaaggccctagcctcactaccttaacaagtaacatctaagtaaggttgcaaaggtctgagtttggaaattccagagaagataattgtattgacacaatatttttatttttctgggaaagatgaggtaatttaaaaatgaaacttttgtcattttttaagcttctcatcttagttctgtcaacatgacttaaagcatccaccaagttacctaaaaagaattattacttaatttttatgaagaaatcatgtatatttttatcatttcaacgtaaattctcataaatagctcacaatttctcaataaaacagaagaaatagagctttctagaggtagaaagaagaagattccctaaacgtttttagcaaatgtgaaaagggtgtcaggcaattcccataaaataatttcctagaaggtgtaaggtgtaatttcctagaaggagtaacatgaaatggcaaatttcagttatcttttagctctcgatttctgtgatttcatgtttctactgtgtggcctcacacttataaataaggtaagtcatgtgccagatctgtgatctgtgcttgggcagttttctgcaggagctttgcaaggtctttttgatagaaaaaaaattccgtttcagcaaaatttgccacatctaaaaatactgcaatgataccttaccttgaacttcacaatgtctatattttcctattcggtgaaaaatagcactataaaaagtttcacatatctagttagaatattcccatatgaagccaagaaattgtaatattattacatttactaggtaatatttgacaaaatcatacatgccatgatttcattattttgaagtttgatgatattttattttcagaatggattttactatatgaatgaaagaaatgaagttgttaggatttaaaacttaagtttatatacatatatgtatttgcagggagttttatattttgtttctgttacttagattttagatttagaatttttggttatttttgttacatactttgagtatagcaatctgccaccaagtttaggaataattcagttgcataattatagagcaaaatgtgaagacctgtaggtagttcagtcagtttttgtaaactaaactgtaggatactaataatacttactgttcagtctcccttaggtaatgtgggtaggtttgtggaggcagagcaaaaaccatttgtttaccttcaacatctctcaacattcaaggactgaggaccagacccaaatgttttctttttctttttctttctttctttttttttttttttttttgagacagagtcttgctctgtcgccaggctggagtgcagtggcacgatgtcagctcactgcaacctctgcctcccgggttcaagcgattctcctgcctcagcctcccaagtagctgggattacaggcgcccgccaccatgcccggctaatttttgtatttttagtagagatggggtttcactatgttggccaggatggtctcgatctcctgaccccgtgatccgcctgcctcagcctcctaaagtgctgggattacaagcatgagccaccgtgcccagccccaaacgttttcttaatctgttgcagtgttttgagaaaaggtcagagttacggaagcattttgccaaatttggaaaacaaggccaggcagagtacaactgcaaataacactaaatatcaagcccatggctatgtctaagaatttggaaagagattacagtctgcaggagatgaaatgtatggaactgtcaacctaagtgaatcacagcagtttagtgtttcctgaaacaatgatgaaggtgatttagaagtgttacctcccatgaggcttttaattttacaaatgtggtttgttttggaagtgagtctctccatctttcttaaacttactctaatgtttttctttttagtccttaatattccatgagtccctgatgttgtcacccaaagttggtatgacagagagactgcaaactgttgagcacaatttcttctccttttccataatagttagggtatagatgtccagctcttcttcattttccatccttacttgcacttaagtgtggttgtgtgacttaagttctcttcagttgaaggtgagcagaagtgatttgcaccacttctaggcctggcctataaaagcttctcacatgaacttctcccatactttatttccctctcccttcgttgataatgacagagtcatcatctgcctgggtctctgaatgactatataaagcagagctccttgatcccactcccagcccctgtcctagtacgttctcttggggctcttatgtgagaaagaaagacacacacttgtgttgtgttggagccattacatttgaggaagttagcctaccctgtctaatacagtagagaagggattaattggtgaaggtcttgatcattgagaagggagatgatcgtttttggataaaggtgaattaactgtcagctagacatgtctcttaagtcctcccagtatgaaagttcacctaactgcctgcctgtacgttcaacctcaccacacacactaagacccacagaatataaggagctttagattaatagctaattggctgcttgacattattaatgtaactgattgatccctgtgatttagccccagtcttctatccgaatcccctgtttcagattcctatcttagaaggtcacttaaaggatcccagtgaccttatgtcaattccccagggactacatttcttcttcctgaatggaggctcctcttatctacttactcttctttgaatagtgggcttcagtcaatttgcctgctgcttgaacctctttgtaatctcctctattcctggctgaggttcatagtctgggtcttgaagttggttaaggattgtgccaaatgaatcatatgctgcatctcccatacctttcctgtctggcttcttgttccctccatttgctgcctgctcctgcagtcctccgtgtagtgctctcctgcagtcttactcatttgaacctcttccaagtgatatttatgtttttctttttcttgcaagaacttatggctcaaggaattcatgattgaatggaagagacaaatacgtaaacagataattgcaacctggtgtgactggaggaaaggagtacaagtgatgtaatagggatatataaaggaaatcactaggatttatccagatactgtgttggctcacagggaagctgtgtggtcagagtctaaggtatgctatcacaagggatgtgattaattaggaatcgatgtggagcagtcagtagcttatacagtagagagggtgtggcagcagaagttttctggaaggtggccttcgtgagaatcacatattccatttgatatggaacatcgtggattcatctccttggcaatagctggaaaagtattggagtcatcgccagagaaattgcgaagttaagcagggaactgaagtagatctaaaatattcccggagctggccatggcagagaccattacggtttccagagtttatcctaagctcagatggaaattagactcattcttgtttctgtcaacaggttaagctaagagtttggttagtattagcttagttgattttatgaagttctgtcagtaaataaccattgaatgtgttgataactagcagagctttaaacagacagagtttagaaagaagcattaaggagatctggtaagtagcagcctaacaccaagcactggggtgggtaggtaagcatgcactgcagttccagagggaacctgtggagcaggaggaagatgtctcaggcacaggttgacaggaacccaggtacagacattgggaaatcagggatgggttggttctaaggatagggagcaaatcaggagctcagttcttgttcccagaacataacaggcgacaccctgatctctggcctgagagtatgtggttacctccaacctggaacaggattggttccaaaacttatatgaaaacaataattcaaggttcaaacagtattaattatatttaatctctaagaatttttaattagagcaaatttttaacattgataatagctataatttataattattgttacaattaatataagttataatctgtagaaattaagaatttttcttatataattgctttattctataactcctctcagtctcttccctaccaatttgcaaatgatctcctcctacattaccacttttgaaaggcatattttaaagtatgtaacactgaattgatgataatgattttcagtttagcaatttatggtttcacacatgaatgaatataattcaggttttcttggctttaaggttagctttccctgttgacctttttttcgttttttgttgttgttcttgttgttgttgttgttgttgttgttgttgagacggagtttcacttttgttgcccaggctggagtgcaatggtgtgttctcagatcactgcagcctctacgtctcaggttcaagtgattctcctgcctcagctccccaagtagctgagattacaggcactcgccaccacacctggctaatttttctgtatttttagcagagatggggtttcaccatgttggccaggctggtctcgaactcctgaccgcaggtgatccacccgcctcggcctccaaaagtaccctattgacttttgacatattacacttagcgacaagtttttactgcattggcaatttgtgatgccaaaagtaccatttactgaaataatacatagtaatgaaagatgttttggttgattttagtaggatttttaaattggaaattaacctttaaaagatatattggatctaggtaagcaaaaaaggtatttaaaatgaagtagctcagccagtgaaacctattcctagtaatataaggatatacacctaatcacagaaccacagattcattgtgctccagtgaaatggccatatttgttttttaaaaggtccagaacatgaacgtgatacaagatcattgtcatttgtaaacaagcaagactcacaagaggtttagtaaactggtttaatgtcatgttccgcctttattattgatgttttttttttcttgaatgtttataattgtgatgttaaaacttcagagactttggggtttttttaaactttggaaagttcagaagcaaagctcaatctctgaaaggtctgagttccttttgacactttgatggtctgctggccagctgccgcctctttctcagagtttccagtagatcgagtatactcagcagaacttcatggactgctccaagccaatctcctgtgcactctgaggtgtagcttggtcagaactgtatcatagtaacaaacgacaaattattcatcttatgccattagatcattctctaagtaaactgtctgttgataaactccagagaaataagcatatggattcttgaagtgtttgaaagtagttaggtgtatgtaggcagaacatgattaaaccaagtttatttgttttgtcctaaaacagttttagttaatgttggtaatcttccaattgactaattattttataatatttcatttgtatgtaataggcacacagcaagtacctgttgaatgagtcagtgaatttacatttgtcatttgttgacattaaatattcatcttggaaactatataagcttaaaagaatgcaaataatagagtttcatccaatatagtttgagtttttgtttggggattcctatttatgctgctactcacccaacacattttaaatatttgtttggggactagtatttacgtttctattctgatgaaaacgtgaagaaacaagaggaccaaatgatctctaaggaccattctaactctaaactcattttcagagaacaaagtagaccaggtgaataccaattcctgataaaaggtagaagataattatcaaaactaacagcagccattgcttttattggcaattcattagaagcattctcttcaaaacgtagaaaaagtcaagagtgcttaatattactgataatattcaacatcatttttatagacctaccactctagcaataaggcaacgaaaatgagatataaatgctgaaaaggagaagctacaactgtcaccattttgaaagaatttgtgattacctacttagcaaatctgagaaaaaagtttagtgaaggaatttaataagatagttggatatgaagcaaatacactaaagttaatagccttcccaaacaaaaagtaaccaactgaaagtgtaatagaataaaagatcccattctcaattcaaattacacagaaattatgaaatgcttaggaatgaatctaccaaaaaaaatttaaaatttatatgaagaaaactacaaaactttattaaaagacatagttgaagacttgattaaatagacatctatgttcctaggttggaaaaatcaatattgtgagacgatcaattctcccaaaatttaatgtcatctcaaacaaaatactagtaggatttttacaacagaatttgatacactgatttcaaagtttaccttgaatagaaaattacctgtcatcacatatatttttaaacagattgacaggtacagtgttgttttaatgtcaaaacatattcaaaagatatagtcattaaaacagtatggtatttgagtagaaagagacaaataagtttgtagaagagaacagagaacttaaaaaccaacccaagtattgagtttctgtttcactctccatcctgtctcattctccatccagatgagctgagttctcctagttgataataagtagactattctgggatcagaccaatttactgggttatcatggggaaactgtttacttttttttttttttctttgagacagagtctcgtgctgtcgattaggctggagtgcagtggtgtgattttggtgtactgcagcctctgcctcccgggttacgagtgatttcaagtgattctcctgcctcagcctcccaagtagctgggattacaggcatgcgtgcaccaccacacccggccaatttttgtatttttagtagagacagggtttcaccatgttggccaggctggtctcgaactcctgacctcaagtgatccgcctgcctcggcctcccatagtgctgggattacgggcatgagccactacgcctggccattacttacatttaaccagtccatttttcatctgagtggtattggtgtgttttagtagactgtgtgctttattatactaaattgagcagagacaatggaggaagcaaccagttggtggtactgggaagcccttttaagcaccaggcctctggttatctcttttatacatattcttttttttaggatataatttttttttttttttgcctggggcacaaaccctttccaaactccttactgaccttcttttaaagtggtgctaaatagaaatgtgggcccgcacctaataccattgtcaaaagccccacttaatattattgctaagccaacaggagtggattcgtaaagtggagttttaatgaaaaccttcaactctgcttggtaagatttcttttcatacccttacttaggtggttaaagaatgcaaacttttctgtagttctgcatgttttctctcacttcaacatgggatggattagaggtaacaatcacagggcattactataaaactgtaggaaagtagtaatgagtccctgaacaaaggtggtggcagtggttttgatgtgtgaaattagagagaggactgcaggctttgttagttgattgttggtagaggtaaaggaggagggattgtcagcattagctcaaagaaggtggatcacattcccagctgcagtggtcaggtgggtttggtaagctgggggattgatagactatgcttaaggaaagaaagtttgatgaaaaaacaggcatctcaggagcggtagtggcaagagatgagaaaacaggcatctcaggaggtaacagggtttggtaagctgggggattgttagactatgcttaaggaaagaaagtttggtgagaaaacaggcatgtcaggagcagtagtagcaccaggtagagacagaagccacagatcaaatatagatgttataggcagaaacttggggtgcagaatggtagatcgaggcatgcttcattcagatcatgctgcagaaacagtgggagctccaggctgagtggtcctccatgaaattcactggtgataaatcatggttgattgatgtcacctaggcccagggaaatggcctagcaagaaaaaagtagaaaagtaaactctagtcacagatgagattggtttcccaccttgagaggaagaagaaaccctgagatatgtatatacaaggggactaagatggtagtctgatccccgaggaccattcagggagatgattgctcgtttttaccagtgagctgttcagtatctcatgtctcacccacggcagggccaaaacaattttccaatacctgtggacacctgagcaactgttatcaatatactgctgagccaacttgtctttggtaccaggttgctttatgtttctaaagcaccattttctttgagtcattgctccacttaagaatctcctaagaccatttgtttactgttaaattaaactccggggctttagtctggcattcagaaatcattagctcaccatccttttactacacttctccatgaatatgaatcctctgcccaggaagattatggccatctttcaaatatgctgtagaaactccacatgttcatatcttttcttgacattaaaatttatcatttttcctgaagccttctttttaagcccagcctatggcacctttcttctatttgcttgcatttaacccattccgtttctctgtttgtgccttttgtctctccagccagcattctctctttccatatagattgatattcattccttaaagacagacaccacaacttccatttcttatgccgttagaagtggggagcgaaactttttttcagtttttatttgactactcctgtaatgttttgagaagtcttagtcttcagaatgatggaaaagattaatcatttgcctggcttttcgtttaataagatgtaacttagaaataaagtagtattcttgccaaaagtttctttgggttgtttttgttatggcttctcaaggtactaaatatttaaacagttttttcttatatgaaatcattttataaaatacgtgaaagtataatttgtgtgttactgataatcatgtaaattgctataaactccatgaagacagtttgactaaaaagtcttctttgactaatcagtttcactcctaaggattaagggaggctaggcaggagagtcgcttgaacctgggaggtggaggttgcagtgagctgagatcatgccactgtactccagcctgggtgacagagtgagactctgtctaaaaaaaaaaaaaagaacttatcctgaagaactgttatggatatttctgaatattttcaaggttggtcattataccattgttttgtaatagcaaaagattagaagtcaacatgaataaccaagtagaattgtttatgttatactataaacattttctatggaatattatacagttaacaaaaatggtcttctacaggaatagtgacacaggaaaatggccccgaagttttagtaagtaaaaaggtcagattactgaatgatatatatggtataatcccattttctttgccaaaagaaagcaaaaacaattctatctataaatttttagattctgtcttctaattttatacggtaactactagaatatttagtgacatagaaaaatggccctgataattgataagtgaaaaagatcaggttattgaagcatgtatggtaaaatcccacttttttgccaaaaagaaaacaaaattatacttaacaaattttttacaattctgtcttctaaattacatgtaagagctttgcatttctcttgtaatcaggaaaataaatccttttattaaaaaaaattgctctagttacttcagagagaaaataacaatggaatattatctacaaggaaaggtcttgaaggaaaagagacccctaaaattcagaccaatgatggccactatactgtagtgatctggaactagcaatttcacttctaatctaaatattaccactaatggtttccttagtggtagttataagtagcctattgggattttactttattcttttagaaaattagtggatgttagtgaatagacttgtaattaaatacattagcctataagagtacatagtaggcattcagcaagcgctggtgttccttctaaaagtaccactggctccataatttaatgttctttaagactgaagcttaagaaataaaccaaaaaaaaatcacaaatcacttctccaaagtgccagtttaaaatccttaagctcttaatgatattttttgtagaatctttcgaatattaatttattttatttatgtgaataatttatttataaagtgattaacgtttttcagaagacgatattttcacacttcctcatttactctgtttattcactttcaacataattaaaagtatcttctagagggaggtattacttcacatcatccaaatgtatttgctttcttaactttaggttgctattggcagaacagacattgaagacttagacctttatgccacatctcgggagaggcgatttcgtttatttgcttctatagaatgtgaagggcagttattcatgactccgtatgattttattttggctgttacaacagatgagcccaaaggtaagtacacttttgaaattatcttaataattgtataatttttttatctctagcttgtgaatggatggagcagtataagttttttagaagaactgagtaatgtggtatttcacatgatattgtgctattcagtgttacagactgatatttcttacaaactcttactcacatctcttctcttttcagaaactttcaattgctccatctttctcagcttaacaccatcttacttttgatactctttataaaagactcatattctgcctcttcattcttatatcaaacctgaacagagtagttcagaggactggctttgaggttagccctgggcaagaattctacctgtatctcttctgcgtttgtcatagctcctgcagtgtaaatatattaatagtttcattgtctctcaccttttcatatgttagaataatggttctcaaaatttttggaagtatgtacattcttgcaaatctcttaatatctaacttaacagaagacagctgtattctcatgtgtgcttttttatttgatctgttataatatgttgttttccatgaaatatatgaagaaaatctacctcacagacatggacagtaaaaaaaggagtattttaattgcctttttagattattataggtactctcctttgatactgtatcacaattggctggtggtagttgcagcttcaaaagtctctatagatggtggtaaaagagtaatgagaaccgaggatttctggctggcttacctggatggatggcactagggaccaggtttgaggagaaaaatcacaatttcaattttggtcatgtctatttgagataccttggatatataaaaggatacagtgtatttttttaaaaaataattcatttcacttcactgaaagatcactcactaaaaatcagtataacaaataatcatttgttcgacccatatctactttaaactgtcacacaaatactttaacttagactagaacaattatagccattttttcctccagagacagcaatatggcaaaaatgaaccttaaaataaatcctcaataatttgacaaattggctacttgacatagtaacttttaatgaatttttgattctttggattatttccactggatatcaaggaagagattcaggtatatatttaggattcatctttgcattattgctaattcatagaatgtgtatgaatgaaattgcctagggaagctgtataggatgagaatatagataaccaaagactaggccttgaggaatttctgctctttaaaagatgaatggacaaaaggctttgaaaggatgagaaaaggggacataggagtggccagagacataggaagaaaatcataagggtatgtagtcatggaagccgagtaaaatagccagaattgccaattgagtgcagtgttactgagaattcaagttagataagaacaggaaaatgtccactagatttaaaaacatgaaggttattgatggttttttaaaatgatgtttcagtggagtcattagggcaattgcaggagtgagtagcagatgaagaaatgaagacgatgagtgtaaaggactctcttacaatatttgattgcaaaagagaaaggaactgaaaggtagctgtaatggaatttgaagtagacacttttgattatgcaagattttaaattaaaaaaaagattttaacaagaaactatgagagtaacgtttaaagaaatgtaaactacataagcaaaaacatgaaatcaagacagtatatggtatagtcatagtagccactttgggaatatgtagggccatatagtgatgggaaaggtgaaaaattaagtagagttctttttttttttatttacgaattttaaggctgtgataagtgttatatcctttttatttaatccatttggtacaatgtagattctttattagtgagttagtatagatttaatactaatttgctaataaatatagagaccatgttgtaccaaatcaattaaataaaaatgtatggaatatttatatgtctgcttctgtattaaggttcttttctgtgtgctaagggggatacaaagtctgtgcactcaggaaacttacgatattataagacgacgtaagatacagaaccatctccaaggtagaatatggttacctggcacatgataggtacacaataaatatttcttgaaggaaggaatttgttagatgctaaatggtattttatatcaaattctataattttttcaaacatatttgaaagctattctttaagtgattgttaataatctatatatatatatatatatatatagatttttttttttttttttgaggcagggtcttgccctgtcccccgggctggagttcagtgacgtgatcactactcactacaacctcaacctccgaggctcaagtgatcctcccacctcagcctcccaagtagctgggactacaggcacatgccaccatgccaccagctaattttttaaatttttttgtagagagagggttttgctatgtttcccaggcttggcttgaactcctgggctcgagcagtccacctgcctcagcctcccaaagtgctgggattacaggcgtgagctactgtgcctggccacagtttcatattttgaaaaattttacttcattattttctagaatttttttcttcagaatacattcactggaagcacactgttcgattttgctttttggaaataacttttgtggtgattcttctcatagatattttaaaaccataacttaagagtaaaaaactggtttctattatagaaaagttatacaggatattttacaaccacaacttcagttaatttctaaccagcacttttcaaacataattaggaacaatcacaaaagatcaagatattcataaatcctgttttgaaagttggggttttagaaaaggaaaagaatagaacaatgtttcatgtactgagtattaaatcagatatgttaaaactgtagcgtaatgaaatttgacttgtgtttaaaccttggcatttactggctttgaaaacttggttatttaatcttctgtttcctcatttataaaaataacagcctcatgaagtttttcttgaagatcgaatgaattatggttagtatagtacctggcacacagtaaacatttaatattggtatgtcatcatcatcgtcatcagaattcatagccatgattttttttttttttccccaagaggagactcgctctgtcaactaggctggaccgcaatggggtgatctcagctcactgcaacctccgcttcctgggttcaagtgattctcctgcctcagcctcctgaatagctgggattacgggcagctgctgtcatgcccagctaatttttgtatttttgcagagctggagtttcaccatggtttaaccatattggccaggctggtctcaaactcctgacctcaggtgatcctcctgcctcggcctccaaaggggtgcaattacaggcgtaagccaccatgcccagcccatagctgtgataatttttaagcaaatatttacacggcacaccatttttttcgctgtttaaaatcatagccattatttttgaaagtttttgatatcattttatgatgacattcaacagggaaaaaatggtatgctgtgtaaatatttgcttaaaaattatagatcaaataaatgttgagatatctgttgattatgattttgcattataatcttattttgcatacttaaatagaacctaaatggtgactttcttttctagaactaaaatcagtaattattttccaacatagcatcaagaattattttaatttagatttttaaaaatatattaaatttttcagacatacaaaaacgtattaaaaatataatgaacatcaacctacagcttaagaaataatatttccactagaattgaagtccttcttcacctaagttatatttatatgtgcagtaacttcatatgaaataaggaattcagaaaatcctttgaagagcaatcttaatggctctttagtctttatttaaaaagataatagtattgaacatggtgacatttccgacagaatgaatatgtcttttgtgaataatttaccatggaaatctcataaaccctgcaaaactcaagagtacctctaacttcctcttccgataaataccttctgagcattgcataagagcacgtgcatgtacttttctaccatttatttttcttctttccttactgctatattttaagagcaacagaataataaatactatttgtattgttctgttcattgttaaaagggaagtgtctttgcaccagtgtcatagttaagtttacatgctaaattctaatttgtagacctgtgatttgaatcacttgattacacatttgtatcaactatcttggatagatgaaggatgttgttgctacataaagaagaaatctatccttagaaacatatttcttctcttttgattttaaattgagttgttttgttgcctaataaagaaaaaactacacagcaaaaattgctttttttgtaattttgaatttgatatattgttaattatacagaaatagccccattgccaggtagaagaagatgttggttggcattattgtaatgtagctgaaataattaatattaaccagtttcctaatacagctgtattacagggcttaatcaaatgtaaacctggtgctaattcttaggcaggcattaaatatttacagtgttcaaatgtgagcaaaggaaatagcaatactgactatacatttgtcccaacattttaagttttacagtgtttgagatctttgggggtgtgaggaggaatcacaaaaagaaagtgatccctgacattttattcagctgtaacactcttactccagtgatgcttcttgaatagttgtagggaagagtaatgaaacaggacaagtttccccatcactttgcctagcctccctttcctttctttttttctttccccaatccttcttcatcctagagagacctgacctgtgaattacgtcatggaacactagtatagcaaagatcacaagtaataccttaaaattatagtttatctatgttaatgttattttatattctagtttgaatattttataagtatcattatttgtgcttttaagcccacaagatgtttaacatggagaaagttagcttactttattagtccagaaagcccaaattaagatgatacggctgtggagaaatgtttcctgtatcactgatacttactatgaacagtgcatagtatatatgaagcaaatagataacatatataagatcatatcacagatccaaattttgaggttaaaagaaaactttgccttttggacataaaagtttggttatgagttatggttgtagatggttagcaaatatggatatatattccatgaagtatttattatctaattatcttacatttgtttattttagttgccaaaacttggaagtcactttccaaacaggtgagttaaagctcttggtagatatacacaaattttatatgtgcatgcatatatacatatataattaaaatatatttcataaaatatattatgtatttttatatattttatgattttttggcaaatcaaatcacatcagagttcctttttttatcctccagattgtcagaaaataaaaaggtggacgtttctaagggctggtgaaaatgtagattactggtaaatctcatgtgttggtatactcactttggaaaacaatttggcattatctactaaaattggcgatatgcctaccctatacctagtaaatacatgcctgcatttaaattctgcagtagtgcatgcgcatgtaccttgtaaagttgaacttgaatagactctgtgatctagtaatttctactaaatacactggtatctagcatataccagtgtatatacctagggaaattcttgcttatatgcaggagaggttcacaagaatgtttatagattatatatgatggccccaaaactttaatatatcaatactataccataaataaatgttgatatattcatatagtatactacacaatagtgaaaacaaatgaattttaacagtgctttaactaaataagtctcagaaacatgatggtaaagaaaataagcagttcaaaaatacaaagtataattctatttgtataaagtccaaaactgagaaagtgaaatcatattatttaggatacattcatacgtgggaaaacaaaggaataattaacattaaattcaagaaagtattcatcttcaggatgatagcagggaatatcatcagtgatgggctcaaagaggctttaaagtactgctaattttctattttttaagttaactatttcttaactttaaattgcatatatattccttttatatttttatagatatgttttttttttttaaaaaaaagaatattagaaatctagggaacgtccttaactagttaaagggaatcctccaaaagcctacagcaaatgtcatggtcatttgtgaaacttgagagacattgtctttaaagttaggtatattagtccccgtttatcagtgggtaatatgctctaagacccctggtaatgaatgctgaaaatttggaaagtactgaaccctatatgtactatgttttttcagtttggtagacgagagaactactaagtgcctaacaggtgggtagcatatacagcgtggatatactgggtaaagggatgattcacatcctggataggacagagttggacagtgtgagatttcatcatgctacacagaacagtgcgcaacttaaaacttaggaattgtttatttttggaactttctatttaatgtttttggactgcagttgactgagggtcacagaaactgtagaaagctaagcctcaaataagggggaactactgtacagtgcaaatatgcctgctgtcacaactgttccatagcattttactggaagtctgggctagtatagtatactagggctgctatgacaaaatatcacagattgagtgggtttaacaccagacatttattttctcacggttctgggggcttgaagtctgagatccaggtgtcagcaggttagtttcttctgaggcctctccccttagcttttaggtagcaatcttcttcctctgtcttcacatggtctttcctctgggcatgtctgtgtcctaatctcttcttataaggacgtcagtcatattggattagggctcatcctgatgaccttatataataacctaattacctctttaaagaaaggtcctctctgcaaaacagtcagattctgaggtactggggcttaggacttcaacatatgaatcggggagaggggcacaattgagaccataatatgtagtatgaaaaaaagaagaggctctaaggattagaatagaggcacagaatagaatgtgattggaagaaaaatgtaaaaatacataaattttagatttgtttaaatttaataaaagtttagcaagattgctactggatataacagcaataaaccaaagttaagaagatgctccacaccagcgagagcaattagaaactagtattgaataaaatgcatttcataatagaaacaagaactattaggtacttaaaagcaatgcctaacagaagatgtacaaaacattattaaattatgtttttaaaaatacaagtaaatggagaactgtatcatgttcatactggtaataagccatttccttatgataatgatcctccaaatctatctataaattcaatgtaactccaattaaaatcccaaccaaattgatccgaaattaacttttaaaattaatctggatgagtaagggccccaaaatatttagaacaattctgaaaaggaaagagggaaaaaaaaccattgagatgagaataatggggttgatcacatatcaagattagaaatagagctataataaataaagtagtattacatcattgcaaggatatttttaaaaactagatcaaggtaatagaatatagaatccagaaacagatccaggtatatataggtagatctgtaaatcagtggcagaaagattgacctctcaatcatagatgtttgaataataacttttccatggagggggcaaattaggcctcagatttactaccatatacaaaaactaatttcagatggattaagttcttatttgtgacaaaaattctctaagattaaaagcaaaaatgagaggcatgagaggtttttttttttttagataagacacaaagcaaaactcaaaattattggcaatgtttactaaactaaatatttgaaagcttagcatcaaaacacagtgtaaacaatgttaaaagatgtatgatggatgggaggatatgcatgcaacatatcaacagaagagggtaagtgtcttgcagtcacgtagaacccctttttttatctttgtaaaaaagattatggcttaataagaaaaaaatagacaaatatgcctacaatggccactgaatatatgtaaaggaggtgaaccttactagtaacttagggtgtgcaaattaaaccaatgatacgatactatttgacacccgccagatggtgagcttccagaaatctgacaatacccataattagcaaggagaacaagaaggaaccaggtcagaatataaactggtgtatttactttttaattttttttgagatagagtctctccctgtcacccaggctggagtgcagtgagtggcacgatcttggctcactccatcttctgcctcctgggctcaagtgatccccctacctcagcctcctgagtagctgggaccacaggcacacaccaccatgcccagctaatttttgcatttttagtagagacagggttttgctctgtcacccaggctggggtatatttacttttgagtgaaatttggcaatacctaataatgttgaaaatgcatatgagaaatccctcttgtagaaatgcatactagagaaatgttttcagatttgccacagaaatcctatatatcagatcgcccccttcccgtgaagcttcgtctgtatttacagccactctccatcactcattgctcacattactgcctgagctctgcctcctgttagatcagtggcagcattagattctcataggagcccaaaccctattgtgaactggcatgtgagggatctaagttgtgtgcttcttatgagaatctaatgcctgatgatatgtcactgtctcccatcacccccagataggaccatctagttgcaagaaaacaagctcaggactcccactgattgtacattatgatgagatgtataattatttcattatatgttacattgtaataataatagaaatagagtgcacaataaatgtaatgcacttgaatcatccccagaacatttcctcttcctccctcctggtctgtggaaaaattgtcttccaagaaaccagtccctggtgccaaaaaggttggggactgctgctatatgtgtttcctgaacatcaattgtaatagcaaaaatttgggaacaatatgtcaatcatcaggcaggtgaatgaaaaatttgtgaaatagagaaacccaggataaatgtagaattacagagtgaaaatgaataaatacattatagctatgtgtattaacatgagtagaactagaaaacaaggttgagtaaaagggcaagttgcaaaataatattaactgacagtcatttaaagtgcaaataccttttcaaaggtccatgaagtcaaaactattttcatcataatattgagaagatacttgttttattcactgtcattctctcatgagtgtatggtggagttttctttttctttttggtttttttttttattttttatttttagtagagagggggtttcaccgtggtctccatctcctgacctcgtgatccgcccgcctcggcctcccaaagtgctgggattacaggtgtgagctgccgtgcccagcctgtatagtggaattttctagaggctgtttggtaatgatgccattgctctaccaactaatggaatgtgtgtttgtgttttattgtgttttaaaaatttgtttttattttcaaataaattaaatattgatagatataacccatatagacaatatctcttttgggtccataatatttttaagaatgtgaagagtttcctttcagaactgctactatagacaactgctgtgtagccattaaaataaaaatgaagaatatttgacaggaaaatatgctcactataatatattaaatgtaaagggtaaattataaaacagtatgtagagaatgatttaatatttgcagcaacaacaaaaatactatagaaatatgcctagctggagaatcagactaaaatgatgttaaaacgtgtgtgtgtgtgtgtgtgtgtgtgtgtgtgtgtgtgtgtgtgtttaacttgccacccctagagacaattaactttagtctaaaacttaagtttgtcatccctggattacaattagtttttattttctgtacttactaatttttctataatatatatctattaactataatttttttaatagtacttatttaagaaaattacgtaactcttttaaaaggcaactataattctaggagactgactttaattcagcaaatatttattttctacctacaatttaattctgacgctaaccactccgagtttaagcatggtgcctaacaagactgccctcatttcagatgcttgttgcaagtttcggggctccaggccacccacactctgaccttactgtctacaagtctaggaggttgccacagctcccctcaggtttaatgatttgctataatgaatcatagaactcagaaaatgcagtacctatggttatggttttattagatagaatacagagtaagaccagccagatgaagagagagggcaaggtctgggaaggtcctgaacacagagcttctatgccttctttgagaacatggagttggggtgtgtcaccgtcctagcacagcagcgtgttcaacaaccagaaagctcctctgagcttagtgcttagaatttttattagggtttcattacataggcatgattgaattattggctgtgtgattgaacttaatctgtagcctctctcttctccccagaggtcaagctcactaaagccccaactctgtaatcacagttattctttctggtaagcagttcccctcctgagtcatctccttagcataaactcgggtatgaaccaaggatttagagtctgcttcctaggacccagggacaaaggccaaattctttataatatggcactgctacatacgaaaccaagctaggagtttggaggagggagagagattcctgacatgggtggaaatataaaaaatttaataaattttagaggtccttaaagttaacagagaagtcaagatgaatgtgttgattggatgatttagaccgggagaaactagattattactaaaataagctacttggtgtcagtaaggatctgggctctgtcatttattagttctgtgaccttgggtgttacttatccactttaagtctcagtaaaatatgcataatgaggattgtttttagaatgaagttattatatgagcctattgtcaaacccatagagggcacccaataaaagctagctttgatttttcagtcttacactgtagctgagtttaagttagaacagatgaggttggaagacatggaaacagttaaaatggagaaagattagttaatatttatacagttacaatagagatggtataaattaagctatgtaaaatttattcagaatgttgttttttaagtttttttatatttttttgagacaggtctcactctgtttgcctaggctggagtgcagtggtgtgatcatggctcactatagcctcgacttcctgggctcaagtgatttttccacctcagcctcctgagtaagctgggactatagatgaacgccaccatgcccagctaattgtttgtctgtttgtttgtttgtgaaatggggttttgccatgttgcccaggctggtctaaaactcttggattcaagggatctacccacctcagcctcccaaagtgctgagattataggcctgagccactgagtcccacccagaatgttttatttaatctctcaatctaacaaaaatatttgagtttactgttgtctaaacaataaacatcccagtttctcattacaattcggacctgaattattctgtgccattcctattctataatcagatgcactgattatctgctggcatcttttacctgcagtgcagatacagaaacatgaaaaacacaaacacaagaatccacatatgggcttcaaggtgtccataaatcccctaaaaatgctgttcctgcctttgacataccaagaatttttcttcctgctagctcagctttgcagttaaacaaaaatgatttataaatgtcagaaagcatttttaggtacagctgcgtcagaaatggtttgtctgaaatgccttccaaacttcaatgtgtgtaaaaattagaagatgttgttaaaaatgcaggttgtggttcagtaggtctgggatgggcactgagattctgcatttcgcacaagctctcaggtgatgcttaaactattggggagccacatgctctgaggagtgggtgtcagatctgaaaatagaagtgggttctgtgtttgtctaatgtgtttctaagcagactaactttgttgtttcaaattatttcaagttatctcaccgtcttttaatcatttttcttcacaattaatcaaattatagttttcacttagtcgtttttaacagactatacacaataaattcaaaattgatttagcatatgagtaatgattcaaatgtctaaattctccagtagtttccgagcagcagtgatagtttgagttttttaaaaaagaaaaagctaagcagcagttgaagtctgtgttctttaatatttaagttaaaattagaaacaaattgaaacagtgaccacaataactcagtacccttgtctttctgcttcatccattgttatcattctctaagtcactaaccgttaaaatactcttcattcctttctaacataattctttgttcatttacttcctctacacaaagttctctaattccaaatgtgttacaaagaagagacattacgtgaagccgggtgatgtgaccatctccgaccttgatatggaaatccatgtttttccatgattttcctaaaacgattcctttataactggctccaggacttaaactcactgttttatcttgatttggttgtcttatgtataacctcccgttattcaacttatctgaaattttagttagctctaattaaatttaatgtagcctcttcatcatttattttatgtttgaactgtgggcaaatactgggttgtgtgcttgaatgaaccacaggcataacataggataaataatgccatgtttcaggtcttttaagtggagaatttggcatggacatttaaacatgtttttgatctattttattagtaagttgtttaccaattcatcagtagtataacttctgtcataggaattaaatcaaatgctcgcagaaacaccaccagtttggaaaggctcatcgaagctatttcgaaatcttaaagaaaaaggtgagttaaccttagtacttgttctttttttaaactatattatgtatactatttatatatgcatattttcccatacctaaaataatttttaaattacatctatgtgtatgcatagagaaaaaactgaagaagaaaacagcaaaatattaacatttctgggtattaatgttgctcttgggtaattccacccttcattaagggtggttttcatgttattgtttatatattatttgtatcttccaaatttttttatatcagattggacttacatagtttaaaaaattgttcttcaaccatatcaaaaagtatattttatatttacccaaagaaaacatttcacaaaaatactagatcttcaaaggtctatttttcttccttccattttgctctgagtgaattatagatgctcctaaactaattaacaggaaaaatttagtggatgtgtcctttgacagcctaatttggacatgtttcctttaaaggccaacacttactgcaaatatacctgtttcaacttactctattatcaatatcaatattagcttaattcattaatttaaacatttcctggcaatcaaattatatggcttttattgtaattttcttttacagggtacctttttacacatttgtagaaaaaatttattaatctttttaatcttaaaaagtaatatttcttggaaatgtattttttgtatcctcaaatacaggaatatgcaaaataaaaatgttaaagaaattacataagcagttatattttcccttttcatcaattttaaccaatattggcttgaaaataatgtacttcagcctgaagacaaatactttgaaggagtagttataattcatatattttatttaagtagaattagaaagttcatattgcttccacgtggtttacatagaatctgaaaggaagagacaccatatcttttattgtaggtgtttcataagtaagatttttaaatcttcaagaaacctaggccaaagtgtcttaaaaaaaatcttagaaatttttttcctagatgttgtcttaaagattgccattcagatcttagggtgagataataggatgaggaaaattcaaagctcataaggatcaagtaagtatggtgaatttcaaacatttttcttaatatacctcatgggaaaatacaaattggatcaaatataatctgagaaaaataatgcatagaagaaagaaccttttttaagttaaggggagggtttaatctggaagtcctaggtttaggcatatcctaatccttctcatgttatacacatgtttgcatttttttccccaggggatagaatctatgctgcaccactatgacggaaatactctgtttctatgctgtctcttatggtagctactagccgcatatggctgttgagcacttgaaatgtgtctagcgtaactgaggaacttatttttagttgtatttgattttaagtattttaaatttaaatagctacaccctgtagtacaatgcgtatctgtatcatattaattagatcatcagggtgatgcatgatcccagaaagttttagaatcattaggttaggtaaaatagagaagttagaagagccttgctttttttaaatagcgattaagtggcagagaaattttaagactaaatctttagagctattgaagactaattttatttttatttttgttttattttatttatttattgagtcagggtctcattttgtcacccaggcgggagtgcagtggtgccatcatggctcattgcagccttgacctcctgggcttaagcgattcttccccctcattttttgagtttttgtagagacaaagtctcactttgttgcccaggctggttttgaacttctggactcaaacggtcctcttgcctcggcctcccaaaagtgctgagattataggtgtgagccaccatgcctggctaaagactaattttaaaattgtaagtttatctacttaaaatattacctcgagagaaaatgttatgcatttaaataataaaaaaattgatatgcattcatgaaaacatgtattgtagagacttaattataacagccaactgcaatgtattgtgtataggaattaaaccatgtaatgcttttaaggaacttcccttaaaatttgttttgattgaattttcgaaagaaacctagttggcatctttcttatcctctgtttctaaagatcacaccattactatatgcctagcttttttttttgtattttttgatcctgcacgccataaataaattgaagagttagttttatagtattctgtttgtataattggaaagcattaaaaatataccgttcatcttcagtagtattttctcttttccttgaccatttttattaaattataatatatcatgggtttcacttcatttttcttccctgtggtttaagccacttcaatcaccatgtgatcctacagacaaacgcctaccatgatattcatggtctggacactcactattaagtagtcctttccttgagggaaatcttgagttaactatcaaataaaagatgcataacagttattaaagttctttataccaaccaacatctcttgtgtattctaccaggtcaactagaacaacagttagtgagatgggattatggagacagcatgcccatttcccatcccatttccttttctcgccccttcttttatgctcttctttcattttttgagggatccctacagactcttaagtattgtatctttatatacattgaccattccagaatctttctcccataacattcatggcaatcaaccagaactatctgtctataggtcacaatattctagtataaacaaaagaagggaatgaatgctttcagggcctcctggctagtgcccttcatgtctctgacaaactgcctgacagtgactcctcttctctttgttctgtaacaaagaagacagcctcaaagaacatcagataaaatggagttttaaagttcacaatctggttattttaaggatttttatacccttttaccaagcgtcagaactatctgatatctaaataagtattgtagatacagattactgatgtcaatcttctcagtatctacttggaaggtcagttgaagcactaaatctagttttgggttttgtattccaaaagcaagaattcaagtaacagaatgcacttttttatttacttcaaaagcactccttttgaaatttgcaagtatggagttactgagaactcaggatgcgatgtacagaaagtataagccatttaattacaataaaaactcctcagggtacatttaatagaagcattgaagataatttgaaagcagaaaagtggtaactatagagctttactcttaaaatgcgaaacatcacatttctaagtaacagggtctaagtgttttatccaagtgttactaaaaagtaattaagcactttacagtgttaattaactatttccaacctttttatttttacttgttttttcctttaagctctgttggacttgacaacttttttattttgtgttaagagtcgtacattagaaactagcaacaagtttaaaagttactgctatacgtatgcattataattttgctttttttgccaatatatttgagagcataatgattttatatggatatctacaaaggcatgtggaacaattaaagtaaaattaaatttgttgcttcttttgttatgattttataataatgattgtcatttaaaataatatctagcatctattttaaactacaagctcattatttatagcatttattgcttctagaacaatattttatatatataactgatactatttttcttgtaggtgtgatttcttacacagaatatctttttcttttatgtattttaacaagtaagtatacttattgcttttatttctggatgcagctttattttttaaacgaatcttggaaagcagatcttaggttctcttactcttgaaaatcaatatccatgctgttctgcaaaattcatgtttaatgctacagaaaaatgctaagcatagcactgtaaagagtcaaaaacataaatgctacagcttatggtatagtaataaatgctcataaattataaatttaatattacgtgtcaattcttgtggttttaatctacctcagactccaaaggtcatgacatgtaataatttataaattccctactgtactcatttgaatcatattttctgccagactgatgtgagagagagtgtctcttaactattgagtctatcagaatacccatcattcacatctaaaacttctattttctccctgtcaggtgcagcatttcttaggaaatatatgaagggtttactatgttttcagttaaatttctttgcatttaatggagacaatctgttatagtttactgtgttccagccacctggcctttctattccttgaattgccgcctcagggatttgtaccttctgcttcctgtgccatcagtacttatcctcaagatccccgtgataataaacatcatttaggtttcctttcaaatgtgaaaatttagcaaatccttacttggccagcctctctaacatagctccctctctctttgtatctctttactgcgttgcatattcttcatatcagactatttgaaagtattattggtttacatgttcttgtctccccacacttgaatgcaaggtccattatggcaaagattttttcttttttgttcatctctgtatcaagaacagtgtctcgcacatggtacccttccaaaaagtagttagtgaatgaatgaagaaaggaatacatgaaagaatactgctagtggaatttccagttgtggagatatgtggagatgcatggaaacaagaacatcagtaaaactctgtcattagaaacaatctaaaaataccttgtacttctttgattaaaaaattcacaccactgtgttattcttaactttgtaacttagcgaggaatgacgttaacattgagttctgttacagtaagttttgagaacaaggaatgtgtacatgcactcacatatgtgtatttcaaaaaatatttttttctcttggacttgtcaccttgctcactgactagactgagccaatttatcaagacgggaattacaacagagaaagagtaatttacacagagctggctgtacaggagactggagttttatttttactcaaatgaatttcccgagcattcagggatcagagttcttaaggataatttggtgggtagtgggtgggtgagtcaggagctctggttggtcgggtcaaagatgaaatcatagggagttgaagcttttctcttgagctgagtcagttcctgcgtgaggaccacaagaccagatgagccagtttatcgctctgtgtagtgacagctgatccatcaagtgtggggtctgcaaaacatctcaagcataggtcttaggttttacaatagtgatgttatccccaggagcaatttagggagggtcagaatcttgtagctccagctgcatgactcctaaaccataatttctaatcttgtggctaatttgttagtcctacaaaggcaatctagtccccaggcaagaaggaggtttgttacgggaaagagcgcttatcatctttcttttaaactataaactaagttcctcccaaagttagtttggcctaactaaacaagaagcaactgaatgaacaaacacagcttggagattaaagcaagatggagttggttagtcagatctctttcactgtctccattataattttgcaatggcagtttcagactttaaatgaaattaaaatgttagtgctgaagaactagtattgtaccttttgtaatagggctacctgaggttgatccattctgcaaagccatagtaatgaagcaagtccagtcaatgatgctatcctgagaatgagagagggtgcaaaggagtgtctcaaagatgtgttgaaaagttaccttgtttgacaaaacaatgatggatccgatattagaagttaagctaagtacctaaaccagcagagtgataggcaaggataagaagtgttggctagggtagccaattgttgagatgggacagggtatagtttaggagggtcagaaaaaacatacatagtgcgttttggcacagaaaggttaggatctttgggtgctgtgaagcttcctttggagttcaggactcaccaacagaagcttctaaggaggttgaattgaataattatgggatattgtttacattagaactaagaaaactgtgaaaagagggctggcaagaagtgggctacataatcttggttacctatctataagtgtctccctctttactttgtactgtatttttccctccaaacaatgcttgtaaggaggacttcttttctgtatgtattttcaagatctttttaaagtgtaaaactcggttattagagatgttgtaaatttgtattagatttctgaaatacatgcaacaagtgagcttgcataaaggattggcttctgtttctgttattttcagaaacagctgttactagttaagaaagtaggacactatctgtgcctcttttgcaggttcaacatttcacaacaggtggtagcaaatgtatctgtggggggtccctttttcaactttgtacccctccccccggtcatctcaaaagaaaagatccagtgttttgagaagggcacgtccactgagctgctctttgaaggacactttcaagttttcttctgtccaagttttctcctttatgctctagaagtgaaaaggagaaagagattgaacctcattattataaggttcatgaaattgaagcacttcatagtatgtgaaagtctttttcagaaaagcaattgttccttgtattttgggggaattgataattacatattcagtcttcttttgttttatatttctgtttttgaagcctctagaagtttaaactataatgtcttatgcttgacatttattttcataggtcattttagttataattttcccaagaatcggaactagttcattgtgtcatgttttttttctgccaatctaagtagctgaacatattgaatatatttaaaatgtgacgagttgatattttcctttaaaacaaactaacagactttggattaaaaaagagaagtgctttaggaaagtattcaaatttttctctcagtgctatgcaacaagtatcacagaagtacttttaaagtatattatcaatttttattaagtgtactaattataaagcagaaatatatatacttttatacgctttctactatctttaaccaatacagaatatgagtaactttacaactaatatggattttgtactttaaaatacatttttccattttgtgaataccttctctgttttttctggcagagccacatgcagggttcagaatagctttcaacatgtttgacactgatggcaatgagatggtggataaaaaagagtttttggtggtatgtatactagatgctgcactttatcaataattaaatattgcttacttatatttttatgtttttgccttattgggagtactactgtagagaaaagagtgaaaaacttacgcttttgcctttacttaataaagtataatactcaggtactttgaacaatatttacattttacaaatataaattacattcagtgtatgatgatgattatcgttgttttttaccttacataaaagtgtgaaatgtatcaggtgttttctgttgggtggataacaggcagtcctcaggttatacatgcccaattaatattcagtccccattatgtcatccacctaggcacacaactccttccataggaacttctcttccttctcaatatgggattcatgttttttctttctcttttctcttccacttactcctgccttgcattccagtcttgtccccacttccctgttcctttctgttatctttgaccataggctgatagttcttagatatttaccttttgatgtttctttgatgggtccagctctggcactggtctgacagtgagttcagttgctcactcaacttcacataccctgcttccagaatttttctgtttgttttacccatatattttgcatctctttttgtgacaaaatgcctagtatattttttttctctgaaatagaaaatactattaatgtattccttagagtaacatgctctgcttttagcatatatattacactctgtctttacctacactctccgagtaaaaagaaagggaaatcaacagccattttcttttcttcttttgttttctttttaaattatggccctacctcctgaacagccattttattttctacttttcctttgtaacatagctgtaaaaattcctcagaaaacctctgaaagagcttcatatttacttcagaagctgaaactcagaggaagtctatgacatcattctttttcttagtaggaaagagaaaatataaaaatcctcatcagaagctaactagtagccattcaaagggaaacaagcagactgattactgggatttatcagtaggcttaaactctcacccacgcagcccttgcccacgtgtagtccctgagccaagccactggagctggagccttcattccagtgctttgcagaatgatggggagatggcggttttcaatttgattacaatagatatagatgtgtttctgccatccgaaaatggccaaggttagtgttgctttcttatgatggtacacaactgtattttaggaactttcagaatgggcctgtttttctgcagaacgttctatgtccatactgccaagttccatccccctgacttaaagtaaaagattaacttttggaactcactcctttggaagttgcctgtgtggatgtctgcattttagagaaaaagtaaaactgtgacattaagtacatttaacttaattatgggttaccaataccaaaggatatatcttcttgggggaaaaaactgaaatcagaaaatagatctatagcagtttaaatgttcttggtggatgaagctgttttctttgtttttggaatatacctagtccagaatagtagataggtgcccagaaactcttgttggatatttgattcttgattgatttctttgtcagcttcaagagatattcaggaaaaaaaatgaaaagagagaaattaaaggagatgaagaaaagcgtgcaatgctggtaagaatactttatagtagctttaggtggcttttgtaggcaacaattattttattcatgttaagaaacaataattaaagtttgtaactttgaagctgtccctttcttgaaaactttgtaaagtttttatgtagaaaaattgcttcagtatttatatgcattgatatcaatatttacttcaaatattgatattaaacatttgtatccataatcattcattaaatcattttcatccatattgttatctgtgagatttgaagggtatatcatacaatagattaatacagatcattatgcatgtaaaaatttaaaggtgaattgcaaagatttaattataatgtgagagaatttagtggtaatataacaaggtgactgtcgaaacgaatagaaggagatgatatgttttcttgcattcttagatgtatatattagagattcttcttctgggatatataatattttcatctttttctgaagttagagttaagcaacattaccctccatcttcctaaccagttttctttttatctgaagtatttcagcctgaccataggccaggttcacataataaaaataacaaacaggtactaagaccttacaaacggacactatactaggtgctttccatacatttctgatttaagctacccaacaattctcttagtatccataattatagatgaggaaactgataattgggaaggttaagtatcttgtccaaagttacatagttattaaatggcaaagccaaagatttgaacctgtgtctggccaactccaaaacctcacttttatccattgtgacatatttctttgtctgatacttagataaccagaaatacagtgaattttgttggcatgtaaatgacatttgtttcatttgcaaattgatggccctgtgcagtagtttaattgtcctacatagaattcagataactaacttcagagagctaaaactttatttttattattctcatttttataagaatatgtattaggtttttcttaacatagattattatctatagcagatgggtgccatattcaatcccaatatatttatgaagtgtacgtttatatttagttgaatgaaagcagattatcaggattatatagcacatactgctttacaggatatttgaccatgctataattcttagtagtcattgaacatccctcagtatactattgacaaagcttatggaagacagtcttaaaaaatcaaagagttcattgtaatgttagtcaagtatcaaaaggggcagtagtagttctctacttaattcaggtctcatgattttcaaattgtaattaataaatcctacatgaatagccccataattgcaactgtttagagtattagcaaagaagactagagaattgaatactttcttaaattttatttcttgtaaataatatactaaatgagtaaacagttattttaattttgatatattacctctaactataattgactgaataggcaagttgttaataaaatactatttaaggaggctgaataatgttaatgaatctattgatatactttaatgataaagtagatagtatttcagtggatataaatataattgttttatttatttgtttatttatactacttccagagaggacttacacatcttccagtaaaaatacagtattattctggtcattaacatttattaatacatccatcaagtaataaagggagataaaaaagagaaaaatattagcagacaatgcacactgagaaaacctacagtgttagcacaaaatttggctctgagcgtcactgcagccaaggtataagaaatttaatattgatttaatgcaaatattttataatagtgatagagtaaaacatcattaacttagattaattagggaaaatccatctgaattatataatctaaattataccagcataccctaagttgtattattttattttatatgggttaatgaaccattccctttcaaatatatggagaaggagatttgttttaaagaacagattaaaataacttttaagtaatataatatataatttgtttatttataaacgaatgcttactaaagtctttgatatccacaggtacctcggaagtattcgttttatgtaacttaaatagcgcttctaaaatcttacttttataatgtagctatcagagctcttccttaaaacaattcagaaataatctttagtacaactttggaactaacagcactttacactatagctctccaaatagtcattactgtgtttagcaataatgataattagtgttaacattgttaatcacattttaaataatgcaaatctgaaccagggaggttttattttatattactttagttatcaaagattttagttttaaagttttttttagttatactactttacttagaaaacattatgtaaaatgtaaggtgatgttatcaaggtgatagaaatgacaatatgattccacatattcttagaatagtttggctgagttctgaggcaattaaaatttaacttattgtgaaaatatatgaattacataagagagagagcatagcacaggctcaggagccagatttttggggtttgagtattagccctgccactcattacctggatgaccttggacaatgtccttaacctctctgttcctcagttttttttcatttgtacgatgggggcattaggagtaatgaccacatgtgattggtatggaggttaaagcacatagctacttaaccatgtgaaatgtaataaacactcaaaaaggttagctagtagtgaaacttattctttagttagtagaaccatgtagctactttaaactgaatcttaacatacctaaataaaaattaaatcaaaactaaagttaaaaatatttatatgccaaaataaaactgtgattcagaagggaaaagggaagtgaacataacatttcttgggacacttatgtgctaagctccatgctatactcattgttaatgttactcccctttagtcctcatgaccgttctaccaggtaagtattatacctgcttggagatgagaaaacagtcttagagagattcatgtgcctaatgtcacagcactgatcacagcagagcaggattccagcacaggtctctcataccatttccactgccttgctgctgcatctggatttccccctatgccatgtagcattgcggaagcatgtccaaatcaaaccgcatacttcaggacaacgtgttttactcaaagcagtagttctattagaaggttataatgaaatggttgaaatgagcaaaaattcatttaatgtttaattatctgagatttttaaaactttgctactcatctttaacatttatcccacttgtattgttcgtgtgctctatataaaatgtagcataatgatttgcccttcctaattgattattttgtcgtctttttccttttttcttttgctgtacttgggttcattctgaaatatgacacttcatttggccctttgtgctctatgtcagcgtcttcaactttatggataccattctcctactaatagtgtatgtacaatactttaaatgttctttatgtatatagccctcacctgttatacttgataatgttatttctttatataaagctatatctgctgtttactaatagaatgttttggaatttattgaacacaataggtgcaatgaagccataatgttacatttcattcctagatttatgtgaagactaaaatatgcagaataattatatatctttaactttagattaaaataaggaaaaggtaagtgtacaacaattaaaacataataattgaaattttatatcttttagcagtatttgaagagttatgtagagagagcagattctcaggctatgttcctgcagaacacaggtattttatgaaccagatctatccaccttatgtacagtctttgttcaattctaataagtgtcttaatggatagactttttttcattttcacttttgctcacaattttttttcaaagcctttgtttcctgccatttcctctgctctacacaaaaatctggtgtaagctgctacttgatatgttatatcagtttatcatattatttctaaagaggataatgactttcagacttttcttgtcttaaaaaaattgagaatttctgtagatgaacttccagttgtacccttcttcttatgctgagctttcttctttcttttctcctgagaaagtcagcacttttggttagcccagctgctaaaggagaacaggccatggccctttttgaatgtaaacatgtgcagttcacttaatttccccaaggatccttaagcctcctgcaaggatccctcaatttttgcaaattccaccataggagcccttgaattcagggttactgatttaatattatcctgctaaaagtattctagttgtagtgtacaattctaaaagtaggtgtattgtctcctgtattggatagttaatcaaaattccaaactataaaaactaattctgttacagatttaaacagctactggaggctgatccctgtaaactaaacctaagatatttttcctcattatacaaaatggacctggaatgggtagagaaacaagccaagtccataggatccatataagtaattgttttgtttacttacaagatactttaaattttttctacagaaatcactactcttttccattaagtaaagcctgtcatttcctttacatttttaaaggattactctgttaatgatttcaacaatttctggaatgtgtaagatgaaaatctcacagattataatgccatatgccatatactacttaggactttatgggggttttttttgtttgtttggtgttttttaagatggagttttgctctgtcgcccagctggagtgtagtggcatgatctcagctcactgcaacctccaactccctggttcaagtgattcttctgcctcagcctcccaagtagctgagattacaggcacatgccaccatgcccagctaatttttgtatttttagtagagattgggtttcaccatttcagccaggatggtcttgatctcctgacctcatgatccacccacctcggcctcccaaagtgctgggattacacgcgtgagctactgtgcctgacctatgatttatttttctaatgtaatatgtcatcactgtatgaaccatttttctaactttgacaatttttatttttcccttaatctcataagcagttttcatatagggtcattatgcatttttttttagaaaaatacgtctcagaataacgttgctaaaagaaaatagatcctaatattgctctagtttaaactacatatgcaaattgcagtcactgagacattaagacaatattgagaagcagacttaaatcgcaaattttatttatattatgcctgttaaataaaaaattatgatttttacattttattgtaatattttttctttatttcattttatagaaatcagctttttctcatgtaaaatgcacacattaaagtgatgtaacttgatgtcatttttacatagtctaaaatattacaggatttttcaactcctctatgagtttacttggttagataaactaaatttcctataatagaaaaatatttgctcattaaggagttattattttcataaactacaagcaaacaagggacattcatttacaattagaaaaaaattccaacatcctgaaaatgtatatgaaatatcattgatacaagtattatacaaatctattagtatggtgttgtgaattaactagcaattatctgctagtttccagagttgtaaattaactcaagtgtctaatctgagtatagatcatggagctggatataaactaagagatttataagagccagtttctacctttaggaagaagtttcctcagggaaagcagtgacccgcttggctttttactatggagatagagactctgtggtctctgtagtgaactgttccaaaatttaatcacttttacagtagatgctgcctattttccatcacgttatttcctgctacagtgtaaaactgagcatacacctttgtattcatgaagagagctgttaccttataaccttttctgttccaaataaccgtgattcttttcctatttctcatgtggtcaactcttaatttcatcattgcacagtgatgaaaagaagtacagaaattcaaaaggataaataatgccaaaagccaagtacatttgactttggcatgtattagaggatttttttagaagattattctaaattctcctagtttcattgctgacagaaaacataccagtttttataccaattctttggtgtatattgagacttttttatggactaaaacaatatcaatattcttaaatcatctgtatttgaaaagaatgtgtattttccagtttggggtacagggttgtgtaatatatacagatgtatattaccaagcatgttagttatgtgttttaaatcttctctgtcattactaatgtttttgtctgcttgatttgtcaattagtatgttaaattacacattacaatagatttgttaacttctacttactgttttcttaatttttgttttatgtattttgaattgttgttacctgtataagattatagattatttatatcatcttagtgaattgaatcctctattatatgctatccctagatctctagaaatgttttttgccgtaaaatctcttttagttatcagaatgaatatactacctacctctattttaatgttttgtactacttactgttttttcctgtagtgatgatgaagctttccctgatttttaaaatatattttagttcagaaattttctataattaaaacgtaaatatacaataaaataaataatgataaaattataaccaccatagtatagatcaagaagtaaaatattgccatataccacgaatccccttcatgtgtgtccccactcataatccctcaatgtccttcaaaagataaacacaatcatgacttttatgtaaatcacttacttgctttgttctgtggttttaccacctacttatgcatcctaaacagtgtagtttacccctttttgtactttatgtaactggcatcatgttatatgaatgtttctgtctcgtttcttggacccaacgtcatgattgccagtttcatctatgttgtatgtagtcctagttaattcactttttttgctgttaacagtggctttcaagcattgtggtctgtgatcccattacattgtcgaaagttattgaggatccaaaagatattttgtttacatatgttatgtatttaccatattagaagttaaaactgagaatttaaagatattagtctgttttaaaacaataatttaaaaactcatatgttaacataaacattttaatgtaggaaaaacaacttcaaaaatatagtgagaagagtgatattgttttacatattttgcagatctctttaatgtctagcttactagaagacagctggtttctcgtagctgttttgcattcgatctgttgcaatatgttattttggcaataaatactgtcagttgtttactttcaagtgacaggctctcgcttggttcattttaaaaaaaaaatgtctaccaggtactgaaatctgaataaccatggtttgtctattagttgttctttcaagtaaaagtggtggctcatgaaaaaagtggctagttcagcttgcaacacaaaccatcacacaggtgttctttcttaagacaaccatggtacttcagcatgcagcagtagtgctgtatgcacgcttcctgtttcatcacaccaaatattaaaaagatactcattcttctatgcctcttaatttctccttaacagtttgccgtatttttatcttttcatgctgcattgtgcataattcttcatgtttatcttccggttcattaattctactagagatatataatctgatactaaatttcagcggttaaatttctaagagttttatttgactattattttaagagtaaaacaatttttgatagtctgtttttcctgaataattctttcaaatctagcttcatatttttcaaagttgtcaaagttactttgtattccatatctaagcatttcattattggaagtctgcacatctggttctgttgtttgtttctgctggctctcacttagggtggcttatgttcttttgtctttagcagttttgtgttgtgggcatacaattgttggaaagtctctgttcagattctttaaggactagattaaggatatattcttcctgggaggattgtattcagttttctttttctttttttcctatgatatacctagggtgcagtgccatgtaactttaaataacaagtctcagattacagtttttagggccatggttgtcatagtgacacgaattataaagatatagttttaatatgtgtgtgtgtttgtctgtgtttaaatatcactaatagcaaaaacagtttactatctgttcctatgggctgttactttatttttcccctagtttgtttaatctctgaatagaaccttcttagaccctttattcagacagggtatttggctctctgaacatgggcaacgttagggagccattattctgcttagcacagtgatatattaaccatctctaaatcaatcttctttcctcctaactgcctttttccctcctttcctccttccctctttatttccttctttccttcctcccttccttttttgtctccttcctttcttgctgccttcctccctttcagtcatatatggcatggaatgccttgaatgggatcctgctttggctcagccaaaaatgccctgggcgcttttgaccaaaattacaaagtgtaagaaagttctatcaataacagactctgaacttaagcaaaaaatgtgtcacacttacagggcacactacatgcaggacatcattttggctgtgcctttcacttgtgaagttctgggctacctaactgtatattcttttacctcttttaatgaaggtctacacattttacatgacatctggtaaaggggccagtagctcagatagcaaacaaagataaccgagaaaacttcaggaagtctttgcgtattggtctactatttacatatcaaagcatcatagttgtctgtttcacagccatcaaagtgtccagttacacctgggcatttttctctgtcagcctttccttacttagcctgtatgcatagatatgttctggttttatatttgctttgcatttcttgctattaaaatctagtctgactttcattgctactttaagcttatgtaaaatatccttactgtattatattttcgtggtgataaaacttcctactagtttgcatattctgagaatgtgctcttaacttcatcgttcaaattgtttaaaacatttaaaactgtctccagaacagttacatatataggaatcagtgagtgtgccaggcatatcactgatttattagctgttttttcctgcagcagtagttgctgtaaggatgttgtttctgccctcagaaactttataattatttaaaagatgatgtaagataaaacaaaaacaaatatatccagttacagcaattcagtagtatatcctagcattgtttaatccctgaggctaaatgatgaaccagaaagctttctgcagcaggacacttgtaaaactgttacgttctaaataagattttttaaatttgaaaagttgtatattatcctaatagataaatacacattttcaaaatattttcaaatatggcaaagcaagaagaaaatttaaaatatcctaaccccaacatttggaaataattaatatatttacttctttttcttgtccacaaaatacatggttggttaaactaattttagttcttaatacgttctaaatatatttgtgtgtgtgtgtgtgtgtgtgtgtgtgtgtgtgtgtgtgtgattgtggacagtgtttggaagtaaggatgaggcatggcttcacaaagtgaatcattcctgctactcttctaacagtagtgcacagtaagccttattttctagtttggtgggtttaacaatccctttctttatcacatattaaccttctgagttgaacttttaaaacgcatccacattcaaaatatgtgaataatattttcagatcaatcatttgatctagctagtatttattgaggttattccatatctatataaaataaaatgaactgtattagttctatatttagctagtcttccctgtttagtttataactgcttagttaaagcttatattattataaagggagtgatgcagattctctgtcaatttgctacatttatagttatggtaatatttatgtctgtgttatgtaaatggttcctgctaaataatactttatttacattttattaagattttattaaaatataggcagtgggcagtgtttctagttagtaatagtgaattgaaacttagaggacctttgaaataattcctagatgcatataattttattaggagcactggacttttaaagattaaggcaaaatgaaagaaagaaaagttctgttttcatccagccactcttgagtacaccatgcagcatttcatctcacattaaccaaaagaccacctgagaacctgtgaaatcttccctgataaatcctgacagaaactgggtttaattatttttgtttatggggatccaagttaggcttgcagtttgacatcttcctagagtgattagactacactttttaatctacacttcctgatatctccttcagactaccctgttctcagaatttagtatcctgtccttgtaataaataataagtagtaccgtaaccattcacaatagaaacacctgccaaatctcaagtagttttgagtgctttgacttaaaacaggtctatttctttttgacaagtttgggatgaatttaaactttgtttctgtaaagtatagataaagttattttgagtctttgatacactagcaagataaatgatagccagcaataatgtatcttttaataggttgctacaaagttaccaaaatttttcccaaacaaatttacttcacacaaggtgtgaatagaattttttttcaccctttcttagaagttacacacgtttcagtagaggggcagaaggagagatcggagaatttgattcttttcgacaaagctacattgtacttacaaatagtggttatataccattacacctttgaaagtatgtgagttaccagcagtgtaatacaatactgtggtgcacagcagaaaacaaaacaaacaaacaaaaaaaggtaagctaatgtgtttccttttcaaggttggttagatttaaagtgtataaattatcattctttgtaactattctttagatttcagttgtgcttcttaaaacttctacaggtacttaaaacagatgctgaggaacttgtctccagaagctattgggatacactgagacgtaacacaagccaagcactgttttcagacctcgcagaggtataattaaacctcaacaaggtccttgtactatttgccatcttgttaatctagtcgtcatttcattttagtcacagtgatgaaacccaacatgtatgttacattttccattgttttagtacagcaaaaattactatatataaactgtgtatttgaatacatcagctttgacagttgaacttaattaaaaggaaatggcattttttttaacttaaggatcactttctagaaattagaatatatatattttaaagtttcactgaatcttttaagcttacaatttaccatgttacatgaaatgctgaaatgtttcccccagtaaaagatacctgactcttcagagttatgttagatttaaacaaatttcctagtattgatagtgagtggcttaccaagggcctggggtatgggagtttgagaaggtatggtaggaacagccagtcaaggaagggaggaatattttaccttgacattaagattgccagtgcatagtgaaaataaaaagcagaccgaccttatttcagttctattactgtttatgaatttgttacagatctgcatcgtactgctgcatcggagtgggctgcttccattatcccattcttacaccactgtcaatagagatttctagtttctcaagatgggccatatcttagaaaaactgttttgtgtttcttattaagaatttttcctaagaactttattagaggcagctagcggtcttaccagaaaagacttttcaataaatactgagatttgtttttcattatctctttctctttacagtgggcttctcatttctttttctaaactttaaatttaacttttagaagttacacctgaaaatatctggagaagtaaactggaatcagttgtgacttctgttatccatatatacaatgttactctattgacatatctagactagggcaaacacttgaaaatgttaattttgtcgcccttgctcagttttaaagtcccaaagcaattaaagtattttgtcctatgtttaatatgtctgtgatatataaatgtgatgtaattatgaccaacaattaccttttaaaattaccttttcaatatgagccatgattaggtatgaagtggcagatgttccctttacagatattttagaagcactttattttgtaatcattatgtaggcacattgtagtagtcagtgcttaaaaataagagcaactgggactcttagagtgcatacaagtcaactgtgtcctagtttccatgcttcaaatcaacagtcatatcattgttgtctctccccatactagagtatccaccttccagcctccaactatcttcatcccatttaactctggtagacattctcagttagacaaaatctgctaatcagatgttgaatttaatttaaatcttgggaagtttaatatcagaaaaccagtcagttcctgtgtactcagagaattatatgatttctgtaagatctttggaaaaggtatatggttctgttgtagatagactggaggagctgtgggcttttacagcttcccagagctaattaattctgcacacctcttcccaactcaacattctgtgacaccccctttgttacttgaaagtggccgtgataggagtatgaataccacagaaactggccaacattacaaatcagccttttttttttttcccggacaactcagtttgccagcacactattggctgtaattaatccacactctgatccaaagctgctaaattaatgaatgaattgaatcaaatttcatgaaagtaaatctgatggagacaatcaagaaaggaaaaagaggaaaagaaaagaaaacttatatcgtgttccagagtaaaataattacttggggtttatctgttactaccctcccacattagaataataattgagaattaactacagttcagttacaactaattatataaatccttataggttactgtgaataccagcggaacacagaattgtttatagtattagtatttcaggattcaaattggttcagaaagaaggcttggaaatctatttgttatatgtatttctttattatatatttaatatgtaattattgagataaaatctgtttattatagggaaattgggttattagcccctcatattctagtctggagctgtttctaaccatagatttttaaaattacagtaaaactccgtgtctccaattactgtgaaaccatataatgaaaatttgaatatcagagctaagactactttctaaccaaaatcatatataataaattcttagtgcagtatgatgagtatattgtgcaactgttgaatacagtctgtcagtgtcaaaattataaacactgttttgagttctacagatgaaatgtaaaattttgctttaaatttgctttaaattacatattcttggtaaatttcaatggattattcaaaaacttcattaacaaaatcaaaagtttgaagatttcctctagcccttcgatacctcgtagggttattatcacattataatcaataaaaatatgttaaaagaatatttttaaaccctttaatagtttgatatatttatatttcatgcaagtttatttttgatgaaatcattttaaatagtttttaatcaaaacaaagtaagataatgtcctttgaataaatggcccatggggttctttggtggctttttctccctttgttatgaaaacacccgagttcattttattttaacaatgagcacaagaatcacagggataaagtctctatttttctctcagtccttgggtgatgtaagttacataacactgttaagatcccaaggacactggtatagttttcagtggctgagcagtactctgtttcactgaatgggggaaaagttttccccattttcattttcatttctctgatgtcactgttacttatgcctcattggatctggattatctggataagtgcaacctacatctcataagattttgatgctgaaagactgttaagtgaagatctgctctgatcagtgggcaggagaaaaactggccgaatgaggtcattatttaaaacctgtataagacaaagccatcttattttagtatactgtgtcttgaaaaggacatcccacactgtaagaaaacattccttaattatgttatctgaattcactaacttttggtgttcctgtaaccactcattttaaggctttttttccagatgtatataatatgtaatttcaacagcaaaaaagaagtaagagtgtatgatgtaaaaatctttttttcattaagattcaacattcttttctgtgtctagtcccttttcagtgtcctgaaatatatttgacaaaaatacataataacagctaacacttactgagcatttacagtacactagtcagagggctaaatgatttaaatgtgttatccttaccacaaccctttgggatagatactattattattccttaagatagtaatatcctcgagagattaacttctctaaggtcacttaaataatgagaagtgcctggattcaaagccagcagtctgacttttaaactcatcttatttgctcaccacagtactggctatttgtgaagcaagcaactttttcaaaaacaacatttcccccttctgatctactcttgtctcctttcctcccaccccattcctctagcttccagacagaggcgcctctactcttatgctccactcgagcatggagtaacctctgaaatatttcctcctactactaatttaagcggataataagtaagataataaacttattaagctagactctattaaatcacacaaagagtgcctataattaataccagatttcttttttcccaaaagttatttgcatcttatgactactaataagaacatttgtttgcttatattttaactttatcctcaaaattgttgttatggttaggattattcccattttatagataagaaagctgaaggttaaaaaaagtcagtgacccatgtcttctaattttaaattttgttctattagagcaggctgcctcttcaacttaaagttctggggacagtaatgcctttgagagctactccaattatactagtctcccctcacttatggagccccacaagactggcaccactaatatccctcaagtttcataagaagcttattcaagaagatgcatttaaaacatagtatgtgacacttggctacctggctgtattttttttcctcccggcaaacagatcaaactactatcaaatcctcaaagaagttggttttattgtagacaacttctcaggtattccagctatggagaattcttgggatttctcaacaaagtaaactgagaagtagtagtagagatctaccaaacaatgacaaggaggttatatgctggaaatgattaggaaaatctaaactatattacttaaatgtgaatagaatatttagtcgattactaaagaatgtcaacaattttagataatttaaagtacagatgaccctacatgctggagtttttaagacatgtgaataattagtcactttagaaacagattttaatgcattaaaaggggacatgtgcaggggaaatcaggtgtggtctttgttactccattttaatcattaaaagagaagaagatgtggtccatggagaaaggaaataaagatttaacaaatgttatgaaggacaaaattgccatctttatgaaagattaggaagagggctatgaggaattaaaggaatatgaaaatttagtatatgggtgaatgagacttttggtcagcaaccacagaagactgatcctttgtagagaagtatttgttttctgtcttatgttttctatggagtactataagagttctggacaaaaagctaaaaacgatgtgcctatctacagctatttttcttgaataaaaaataggattatttaaactcttttttcacatttcctaggatgatgtgtaggagagttatagtcctttgaattttatgctttttgtacctgagtttatgaaatgagttaatggccaactggagaaggaaggaaggaaggaaggaagggaaggagagaaaaggaagatctataaagctatattaaaggaaggtggatgattttcataggccattatactttataaggactataaccaagcagttttaagaaaatacttagaacttagtttattgagtgggaaagcaaaaatcctctggaattaattttttatccatttgacgtgttacgtaagactttgaaaaaattatagatcatataaattttcaaggtcatattattactttagtttttctctttccaaatacagtatccatttaaagtatcataactgtggaatacagtggttaaaggaagctgttttgtgaagcttgggacctttcttttgtcagctccatttattcagtatatctgaagaggttacctctttggaacatcatttaaaaaaacagatttttcagattgattaggaaaatccaaactaattacttgaataaaaatagaatatttagatgattattaaaggatttcaattattttagataatttaaaagatagaatcctatatgcataatttgtgattaaacatttcttaaatcacatcttcaaaaatttttgagtacaatgatcagttccattcaaagttctatttttaaaatgtgagctttattttaactataattgcatgtattaatatgcctgtgtttttcattctaatattaatatatttacattcttgatgtttgtatgttgataacagaattctttgagaaatattgggtatccctattctgtttcttttattgaagctaacttttaaattgtgatttttttttaagcgtgctgatgacatcacaagtttagtaacagatactacacttcttgtacacttttttggaaagaaaggaaaagctgagctcaactttgaagatttttataggtgagcttatttttatatttttattaaaaattattagcctactgaaatcagaaggatctttagaaattgtctagtacagcaatactcacctctttgttactttaattttaaataagatcctctgtataataaatacccacatttatcagtacctacataccagtggttatattgataattataacaggaagttactgaatttttttaaaaattccagatatcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatggcgccactgcactccagcctgggcgacagagcgagactccgtctcaaaaaaaaaaaaaaaaaaaaaaaaaaaaaattccagatatctggattgattgttatctcttgtatattcagaagaaagtatgttgccaattccttgtctcaataagctgcagtgatagtaacaagtagtttaagtatcattgctattctgcaaggtacttttgttatccccatgttatagatgaggaaactaaacccctgaaaggctaggttatttgccctgggtgctacagtcattaagtagtaaagcgatcgtgtgttcttttcattctcatttacagggaggaactttattaatctttgcatcatcatacaattatttccatataaccttttctaggacagtgagtatttgctcatctcctgttacgattactctttctttatctttttccttctttattacatttttgtcatagattcatggataatctccaaacagaagttctagaaatagaattcctttcctactcaaatggaatgaataccatcagtgaagaagattttgctcatattcttttacgatatacaaatgtggaaaatacatcagtatttttagaaaatgtgcgttacagtatacctgaagaaaaggtatctaatcctcatatttagttggttatgttactgttttgcaatacgtgcctctaaaacacattgcccttttgttagttctttggcttctctgtggattaaaagatatcttggatgtgtttcattctgtgtcctaaatgctctggctacacttttaaaaataaattaattgtatattctggttagatatccacatttttcttaggtatttcaaaactcctttaggctactaccaattgttttattcaaattaacaatatcatttttcaggagaattccacttagctctatgctttgactactacctaaataccacctcataaaaaacagtttatgttgacatcatttctgtcacactctattcctttccgtaacacccttaataaaaggtcatttgaagaccaccattgatgagtgagtgatcttatcatcagctgaagtgaagtttttcaaagagtttggatgtcatgaatggttaagaacctgggacaactgattgcctatttgtttagtaacaaatgtgttgtcagtgcttctgaacagttgcattatctagtggtatttgaatgcatcattgccaccaaatagaactagtgttacaagcacctcttcaagagtgggatgttttagatatattgccttctatttgtgtttagacaaggatcaggttagtcatccaagaaaaacttgcaaatagtttgactttgtttagaatggatacactgtgacaatgttaacaattttccatttcccctaaggaatgaaaaaaaaaaaaagacttcatgcatttggcaattagtttacgatatctccaaattagagtactttttgtctgttgtacatgttaaacggaatttttccaattcataggtacttccctaaaaataaatattgaaaattgtactaccctagtagtgcaatttttccagctactgaggtattacttagggacttgaatctgcttttttttttttttttgcttttattaaatggaaatattaaaatctgtaacttaaaaggttaagttttttaaagttaaattcagtttctgaaaaattccaatttctagaagtatcttaagcaccacaaatgattacttgtagaaatggaaaaatttgcacgtgaatcaaaattaattgattctcattgattttttttttctacattacctcatcaatcctcagagcaaccttccaggcttgactttcttcagcatattttagaatagtggaagctgaggctttcagatacttagaccgttgtccaaggattcaaatccaaggctttctaagacaatgatattcttaccacactctacttatgtctttcccctccttccgcctacttaactcttccccttccttccatctctcatctccttctctccagaagaataacagctactaatatttgaatagccctttacatttctaaattgctttcattttcatttgtttacctagcagatatttattgagcatctactatttacttggctttattccaaccactggggttaaagtggcaacataagcaaaatccttctctcatggaaatgtatgttagtggagagacaaacaagtaaaaaaagacatactttcagatactgataaatgttatgaaagggagcaagagtcatggggactggaaaagaaggtagactgttaggaagagctttgctgaagagtgaagaggtaacttctggggagagactgtgaagaatgagctatgcgaagttctgggtaaagtcttctagacagaggtaacagcaaatgccaagggcctgaggacagagaagcttagtttatttgagaaaatgccaaaaggtaaagtaagtggacaggaaaattgtaggcgatgagtaaggagaggtagatatgggtcaaatcttttaagactctgtaggctaaggtaagaagtttagttattcaaagagtgactgtaagagtgatgggaagccactatagtatttaaactttaaagcaggagtcagcaaactactgcacctatttttgtaagtaaaattgtattggaacacagccattctcattcatttaatatactgtctgcagctgtttttacactataatggtaaagttgaggcaacagagaccatgtagccagtaaaaatgaaaatattgactctctggccctttacagaaaaagtttgtgaaccttgctttagcataggcatgatgctcattcagcaaatattcaacaagtattgacaatcaactgtgacactcagatgtggtctaattcatgtgccagatatctgattcatgtttcaagagatatcttggctgctacataacagaatagattttaggtggcctggctttgaaaggaagagacaggttaagatactgttataggtgcccaggcaatagataagcatggcttggaccagggtaagagtagggaaaaggggtcagatattgattggatcatttaaaaagtagagctgatagtacctgttcgtggatatttcattataagagaaaaaggaatcaggaactcctagggctttggcttgaaccacaggctgaaacaatgccatttgctgagctaagcaaaaccatgaatttagggttaggagggaatcaagagttttattaggaaccagtcatattttagattcctaatagttatctcaatgaaaaattaagcaggcaagttggatatgtgaatctagcggtcaagggtgcagtcaggactactgattagtagtcattagtgtatatccacattgtctgcagcttaaacttctcccctgaatttcaggcttttgcaatgtactgcctactcagcatctccacttgaagatccagtagatgtcttagacttaatggttgcaaacctgaactcctggtcattccataacacttgttctgcaaaccatcttccctgtttcagttcataggacttcggttcttcttagttcttgtggccaaaattttggactccctcttttcacattctacgtacaatcagtctatcaagaaatcctattgatactacctgtataagaatttaaccactcctagccacctccactgctaccatccaagaaaccattctgtcttgcctggagtgttggaatttccccccagatcatccttctgcttccagctttgcctccctgcaatctattctgcatttagaattcacggaaatgtttttgactgtgatttcgatcataccacagtaagattgccattcttctcaaagtaaaagccagaatccttacagtggctcctacacacactgctccctcattacctttgacctcacttcctatattctgatcctcctagctcactctgcaccaaccacagaaactctttactgtttctcaaatcttctgtcttagggctttgtatatgttgtcccctctgatgagaatgttcttcccttaatagccacatggctcgttatgctatttctcaatgatgcctaccctttctaatctaatatataaataatagcctattatatgaataatatataacctattatataaatgatactccctctcctggctgtccttattccttcctaccttaatctgtttttatttccatagcataatcatattctaacatactgtataatttgcttatttcctaacaaatatgttttatgtatatgtatgcaaatatatatattatgttgaactcttgttaattgatggatagatggtattttaaaatgtagaacttgaagcttttttgttttatgaattttacctacagatttattcactcatgatgaaatggcacatgtacaaggttactaattataatgttgtttgtaatagcaacaggctggaaatggcctaaatgtctttcagtaagtcactgatcaaatatatcatgatatatctatagaatagaataaggtgcagctgaagagagatgaaaaaaaattctttactagtgcagaactatctccaagatatactaagtgtgaaaagggcatgatttagagccgtttgtagactataaaaagcttatgctaactctggaaggattcacaggactagaaattggttcctctaaggaaggaaactacatggctaagggtggaagggacattttgtgctatacaatctttgggccttttgaattttgaacaagtgaatatattaaataaataatttaaaaatttttaaaatgccatgggactaggtaaacttatctaggagataatgtagatagtgaccagaagggatggaaagatgacttctcatactaaccatgtaatgcaaatgttaacaagaaagtagtataattattgttattaagctttaaggaaatggatattcagaaagatttaagtggcttaccttaggtcattcagccagtaaattttggagtttggatttatttctcctaaccttttaaactcacttatatttctaaaagttattatatacttgccatttacatcagttaccaataaactttgaacagtatatattgtggcataatttatgggatcagcatgaattttgtgctgaaaacaaacatggcttatatacacttgaaagcctcataagaccatgttttctgaacgtctgtttgtatttagtcaatactttattgtaatgatttgtttggattttttgagttagtcttttcctcttcctagccttttgttgtttattttattgaggtaaaatttgtataacaaaaaattaaccgttttaaactgaataattcagtgagatttagtgaattcacaatattgtgcaactgccacctctttctacttctaaaccattttcctcataccaaaagtaagccccgtacctatgatgcagtcccttcccgtttccttctctcctcagtccctggcaaccatcactctgctttctgtctctgtggatttacttattctaatatttaatttcagtggaatcatatagcatgtaacctttttgtttgggttctttcatagtatttttattattcacttaaatttatttcttttaagaaatggggtctttctctgccacccaggctggagtgcagtggtgcaaccataggtcactgtagccccgaactccttggctcaagtgattctcccaccttagcctcccagggagctgggactataggcatgtcccactgtacctggcaatttttttggggaggggggggtagagacagggtttttttttgtttgtttttttgcctagacttgtctcaaactcctgacttcaagtgatcctcccacctcaacctcccaaagtagtgggatcacaggggtgagtcaccatacctggtctcatagtgttttttaggttcatccacattgtagtatgtatcagtatttcattctttgctatggctgaataataataatagtccattttatgtaaataccacaatttgtttatccattcatccttccatagacatttgggcgatttctatctttggctgttgtgagtagtgctgctgtgaatatatgtgtacatgtagttttgatttgtatttccccggggagtaattatattcagcatctttttatatgcttattggccatttctttggagaaatgatttttcaagtcctttgcccatttttaaattaggttgtttatcattttgttactgctttgtacatgttctttatataaactggattctagagccttatcagatatattatttgcaactattttctcccattttgtggattgtcttttcactttatttttatttattatttatctttaatttttttctacagacagggtctcactctgttacccaggcaggagtgcagtggcatgatcatactcactgcgacctcaaactcctgggctcaagtgatcctcctgcctcagcttctcaagtagctaggagtacagtcccatgctaccacacccagctaattttgatagtgttctttaatgtacatgtttttagtttgatgaagtctaatttatctatttttattttgttccttatgtgtttggtgtcatatttaagcagttgttggcaattcaaggtcatgaagttttgtctggttattttgtaagtctactagctttaactattaaatttagaactttgatctgttttgaattagtttttataaatggtatgaagttagggtctagcttctttcttttgcatgtggatatccagttgtcatagcaccatttattgaagaaacaattccttccccaataaatgatattgacatctatattagttcactttcacactgctataaagagatgcttgagactgggtaatttataaaggaaagaggtttaattgacccagttctacatggctggggaggcctgagaaaacttacaatcatggcggaaggcaaagaagaagcaagtaccttcatcacaaggcagcaggagagaaagagagaacacacaggaaaaactgccatttataagaccatcagatctcatgagaattcactcactatcacgagaacagcatggggtgaactgcctccataatccagtcacttccctccctcaacatggggggattataggtccctccctccctggacacgtggggattgcaatttgagatgagatttgggtggggacacagagccaaaccatatcaacattcttattgaaagtcagttgaccataaatatttgagtttattccggtactctcagtgcatgtattttttgatgttttcagcttttcagttatcattgttttatttttgttagcagataagctacttcttttcaccttatttctaacagttaagacaagttccattcaagtcctgatggtttattccagtagtgattctgagtgtgaggatggtagagtgaagaaatggccacaccccttttgtctgcccctctctgactgtctgtccctcttggccattaagaaacattgctttaattatctccatcaaaatacatggcccatttgttattttataattttatatttctaaacacaaagtgtttaatctacacaaaagaatgattgtatgttctgaatttgacctctttccaaaaatgagaaccatgtgttgaaaaatctgaaagttcagatgttgaacattatagtctgtcatttttaaatttatttcttaatctcatgtctgccccccaatatattgatatttttgttttccctttatttaaaaatattccatcctcgtgtgttttactcctactaacagtagcctgtcactcagacactgctgttatggcagcaggtcgcagcataaactggtgcagaaccacagcagtgactagtttttttggcaacaagctctccacatcacgacaaaccctttctggtgcagtcctcctaactgattcaaacagccttctacagaaaacatgatgggtgggatagggtcacaaagcaggatccaagattggaatggtcataaatgatcaatgtaaggaaaggaaagtaaacaatgtgaggagaaaagacagtaaggattctcccattgcaagtaaaagatgagttgtaattgaagtaacatataccaaaagctgagtgtttgggtaataaatcatttgatctaatcagtagctggcttatatgaaactagatccctgtggggctttccctggccttccaacacggccttgttagtgtcccttcctctcacccttgtattaagtaagaatttgttaggcctcaactcggccttctgctcttctctctgttctctttcttaattatgttaatttgctgaggagaacccattaactaaatgcagctcctcttgtccaaatgtgtattctctaagatacattgtacttatttcaaagactttccctattcaactgaagtaacagcagtggcaataattgcagtttatacacatgacattccagaagaggccaccctgaccaccagtcctttacattatcccacaccagcccagtgtggaggcacccagaactgtacctctgaggtcattgcacttcctgccactgccctggcagtgctatagtgacaggaacaagtgtgaatacactgcgttgacatggagtcagcactttgattttgcattgtcattataaagacattcatgatctaatgatgctgaattccatttgaggaatacatgtgcaggggaaacttttttatggcttttttttctgttttttttctttattatcatatttaccttacaaggttaaaaaaaatcaggcataaaagagaggattttcaaaattgaaactttttaattcttttttattggagctttttttttggaatttagtgctgacacgacagtgtttacaaaatacttttacctattattctaatagcaggcagcactacccagtgaaagtaagtctgagtgaattttacattccagttggagaacaacgtcaaaatgtgccctggaaatgtttacttacaagatacattgcaaatgcttaatctgtttttttctcttatgtgtagatcctgattttaataaatttggcaatactaaatgtattttcatttcctttcccaatatagggcatcacatttgatgaattcaggtcatttttccagtttttaaacaacctagaagactttgcaatagccctgaatatgtataactttgcaagtcgttctatagggcaaggtaagtaatcatctacaaaaattaaaagcaagaagtaatactacattgtttctatagattttggcaaccaattaattaaatatgacatatcacccatcaacttgtgtgaaagtccggtgtatactttcagtgacaagtcagttctggtacttgtcagaaaacagccatgagggaagaaacctcatggccactgggtgacattgagggacttgtgtgtacctatggaggaagcagctggtcgtgccctgttcttacagggtggtattttattttactaatttaatgcctgctgactcagaaactggaattttctcagcagagccacctcttagccatggatttacattaaccaactaacctgtaaaattgagtatcagttttgcataattttcaaataaatacagtggtcatagaatcccaagtgctggtgtcctcagagccagctgtctttggctataggtggactaagaagccaagcccttttcctaggatcctgtggctgtgatcaccttccctctcctcatggccatgtcctttttaaaacttcttgccctatggggactttgtttgtcttaaggtgattttacctgtctctgccataatctgtgttaatgcacaagcttaaaccccagaggaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaccccagaggacaggctattattatgttctagagagaagccaaactgcagtccctaagtgctgatgataatttctctttcccaaaaacatagatactgatttcatcatgtggccttattcatttattcattgaataagagaaacctgcaaaattttatattttaccctttctgtagtctagatgttcaaatatggcatattctcaacccattttagtgttttaaagccaaaacctttggcaactctgcctctacagactagccattactgctgtgataaatctcatcaacgtgcaaagaaacaaatcaatatctggttactgggttcagaatagaaaagttgtttgttttttagaactggaaaatgaaaaaaattgatggtgtcacctgtcttgcaggcgctagaaatacgtccatctctttttgccatcacaagtatctttattcaggttattacctcttaaaaggaatattgtagtagccaccaaagtgacaatcctgctactagctgctttcctctttgatgtttcctacacacctgacagaataatctttcttaaaaaattaacttttctatgacacatctgcaatggaaaactcttaagttttccaattgcctattgaagaatgttctggttccctgcctcaaagtccctgtgcagagtttcttgagatcctagatgtcccctgctccacccaaaccagactccctgttttctgaatgtgctttatgccctcccacctccccgcctgccttggttcattcatgtcatctcatctgccatttctgtcatctctataggctgaaattgtccttttgtgttcagctcaaagacaaaatcacatccttttcctaaccactgcctttctctcccttctccctgctccacactaaacacagaagtgatcactcatctccagattctcatagcactttattggtagtttttgtgtggcccctgtaatgattatttgggcaggggtctcatttcccatctgaaccgtaagtttcttgaaaacctattcatcttactaacttctaaagtatctgtcactgatagtaggtgctcattaaacattcatcgaatgtgaatgcattattaacctaagatacagctgttgcttggctcttttcatttaaaccacaaaaatgttcattacctaaaagacagcaggattaatggaaggccatgttgcataagatcatgattcacatttagaaaacaacttcttttacaacctttctagtaattaacacatattataaaaataataacagtctattctttttctatgtaacatttatctagatgaatttaaacgtgccgtctatgtagctactggactcaaattttcaccacatttagtgaacactgtcttcaagatttttgatgttgacaaagatgatcaattaagttataaagaatttattggaattatgaaagacagactccatagaggattccgggtaaacctacacattttaaacctattgatatcctttttaaagtctgagggaaatcaatccatctaagttgagaaataatttatcttaatttcttaaggatataaacatgaatgctttatttgaaaagaaaaaacataggccttacttcccttaaaaaacaatttgaggtgataaaagagaatgctttttaaaaaatgtgaaatcagtttgaccttataataatttattttcatagtcagtctaatgtcttcatcctagtttgtggaagaaaaatgttgccaaatattttcaaaaaatttagtctgcatattagcttttcggacttgttactatacaaataaatatcactatttgtcactttattttattttaatttaattttatttattcttttagagacagggtctcactctgccacccaagctagagtgcagtggcatgatcacagctcactgcagccttgaactcctgggctcaagtgagcttcctgcctcagcctcccaagtagctgggactataggtgcatgccaccatgcctggctaatttataattttttttactagcaacgaggtcactctgttgcccaggctgacgttgaactcctgggctcaagcagtcctcctgccttgacctcccaaagtgctaagattacaggaatgaaccaccacacctggccactatttctcattttagatgacacagatttcctctaggtaacttgatgctcttatgttactgcataatcattactttttaatatgaaaaataagttaaaaatttttttatcgaaatcttacagtaaaaaataattaccagaaattcagtgatttttttcccccaagaaacatgttttaaagctggaaatatagtatgaatcaataaatgtgtacatatctaacatattatggatgtgccacaaatagaaaaagagaaaaaatgttctgttaaaattaagagctagaatattcaatcttccctcttgcaagaatatccctaagttttatccttttttttttttttttttgagatgggagtcttgctctgttgcccaggctggagtgcagtggcgcaatctcagcccactgcaacctccgcctcccgggttcaagagattcccttgcctcagcctcctgagtggctgggattacaggtgtgcacaaccgtgcccgggtaattttttgtatttttagtagagacagggttttgccatgttggccaagatggtctcaagctcctgacctcaagtaatcctcttgccttggcctcccaagtgctgggattacaggcatgagccaccgtacccggccagtattatacattttaaaagagaaaaagttatatatccaaaacctcaagattcatctgagacagtatttttaaagatttttaatgactttaaagtccaagctacttgagtaaagatgctgtgtacttaactgccacctggtggttagttgttaacattttaggtgatgccagaagtacttgaaacaagttacattgaaaatcgtttattttgcctcaaaaattttagaggagcaagatcaaattaaatataaagtacgctagaaacgtttgccactgtactgctctcttaagtgttatgtttttatttttatttattacatacctgtggcctttagcattttatttacatttgccctttttttaatttttatttttaatcaacagataatagcatacaaatatgtatttatggggtaaatgtgatattttggtatatatatatagtggaatgattatatcaaacttattaacaaatctatcagctcacattttattgtgagaacattttaaatgtactttttaaaagcatttttgaaatatgaaatacatgattactaactatggtcaacttactgcacaatagatctcaaaatcatattcttcctgtctaattggaactttgtatcctttggtcaccttccccctttcctccccagtcccccagccttccagcctctggtaattaacattctactctccacttctatgagtttgactttttagattccacatgtaagtgaaatcacgctgtatttgtctttctgtacatttgcacactttgctcttctgttttacagggttataaaacagtccagaagtaccccactttcaaatcctgcctgaagaaagaacttcacagcagataagtatgttagcttctatttgtctaaatttgttcagtaacaatagggatcataatttatttttctgttataacatttagaaaatagctgaaagaaatagaattatctaatttatttttaatttttaagtcattagagtatcttgattgaaaaattttacgttaaacctgaagttttgtatgtgagcagacaatgtaataaatcaaaattggacttttataatataggataattagcacccaaagaatatttgttactgttttttaggatcatgattctgagcatccacagaaaataacagcttatttgtttagttattttagttgtctggcactatattaagtgttcttccacaggtagtatctcatttaattctcacagatatcccatttaacaacagagaaaaatcaatgtttaacaagtaacttgcataggataacttgctagtcagtggaaaaccagaatttaagcttcattctatcttattcatttattacttcctatttattataacttattattccttatcacatttttattatttataacccaaaaaatgtgtcaaacttgtttctaatctccaagcgaggagtttgtttttttcttttttctttcaaaagtcaactgtagcgataaaattttggtcagttgtgggtttttattagttagatttctgcaatggagattttattgttggtttaaaaatgcttgcaagtatattcatgtatatgtttcttgctgtttttctcaagcttgaagcatagatagatagatagatagatagatagatagatagatagatagaggtgtttcccaaagtggttcctcagcacatcaatgcatacttaaaaaaaaaagttgcttagtcaagtttaagaaatatcataataaaactggttaaataagtttcttccccatagagtttattagattgtaatatgctactatgcattttgtcttgccaaaaggaaatggcagtattcagcattttacaaattaggtttgagatctagtgttttatggaacccattttgggaaatactcatctaaaatgtttagaggcaagcaggcttacttatttgtctaaggtggtaaccgttgtagctgagttaacaaaagaagtcaggtcttcctaatctccattttaaggaattttaaactgccttataaattcttaaactaaacattgaaaaaaaaggaggaccattgtctggtatgtccacacaggtagtgttcccgaccgacttgtagtatcacactggcaccactgattctaagtaatagtgcgtagagccatacctggaagtggctacctttctctaagcctaagattgaggattgcacagattactaaacaaaacactcagcttttaagtctttgtgtcttatattttatgtggggtgtttttattgaattccttacgtttcatattattataagaatatttaacactatcacctcagaattatatcctaaataaatattgcttttgtgttattattttttttaattagatactcctaaaacaaagtttaaaggattactatctgtgtgacaaataacaagaagcaacattttgagaatggaagcaggtctgaggtcagaagaagtagagaatgaaggaaaaggtgaatgctatgaaattgatattttttctggaactgaattcttaaacataaaacagataaaatgcatcttgttactacaaatgttatatatataaaatcaagttgagctttgccttgatttgctgaactctctgcactttttcattcccttcagaagtatatagatacttccggtgactacatatgaatgtactttcaatattatttttttatttattcattagaaattttcctcatttcaaaataatttatgactcatggaatgttgatcgcctaaaaatgaacatcgcattttctttgattttggactgtgaacttattttcagagatgaatattgcttgagatttataatacccttagaattaaattcctgttatttgcccagtttttaattacactgagataattttgaaaagaaatagaaattaagctactatataaaacaattgtttacgtgtacttttaacttttaaaagtacttaattaacatatgttgtttgacttgtataaagtttttaaaaattgttgtttatttgccaaagtcaacagaatgtctgttattgttttatgtatacggtaaagaaatttaaagtgtagaattttcctcccccaaaaagtcatgtgttgatagtagaagcagtggtagttgttgtaacagtaatcattgtcattgtcattatcttcttaaacatgaagctgctcctgatcataggtggtacacgttaataacactagtaaaaataacgtcttacactctgtaacttactgcatattgttaatgtatgtctagcatcaaatgagtattgtaaaagactaatataaaatggtttataagactgatgtatatattaagtagaagctaatatttttgtttcttgcaaaaggaccacttgaaaagtgatgctaaacagccagtaataataatttaaatataatttattatttcaaaagaatatgtcttaaaagggaaaataaaaactttctgttgaatcacaacaaaattagatttgtacatagagaaacaatttgataatacttaatagaaatctgttcaattaaaaatgcttagtttatacaaagatactacacaaaaatagaacaattagtctgaattaacgtatttacatattgcatatggaagataagttcatttatcttcctttctaagacatatttaatgtaggttacatacactccaactattactttgcttttgcatatgaaactagaaaacactgactttgtttttataagttattaaatgtgaaattgatctgcatcagcttatttataaaagtaatgttatttccaagaaaatgttactcttagcattgattttgtatgttagactttttacattgtttatctaatattatttatgacagtaattttaaaatatattattcataagttcaaggatcccatatagtataagaatataatttcacttgctttgaaagttgatttaattgactgactaaatgaaaatgcctacccactcatataacatacctcaggtctattttaccttacactgaatgttcttaatatgatttggtacctaaagtaattgaaaaaaatgcagtttcctttaatccttgactataagttatactatgttgcgtacatggcaaatcctgcaaatatagattaaaaattaaattagcccattgaaatcctttataattctgtcattttcccaaggaagaatagcattgtacatatgcaatctttattttattctttattgcttatcagagtgagtggatgaaaacatttgtaaggctgcaacataatattaaaatgtgaataaataaatgttctgataaaatagaaaagaaagtaaattacagtgatttccatcatattatcactcttgaattttatcatctataaaatgagagataaaaatatctcactgaattgttacttatatcaatttaaaatttgctagtggtttgaaaataataatgtactgactacatgtatgctgttattgtcagtgtttccttctataaactgttctttggaaaaattaagttatacataaaattcatattaaactttttacagaaagcatacatgataaacagtttatggtacttctcagaatcatttcataataagcaatttatttagcttaagttccaacttactgttcttattataaattgcaaagcaacctgtcttacattcttacattatcttaaaataaatatttctgcccttgaatcaagaaacattgtacttggcttttatatgtatctgtggactaataatgactttctgaaaatgtaaccttcaaactttggaaatctttatgggttactaaacctcttttgattttattccctcttctgtggcaacacatgctaatgacatttatctcatcaacacctttgtgggtaggtaactcacagagctataaggcttctcaaagtaaattgtaggaattcctaaattatagaattatggtcattggtactggaaaacttttcagaaagtttatatgtgacttaatggagtattaattttgtaggtatcatcttactaaggtaacacctagaaatgtttcaaaatacactagttattatcctactacttatagccatatagtaaattaacactttttaaaatataatgcttttacttccaaaagatataaaaatatgaattccataatattcagaaactgtaataaaaattgtaagtgataagaaatcactgtggtttgtaaaaaattggtagcatttttaatttcttagtagttcataaaataatggtacaccttgcaatgttgcatcttagattctgtgaaatactttatttgtagttctctatatagcataatcagtatttttggcacacatcttaaaaatggaggaatatacctataattgtgactatacgcacagagaaagttttctgggaaagataaattttgtccaacactgtgaagagagagaggtgtacttacgaaaaatagaatagaaaagataagagaatggagagggatctgaatgaggatagatttttttttaatggactgagtagacagtttttggaaaaataaatgtaaagaagtgcaagttaaaatgacaacatatcttttcaccttgcacattgaaaggatagttatataatgtatagtattgagcatggggggcaattcagaactctcgaatgttgctggtgagctgtaagtttgggggcagcatctttggagggcaatagagaaatatctcacagttttacttgtgggactatcatatcccaatacatgggttagtaaatttatatgtcaataaatagatttattcaatgaaatactatataactattaaaataataactgaaaaaagtaggaggtccacttatgtttatatgacatgatctgtaaaatattttaatgggagcatagtaaggtatgaaagaatgtgtactgtactagtttgtgtttagaatatactttgattgcatagaactatgttttagttttattaaagttatatgcatatattttaaaaagacaactctaaagtctttaaaaaaaaaaaaaaaaaccaccatccctctgttgtgcttctcagaggcaatcactttcaaatcttttggcagtttcttttggtatctaccttcatatttcaagataatatgtttatatcaacatttttgattggtcttatttttagcttgttaagtatttattgacttcctacaatggaaaagaaggatttgtctcccttactcaagtccccctccaagacacacagacatgtttcccctccactatcctttcagtatacagtataacctgagttaattattatgtcatcttcagttattatatttgcttccttatacatctttccctagagttgttaattttctcctttgcagtttgcttgtttgtctaccttttatttagttataattaacttctcccagactggtgaccagaactatatatttagttataattaacttctcccagactggtgaccagaactatacatgcatggttaatatatttaaatatgtaaggtaataggtaaggttttgttatgttagaaatgcctgctggagctttccatcctactgtcccatctagaatggttgtcctctaggcctggcccagaggtgttattctaggatctcccctctctctctgttcaagattgtatttaaccctctctatctcccaggtcatcctgtttcttatcttttattttttggaatagagcataaacctccatatttcctgagaaagttgcacagtaagtaaattttgagatctcgtgtgctgaaaacacctttattgtaccctcctactttggtaacggctcgtccagggatagaaatagagtatggtataccttttccctcagaattctgaaagcattgccccactgtcttccagcttccagtttgttcccaagaaatcagatgctatattctgatccattacctttttctcttctttctaggacttagtagaatcttccctttgcccctactattccaaaatttcaaattaatgtaccttgataaaagtcttttgcttgatgtttgtgctgagcactcaacagtcttttcaacctaaaaactcatggcattcatttctggaaaaaaaatgtaattatttatttgagaacttcttgccctcttgttttctctgctcagttttcctggtatttctattattcagataatgaatctcctatgagtatagcctgtaatatagcctgtaatctttcttttccactgttcatgtctttgtctttttattgtaccttttaaagatttccaattagtcttctatctgcattcttgaggggtttttttaatttcatcatattcttttttcttgagttttccttttttattttctcccattcttgtttcatctattatcttttattctctctgattatttcagtttctttaaagttttcttgtgctcccttcattgccttatttctttttttcccatttgtattttgggtttctcatattagaggtatttctcaaatatctggcaatcctttggtatacgttcatatttacaaagaaatttgaatctctgtgtggctgagatgagcttttgactgatggattttattatttgctgttgtagctggggcatttcatacgaggaatcttgactatcagtatgtataggtcttttctctttggctggccagatttcgcctgcctggcagtttaaaggttggctgctattttgttcaaagttgagtgtgagaaagaaatcttgaagcccctttcttcagtatgttaccccaaacttcaatcctctcttctccttgtgcatataacacctctctggtggccaggcacgatcgctcacacctgtaatcccagtactttgggatgctgaggcgggtggatcacgagtcaggagttcaagaccagcctgaccgagatggtgaaaccccatctctactgaaaatacaaaaattagccaggtatggtggtgcacgcctgtagtcccagctactcgggaggctgaggcaggagaatcacttgaacctgggaggtggaggttgcagtaagctgagattttgccactgcacttagcctgggtaacagagcaagactccatctcaaaaggaaaaaaaaaaaaaaaaaacctctctctgatttgaccactgaagggttttctgctgatgtgtttggaaggggagatccagggggatgagtttcaggcagggaggagcctgtaatgtaaattcttcctaaacagtttcaatcattccttcttatagtacaaccttgagaggtacctgaatccttcacttaagcctttgaggaactctgtggggtgagtctgccactttcaaggtgtctccgtattgcaggcatttaagttctctatggtctatgagtttattaccatatgtttctgagatttaaaaattttgtctctgtactctcttccagttttcctgtccttgagaaagaaacctatactgaaaaaaaaattcctttcctgtcattatggtatagtttcaagagggagtgaggaaaaatcggcatccaaaacaacatatttaactccatagttacacatagttctaatatatctggaagtacccacaaggaacttaaggatggttatctttgaagatgggggcgtggttatatttaatgagctgttattgaactattagagtattgttagcatgggtatgtttactttttaagaaaagcacatttttaacacttaggatctcagtctggtaaaagtgggaataaatcatgaaggctatgtattcggtgaatttattcaccaaatctagagttagactacttcttgaagtgggaagagatggtttgaagaaaaaataaaagtattacggtgattgtaaatttgtggaactaccacacagtttaggtttggatggtaggactgcagaaggaaagaattgagaaaggaacatcagggggaatcagttactcggttcaaaaaggtaaagatggcagctacactctctgacacagtatattctggtcacatttaccatcagagacaaatgaacttgattattaatctaattcagtatggcatttcctatatgtgtattatttaggaatgaagcaagtagcttaaaggtaagcacattagtctgctagcagattttaaactgaggtaaaataagagtttaggacagaataaaagacagtaaagatattttgagtgtatgctatatcatgcttttgcaagctctaggtgctataagagttaaatatttaagctgaaaaatctatgaaaagcaccctgaaaatctatacttttttatgccattgctctttggtgctaagagtttctcaagtaagtgagtatcttatgtaccatttgtgctgtaatatttaattacagtgagtgtacagaagattagctgtcacaaagaatcttttgaaatcagattgcacatcaaaactacattgtgccctgctaagtaggcaaatttaagaaagaggagaaagtgatgtcaagacgtattgcaaaatgaacaaataaagcaataggatttgcttgttgttcagcctattaaagcacagccaaatgtcagccttcatttgtcaacttaaatatgttttttctaaaatttataaagattcagtctatggaaagtatcctttactatttggactgagaagtaaattaagcaaaaggaaatactaaatagattatgctactaattcagtttctcatagtgataaattgccacataaagatgtatgttagtaattcagatagagatatttattgccttttatttttgttatttgactgattagcaaattaacatatgtgtttttgctcccagatatgtgaggttttaaaagcttaggttaatttctgctccacaatagctaaaccccaaatacaatgtacactgaaccatttctagtgtcctgtgatttcttcccttcaaaaacaaaaaacaaaaaaggggtaaaaataattttttaaaaaatctaagtgctgagccccaagtagccaggagtggaaactatcagtttagagcctgaattggacttgctagaaatcaccaggaaccagaccacataaggggaggctcctcagctagagcaacagagttcacagatggttggaactggaatggttgggagcctgcgggctttatggagaggagagattgccctgaagccagagttctctactgacagtgtgtgagcataatcagctttgaaacagcagtgagggagaggacctgaatgggccctcctcttctgagttaaaacttttaagggaatcccaaaagttcctgagatcagtgtacacacacacacacacacacacacacacacacacacacaccagaatgaagcagaagaaactatcccaaaagagtcttacatgataatcaagcataaactttaaaagaattcaaccaaatccagataaaggtagccactatgagtgaaaatcaaaggcaacaatacatttagactgcagaaaatgcatatgttggaactgaatacaaaatacagaatacaggctatatgtgaaattaactttgaaatttcaaaaattgttacacaaaatgagaaaactgtagggattaaacagatacacttatgagatagaatttctagaaataagcatttgctgaaatcaaaacctccattggagagccatgactattagacttatccttctaccataaacaactacgacattgcacaacaaataattcagggccttgatccttgaaagaagggaaaactatgtggtggaactctgcattcagtggctttcttcctggaagggctttccaaactacagcagaagtaagtggagcccagacaaaaaagagttgcatgggatggcagaaatgggaccagagttaagaatagctcaagtagctggctgaaatttatgggacagagtaccagggaaggggagctgtgcagaaaagaagcaccaaaaatctgcataggggtactgttaagtctgactgaatactaagctgtacgtaagcaaggcaagacttcatggggcacggcagaaaacagtcactggaggtcccatagtgctgggagccatcagtgttcaaatcagccagtgtgtgaaggtctcactgaacaacccaagcattaagtaaaggtcacaggttaggggtaaggctactgtacctctaaagtaaagacaactcttgacctatcctaaaattaaaccttgacaggaccaagctatcctatcagtaccgcagctacctgccagaacaaaactcaatacctgcacaggaagacagcaaattcctactgtcaacagtgtagtatccataacatccactataaagtaagccaatattaggctaagcaggaaaatgtgacccttaaaaaggggagaaagtcattcatagaaaaaggcccagaggtgacccacatatttgaattagcagataaaaactttaagaactattataaacatgttcaagggtttaagtaaaaataatagcataataggtaaagagatggtaattacagacagaacaatgaaaactataaaaaccaaatgaaaattttagaattgaaaaatacaatacttgaaataaaaattcattctgtgaacctaatagaagattggagacagaagaaatgatcagtaaacttaaaggcagggaaatacaagctatccaaactgatgcacaaaagaaaaaactattgaggaaaagaaaagaatagcacctcagtgaactatggaaccacacaaaacagactactgtaagtgtaattggagatcaagaagaggggaagagggtgggagagtaaaagaaaaattgaaaaagtactaaccaaaattcttcccaaatttgaagaaatgtgtaagagtttcaagaagtttaaccccaaacaaacccacatctgttcatatcctaattaaatggctagaaagcaaaaacaaaaattttttttcagagacaaaagatatatacaagggtaatgataagaatcagtgctgacttatcagtaataatggagaacagaagataattgtataacatctttaaatggtggaaagaaaaaagtgttaaactggaatagtatattcagtaaaatagtcttttaaaataatggttatataaagacaccttccgataaatactgtcggagagaatgtaaccagcagacctgcacactggaagagttaaaagaacttctttaggcaattggggaatgaaactagccaaaaattttgatacatacaaaataaagttcaccacgtaaatgataaatgtttagtaaaatatacaatgttttcccttaagtgtataaaaaggcaattgagactaggcgcggtggctcacacctgtaatcccagcactttgggggactgaggcggtgggtcgcctgagggtaggaattcaaaaccatcctgggcaacatggtaaaaccccatctctacaaaaatacaaaaattagccgggcgtggtggcgcatgcctgtaatcccagctactcaggaggccaaggcagaagaatcacttgactgaggtggaggttgcagtgagccgagatcgcaccattgcactgcagcctgggagcaagactctgtctcaaaaaaaaaaagagaaaaagaaaaaggcaattgactctttaaaatgaaaataatgcattgctgcgtttatcattaaattatttggtaatatcgcaaaggacagaaaggggtaaatagaagtatactgttgtaagattgtattgtaggtgcaatggcatagtattaattcagttaatatagattgcgacccatagaaccgtaagtgagttaaaatgcagtaattttttttaaatggctaacccataacgcaggaaaggaggaaacaaaaaaatgggtacaacaaatagaataaaatagcaaagtgattacataaattcaaccaaattagtaattaatgttaaatgtaagttcactaaacattccaactaaaactcagatgttaatcagtttttaatgaagattatctgctgccttgaaaatatgtattttatatataaagacatggatagagtacatgtaaaatgatagagaaaaaagatcctatgtaaacagtaataagaaactggagtggctgtattaacatcagacaaaatgatgccaagacaaggagtattaccagatgtagtagttggggtccagttaggagacaaaaaccaccatttaaacaaggaaattttaatgtaagaaatgattagaataatggcaaattgactagtgaaagttaagataattttaacaaataaaagactagcaggtatcaggagcaaccgttatggctaagactgagatagagctcccaatatagagctttccccctactagggctgaaatccagatgtctttggaaagggcacacctttgattcactggatagtggagaagtcactaaggtgcctcgtaagtgggagcataagtgggagttgctagaagtttctggggtgccaggggggccatccacagaaaagtggagtcttaaatcatcagagtgaactccctgagtgtcagagggagctggtggtggctgggcactgctggaaccgaaatctggagaagcagccctctaggagcccagcatgcctgcaggacggccctgggattctaggactgaaaagatgtggggagcagtgacttggtttggtgtgcaggcccataccatctgggaaatcccggataatctccagctgaacacttgagaaaattgcagcctgcagcatgggagaaaccacacagggaataagcatgcaggggagggtggagtgtgccctacaacagcctagagagtgaatcataccagaaccaggaaaggaaaatcccttcctcctccagcgtcctccagaaccctctactgacaaggtttaacactcggctagctagcaaaggagaaatatttccaaaatccatcttcatttattacaaagtaggccaaaatatggtgaatttggagctaagaggaaatacatcaataaacagcatagtctgcccctttgagtactcactgtccatatataccttctacgcacacttgaatgccatacaataataactctacatttcacctaacaggatactcatcatctccaaaatgaggagatgcaacaatcattgcatacagtgctgtggctatattaattgccctttagaatcatcacagttccactggatagtctgttgcccaaagactaattgtgaatttaacctctagcaacttgcatataaaatttttgttaatagaagggagcaagaagaggaaaatgtgagcatatatacataagtacatacacatgaaaagcaaaaaaggaaatattcaaaatgactacagcccttttttctgcagttggtcacaaggccctaatttttacttatggcttccttcttctactgttcattgatttcgcccacctccagccagaacctggtagagtaattcaaactctcattcctgaaagttccaagtcctcaattatcctgccttttattttggtttctgtacttttctactacacttttctattgcatatggagtactaatatacaccccaaactgtctcctgggttacagacatagtcttccttgcccctaatgtataaaggcaacccagtttcctcttggcaatagggatcagtcactccacctagtagagcaatccacctttctgcctgttgattcagtagcatgaggagtccag

SEQ ID NO: 267 - DNA, 293520 bp, Homo sapiens
aaagtgacaaagcatggcctttaagagatcagaagtaaaagatattttagcacagtggattgtcagtctgcattagcaggtggtggaagagctttcggcagacatgcccctataacttcagttagtggcagcaccattggcacaggtacacccccaggcagctggccctggtaacaaggtggcagcaaggggaattcacatttagaggcaatgaaggcagctgtcgccaccatcataaacttctcctcctcctccttactcttcctcataattctcctttctccctcttctcccctcctcctctcccttcttcatcctcctcatccttcttcatctagctgtgatattttttgtcctggatttaggttgtactggtgaggatagagacagcaaatcaataataatattttaaataaatttttaagcacatatacaacaaacgctgcatttgatacctacactgtctcatttcatcattatttaatctcccttaaggtaggtatagtaactctgcaatggagttgagagaaatgaggcataggagggagaatgacttgcttaaggtctcacaattcataagtgatggcaggaggatttgaacttcttggaggttcagatttgaacctggagtctctttgactccaggacacttgttctaaagtcactcagattcaaaaggtagaatcagatggcttagtgattggatgtgtcagggacaggggactgtgaggaggagaaggggtctaaaatacttcctagttttctgatttgggtggcctgttgaaatgttaatggtgctttacccagggtagggacactctgactcctagaaatagttccagcctctaattagtgtcgagatcattttttaggttaaaaatgagctttgggctagagttacaggaattcttatttcaatctttcacttggttttgcctgtaatagactggctaaactgtaagaggcctcctattaattttaaactgtcttgaactcaaaatagtcaaagtattaagctaatgaaagagcagtgttcttgttgttgagtaatccacttatttattctatagcttcctctcccatgctctttgttccctttgatcataattttaatgggttttggaaaaaatagaaacccatgcactacattggctatatttaacaggagtacctataaaatatcattttgtctaatgtactgtaaataattttttccagatgcttgaatgtttttggagtgtatacctttataaattatacatttttatataacacctgtatctgtttttcctttaattgcttctcaatcttgtgtcacgtttagaaaagcctcctcattttaagatatacaaatattcactctcattgtcttttagaaagcgatagatttatttcataaatgaattatctgataaatttttaaatggtgtaatttttttctaccattgattagaaatgctatgtatattaaaataaattcatatagataagtacatatatttatatataagatatacatatgcatatgactcatatatatgagtcagtgtctccctcagtagaatgtttgatttaacaccccagaacatattttaataccttgttttaatatcttttctcatactcctatagtttttctttctttcaacttttatcctttttatatacacagtaaaacaaaaaatttatttttgttttatatgagaccatatagaatttatatatgaatttagaattaccatatctaaaacattgagcctttctacccaagaacatgctatgcaattgaaagcatttaataatctttcataaatcattcattataattttaagattttcttttgttatgcatttataacagtttattccttggtgttttatcttttgggttactattgtaaataaaatattagtcttcattttattttctaaacgacatttatttcttattggaaatctatacatttcttacaaagatttgtcagtagaccacaaaataaaattattttatttctaataagttttttaaatcaattcttttattttactatattcataatcatatctataaaccacaataattgtgtttcttcctatccaatttatacttcctcattttttgacttgtttatatacttaaatactttcaggagcctaaattaatagcaggcattattgattgtaatgcaaaatgctttattacgtcaacataaagctaaataaaaactactttttatctggtttaacactttctatcctaaattccaccttgatatatcaagtctgtagttccagccttgttctcaattaagatctctccagtaagtttttcggttgtgtgtttttgatccttctaagtcaaagtgttataatgaacctcttaacctagaattgctcttactttgatttttgaggtaatttaatagatgttaataaccaatatgtcttttatgtgtttataatatttttgttttctattttgaaatgtgaattgtgttttatttatttattttgtggtttgtgatgttatttatttcttataattttgaaatatttgtctgcttttgatcctctattatacttttaaaggtgtataatctacttagctttgtacttcctgaaatggatacactaaaatcaatgagaccaatattttctattaatagtgcatttttggtttttgtagcacacactttacttcatacaatggaattcataatgtatcctacctacacacctaatattaaaaattaaccaagataattccctaactctaatataaaaagtataagagaccactaatttacaagaccactatttctatacaaaaaatactaaggaatgactgaactagaagatacattgaagtggttagctctttgcactcatacacagaattaccatgggtttggtagccataaataaagactgataatagtcatttcctattagacactcaagtaggatgatgtatttttttcaatatagttaaaaaattctaagaaatttctgaatgaaaaatatttattgacttaacataaaaaatttattcctgatatagtcaatgattattaaaattgtgtaaaaatatttcatgccaatatgtgacatgaaattcagatctaggcttagatattcatatataggttttatacacacattaacatatgctgtgacttttagaaattgtgcaatctgtgaaaaacgtttgctttgcctgaactgttctgtgcattgaaagatttataacattcatcattcactacccatatcctaaaattaaactgttccagtcaattattctgaatattgacaatgactctagaagttcccaagatgcctctagaagacaaaatactctccctgaaaattactgagctgaaataaatttctccaatttacaaaagcactcatcacttttcacccaaccatgtactagtacgtctagcattttgtcataataattaataaattcaaataaattgtaatatatatgtgtacattgatattgagtactaagagaaatggctatcagattgaaagcttttcagtgagtacatcaattttgctaaaatatcaattttgatgaaaattatagtaacctataaatgttactgatatcttgaaaatatgtaaatctaaagaaattttctttgagaaatcaaattggactaaaataatttatgaatgtattgctaactgtattaaatatataaattttaaaatataaatgggaaacaagtgaataatatgatagaaagtaaaaagcagaagcctactaggtaaaattctataagttaaaaatatgatctgatgtgaaaatattataattattagttttttatcatttatgtttttaatgaaaaaaattctaggaatagaaaaactaaaattattcctttacacattatcctgaatcctaaagttatgacccaaataccatataaactgtggatgctcaattactgttgcattaatatggtcaacaaatgcattttaaacttgagcaagctatgcttaagacaaaggtcaccttttaaagattctgcataaaaggctgcatgaaactccaagtcttagaaaataatttgaaaagcaatgctaaaaggttatacctataaaaacgatttaaatataaatttaaataaaaatctggcttaggtagtataaaactatataacatgcacaagtcattttattgtttgagatatgaaattgaagtatgaaaagtcataaaacctgaagctataatacggtcaaactttaattttaaatatataacgtatgtatttgggaaaaatatatgagagataattgtgtatagatgagttaaatttcaacccatatgaaacttgaaactttattattcaaaaatgcttcatttaatgaagtttgttataataattttggtatgtgtatgggtaatacaatgatatgtactctagaattgcttaaatgaatgatttctatatcattttactataaggatttaagaaccaagattatttggttttctagagcataataaagagagaaaatatatcagtgtatgtaagtgccttagacaaaaagatttagacacttgatctagtggtttcaagactggccccaacccaaaaatacattcaatatgacactttcatatgcagttcgatatcttttttgctttaaaggtaaaaatatacccacataaaacttttacttgaaggcagaaaagtttgcatagtatagccaaaataaataaataaacctaaaaccaactattcaacttgttaataaaatcacggacatcacggcagaaattacaatagtcttagaataaataattattagacttttgggatcagaaataatttaagaaaatcctggtcaaattatactatacttttgtgccatattcacataaagctctatttttacaagcctcctgactctacagaaatagtttttgaaacttcacctgattttcttatggacttttagattctacactttgaaacagaactcttacttataactgaaaattatgttttggatatatttaacattacacagaaaatgtgaatctcctaaaatagcctgtaaaggaaacaggttaaatttaaaacttccagaaagaaagccagaagacacactgctataatcaagcaacttgtatgttcagaaagtgaaaaaaataattactttagtactttaaaaatgtgttcactttctaaatgaaacagaagaaccatgagatgtgttctgaagagtgtataatcttacctatgtatagtacattacctggggacaggtatcatgtctcattgtcataacattttgaaaaatatcttccagttagaggagattcaataaataataaatgtatgaatgaatatatttcattctgttatgatatttctggtagcaagtagggattggtgacttagacataaatttgaggcttcaaaaacaggtgggagtcatgaacacttcacagtctgggcatggtattaagaaattaacatcccagacttagcaaatctttcctggtcttaagtaacaatatggctggtatgatttagtctttggctcattaaacattttataaacccccagaaaaattttttgaagatttcagggcaaaaaaatgtggtaatatgcagacctgtttgcaatacatcatttatataatgaattttaatctgcacccatttaaaatacactttaaaagaaaatgtttatacgctattcattaactttgtgtccgttaacatcatcaacattattagtgtctatcattataatactatcattattttgccttataaattgagtttaattgaaaaatttctccatcccgaaatcacaaagatatttttctacatttctttcatttatatcgtcattttaccttaaacttttagatccctatacacatttagagtctacttctatataaggtataaggttgtaatccagtttcatttaaggtcttattatgagccatttcctcaataccatttactaaagaaccctgtatgttcaaatgagattatagccaaatttctcatatattgagttcccgtatatactcgggttgttgtcagagctctctgttgacccattattattttttttcctttaaaggcacccatatgtgttatgtagtctgtcatgtcatatggttcatcagatcccaccccattagtcttccttttcaaagatgacttcataatttagaaaatattattcataaatatatataacatgataattagtttctaaaataacttgcaatatttttactattgcattaaatgtgtgaattaatttgggaagaattaatattttagctaatttaaggcctaatatttaactccatgcattatatttccatttattcagtgtatatataattttctctttttcattgagcttagtggtatatagagggtctttttaatggagaattagagcatcttttttttaattctaaacattttgcatatcttttgacattataacaggtggtatcacacatataatttctagatattgcaactgatatagagaaacttaattttatataaaatacttgtatctgcaacatttgttgggctccattgttagtattaattatgagacaatatcaagaactcattaaagtgttgataaattacaaaaattttgtaatttatccaagattctctggatatcaaaaaataatggcaaacaaaagagaatcacaaaatcagaaaaaaggaaataacatcacaaaacgaaggataattttcttagtaaataaaaaagcttctgaaaatcattgtttcattaaacaagtatttgttgagcactattctatgtgtcttttgtggcttactacttttccttatcaaaatgttttcaatgtttattcgtattgaagcacatatcagtaattcatctttgtctattgctgaataacatttcattgtatggatataacaaattttatatatccattcatcagttgatggtcatttgggttgtttcaactttttgactctttcgaacaaaactgtaaacattcacatataaatttttgtaaagaacatatattttcaattttttgagtatatactagaagtagaattgctgggtgtaaagtgttatctcattgttttgatttaaaattccagtctttcagcctttcaccgtaaagtataatgttagttatgtttcttcattcttcttatttttttttaacttctcttatcagattgtggaagttcccttttattctttatttgttgagtgtttgtttcataaagtgttgtgagattctgtaatacaatttttttctccatctacattatcatgcattttcttctttatttattctattgatacattaaattacattaattgattttaagccactaaatcaaacttatattcttacgataaatcccacctggtcatgctgtataaacctttctatatgttgctgaatttggtgtggtatcaccgtgttgaggattcttctgtgaattaatttgggaagaattaatattttagctaacttaaggcctaatatttaagtctatgcattatatttccatttattcagagtatatacaattttctcattttcattgatcttagtggtatacagagggtttatagtgctatatagagggattgaaaacatagatttgcctatagttttcttgtgatttgtctggttgtgctattgttgtaatattggcctcataaaatgagttgggaaatgttctcttctcttctatttttggaggaggtggtgaataactactcttaattttgctttaaatatctgttacaatgtctcagtgaagtcatctagccatgaacatttcatagtgttaatttttgttagtttgtttaattactgattcaatctttttacttgttataggttagatttcctacttcttcttgaatcaatttcagtagttggtatttttctattttatcgaagttaactaatttttttaatttacagttgttcatagcatttctttataattatttttctttctgtaatttcagtaatattttatatcttattcctgattttagtatatttgttaatgtttaaaacaaatgaaattttgttttttgatattctttattgtttatctatattttattttattaattttactctacattttatgatttccttctttctacttattttatttaggtttagtttcctctcttatccattgtgttgtggaagtttaggctattgaggtatttacagctataaattttattcgcagcactgcatcacccacatcccatgagttttggtatccattttcaataatctcaaagtcttttctaatttctcttgcaatttcactttgattcattgtttaataaagattgtattatttaacttccatgtaattgtaaatttatcaagttacttattgattttgatgtttaatctcattcaattttggtcagataatgtcctttttattatttcaattttttgaaatatattacagcttgctttatagcatagcgtaggatatgatctatcttggagagtgtgccatgtacatttaagaaggttattctgctgttgttgggtaatgtgttttatagctatctactatttctagatgatttatagtgttgtttgaatctcctatatcttagttgatttatagccaagtgttatatctgctattgaaagtagaatattagagcctctaattgttattgttgaattggctatttctcccttaaattattttttagcttcattattttgaggctctgttgttagttgtgtatatacatatatatatacacacacatatatgtttgtaatcactaccttttctgatagtttgattcttttataattataaaatatctttctttttctctactaactgtttcattttttctcttaaaatctattttttccctgatgttagtataggcactccagttttcttcttgatgcagtttgaatgatatttttttattgctttactttcagcttatttgtatctttgaatctaaagtgtcttccgtaaaccatatatatatatatacacacacgtatacataaagtgtatcttctatagatcatatatagttgactaaatcagaaaacagccagtctaaacgtctctaaattttgactgaatttctgaaatcactttatttaaatatttttgatatatttgaatttatgcctgccattttactttttgttttccacatgtcttatatctcttttgtacctgtatttttttcattgtaattattctaatactagtttcttttatactaagtaaatctctagggcaatattttattttattgtatttattttctcatgatagggtctcactctgttgcccaggctggagtgcagtggcacaatcatagctcattgaagcttctaactcctgggctcaagtgatacttcttcctcagcctcccaagtagctagggctaggagtacaggtgtgcacaaccacacctggctgatttttttaagttttttgtagagacaaattatcactatgttgcccaggctggtctcaaactcttggcctcaagctattctcttgccctggcctcccaaaacactgagattacaggcttaagtcactgtgccagaccctgagggcaacattttaattttgttaatgctaattttactaaagcatatgagtttttgtttgttttgttgttgttttttgtagttgctttggagctaatcgtacacatcttaacttagcagaatttaccacagatttatgctaacttaattctacaatgacatagagaagttatttctatacagatatattccttcttccctccttttattgtgctagaattgttatacataacatgtattatgtaacataatatataataactatatatgtatatgtaagtgtttgttatggaaattccaatcattttaatcaacaaaaacattgttaccatgaaacagttcgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttgagagggcaaaattcagtctgtagaaccttgtctccagggagataatttgcattgccaggagacaaaaaagggaaggagacgtttctcactctactcttttgtaatttccatcttttaaatgtgaatgtgaaatttactcagaaaggtaagttacataaaatttaaataatagggttattgtatctacatggtcatgtaaatattaagtatctccattaccatggcattttactaaataatatatcagaatataattaattcaataattttgttttacagacctaagacacatgcatcagtactttgttaggttttgaaaaatgtcacagaaaaatatctgtatcctcaggaaggaacagcccattaaaatattattcaaaatcaacaagtatattccaagattaattcagcaaaagtggagtgtatttagtaaaattgcaaatgttctatttggagaaaagattgctttgaaataaaagttaattcaactcagagagaaaacaactataaatattaaggatacgatcaataaagttactaaaaatatggctgtgcttattcaagatttagaatccaaacagaactcattgggtctagtaactactagcctgaaattaggaagatttgtagacaacaaattacaaaagtaattgagagactaagaagatttaggacaataaatgtaagaattctcttttaattgaaaacctaattttgtagaatgcttaaaatataactaatcagtcatagataaaatagcatttgtaagtactctacacattgcattctttgaagcaattattaatgattaatactttactctgtgctgttatttgaatgtcatagatctgtataaaaattaaaatgaaatgagacagagtccattcaaaatggcataatgcataattggatacaattttaaccttgattccattgttctatataaagctactatttcaatttaatatagctaatgttctaaccagaaatttataatgttaaatacttcatcctaaaacttcaagtgtcatgtctcccccagacagggatattaaaggccattttttatctcaaggtaagcctgaaatatagataatatattaatattccagtatttcaaattgtaagcattaaaatgtcatctaatgaattttgtggttaaatataatttgacatattttaatctattcaattgcaatgagtaattttggcactttgtttcaacttttaaaaaagtgaatttctcataatggatctcttaaggaattatctattaacataattagaaattaatacatgttattaatggcttaatcaaagaaactgtaaattgatgtgggacttctttgcaactttgctgtgggtctaatcagtaatatttcatgtactcgtcttcacccaccccatcctttattaaatatagaggggaaaaaagtggctcatgtagactaggactggttcaagaattttacaaatatatgatttataaagtgatatggaggagagacatgaaagaaaaactgacttattgtacagcaaacgttttaaaagccacttaacaaaaattaatgctatatttgctctatttctatacaatcagaaactattaataaatatatatctttcatctataatggccagaattattcttagtaggcctcaggaatggtcaaagtaaaatttttgccagggaaacacaataattgccaatgttcaatacttggtgtgccagtcaatgagggaaacaaaaatgttgctttacaacaatccctcctaatgtttaatgttactgttaattgctttatgtaaactctatgatcttagttccttagtgatgctcttattaaccaaaatccttgtaatacttaaataagtacctatattcacctaaccaaaaatgtgtatatacatcatgcttttattagtcccattagtaaataatgaaaatcatttataaaaatgacaaataaatatctgtaaaaataaaaaaattagtagcaaggtaaatccattatatctctattatgtatacatccaagtctttagtgcactgtgattcctattggtgatttttttcaaaatgattttaaaatctaaaagcttggctgggcatggtggctcacacctgtcatcccagcactttgggaggctgaggccagcagatcatgaggtgaggagtttgagaccagcctggatagcatggtgaaaacctgtttctactaaaaatatatatatatataaattagccaagtatggtggtgcacacctgtaatcccagctactcgggaggctgaggcaggacaatcgcttgaacccaggaggcggaggttgcaatgaactgagatggcgccactgcactccagcctggtcgacagagtgagactccatctcaacaaataaataaataaataaataaataaataaataaaagctttctgagaacatttgatcttttaccagtgttttgttggaaaagcaggtgtgaagttatttcatttatagggaatactttatattacttcatgaatttctggagttatgtattaagacatcacccacagtcaggaccaggaaacttaataaatagaaattcagttttaagattgtctaacgaatttataaatttccccttagtcctgtttatagaggcttaggcagactagttttcaaagaacaaaggctagctctcatgtcaactgtattcatttctgcatgtcattctgaaccaaagaaatggatgaaactcatctgtacttttgactgagggaattacatgatattttgctatcattggaaaacaaataaaatgatctttctttactttcaacaaacccatacactcccccatcactatccacacaccatcatgattctacagaaataaataaactcatttagcctatcccaacagagggatttcacaaatttagaataccataaccaagtagtttggaatactcctgtacaaacatgacagattacatgtgtaataagtgacaaagaaatacacctaagaaatgttataattatccctattttatggacattttttgttttgttttttgaaagatgtaaccacattaaaatgtttatgcctagtatcttacttgcaaactctaggaatgactttataacaatagtagctaacactcatgttactaatatactgatagtggtatactactatttcatttcatcacagtaatggcaagcggattgtaatattgatccctataatgcaattttaaaagttatttttaaatttaatttaagttacataagtgacaaaaaaagaaatttgaattccatgtctataactcaaaggtactgttctaattgttagataatactgctgtaaaatctttttaattcccttctgctctggaataaaatctaggttataatactccagattttaaatgagggctcaagtatacttattttaatattgttttctcttaaactaatttgccgtaagaagaattttatagagaatattaaatataaaaatgcagaggatagtttaatggtatatttatgtcacattttcagtaagacaattactatgcttttcgttaagtaagaattactttatataagtggtagaagttttcttgtagtgttttatacaccttaaggatgccaaaagtaaaacaaaatggcaagtccgagccggtattccactacaaataatattttaattctatgactctcatttcatttggatagctttgaactccatctggtcactgacaggagggaaaaaaagtttgagtttccattttcattaatatcttcactttttaaagtggaaaatggaaagcttcaactgctaacaaatcagcaactaatacattcataaatgaacctgctcctataatggtctaaagtggctctctgtttaagaaagcaattgatgcaattggaccttcctattattttctttaaataatgaagttatttgtttttaaaatacaagtgcatttatattcacagtttacatgagtggacaatattatatttggttttatgttttacacaaaatagggatattgacagaatgttaatatgttcatattaacatactacctaacatatcttatgaacatattacttaatgtatcttatgacctaacatatcttatgaacatattacttaaaataaaaaaaaaaaatttcagactacagaaaattaaagcagaaacttttgttgactggatgaattctaagggtgaataggaaatatatttcagccagctatgacaaatagagaaaaacacaactgaaaaagaaccccagccatctatctttgatactatgtctctagttagctacattaatttaataactcatggactatttctgcatcatagtcttattacctggaaaataggtaggttgtattagatcaacagttctttgctggatgattttgcatccccatgggacatttggcaacagttgaagacattgtttatatcacaacagtgggaagggcgttagggctggcaatactggcatctactaggtaaaatggaacaggagaactccacacaacagaaaattatccaatccaaaagagtaatgtcaacattaggagaccctagaacaggcggtatttatggtttctatatctgggatttcaggatgagttttttagagttaattggggaacatgaggtagagtaaggggctgagatgcctttttaccaattaggtttttttcaaacaaaaatttgaagaattagtaacttttagttccaactgaattatccagaatgttctataaaataccttcaaacgaatcatttttctttgaaaatactacgctaaggctaatctttcacttttcaatgtggaggtccccatccaaagtttatggcatttatttatccagtcttacaataacatcttacgttgctatataattataatatgaatattatggatgatatacatatctttataatccatttaaatcacttctaaagcatgaataatatatatgtcttttacacatgcatgtatacacacaaatacaatttacttataaacctattaagaagttagcactatgggaatattatatatattatatatatatataacatttttcatctctctgtctccaaactttgtgattttataatttcaataaaagtacaattttgttcaaactgtatttgtatcttatgtttctgttcatgcttctgcaggatattttacaagataaaagtgtggtccattgttatttgctttactaaagttctaaattttaaatactactaagaccaccaggaaaatactttctaatttattagaaaatacttacaataaagcattaattcgataattcaagaatgccaatataaatacatgaaatggaacacagttaaaaataaatgtatgaacagtcacataaaccatttcatgtcatcattttctgtatttaccaaagttatagctctttcgaatgattattgctaatgtattcatctctgacaaagcacaattatttatttaaatgaatgaacaaaagaaataaacagactggctcattttcatgggtgactgactgaaggaatttaagacttgcttcaataatcctcaattcatgaatctagatggtataaacacatattgataattttaaaactaaaataatcaaaaatgtacattaaaatatttttaaaataaactgaattattattcatgtaaagaatttgaagtgatataaaaatgttaaataaataatacaatgcaattcagtatattatttcaataacagtttttagtgtactctttgaagcagaaatattataacattctttgtcataatgagaagacaattttaaacatcttttccaaatattaaggttgtctggcatatgagactacatttatgtgactgtatgttgtatttcaatgatgaatgagttttacctagaaaagattaatagaagattttaataaaagtaaactatatgagagtcttacagttattgttgtaagagctaaaataaaagcttcacttatagaaaaaaatactaaaaggtttagtaactactcaatatgaatttgcctgttactaaaatattttattattaggttgttgcaaaagtaattgtggcttttaccattacttttaaaggcaaaaagagcaattacttgtgcacctagctattcatagaaggaggaaaatcaatatttaatttaacattccatgttatgtggccactcacttatttggtggtttcaggctccattttggggaattctacagtttctttatggtttcaggaatgtctgcattaggagaggttgggagagagggtatcttgttggatgtaatttcttcattttactttaatcaaaatagtttctcttgtaactatacacatagagaatttcagaagaggcttttaactgaacagaaggatttatagaacaacaacaaaggtagataatttcaaattaatatggtaatatgcactgctcttacactgatctcttggtcaagtaatttaaaacaagaattaaaaactaaaattgaaatttaggtaattaaattctatgaataattttataaccaaaaggggcaactattgagatgctggagattaagggtatcctatcttaaggaatgtagccattgtggaattaggacagcacttttaaatgtagaacatacctgcatttgtttcttgtcaagttcaccattagagacaaaactgattgtcagaactgtggaacatttgagtagcaacatactttttatactgacaattaggttgaaacaaccgaagaatgaaacgcataaagaagtgtgttcatgcccaccacagaataagaattgcacttaaaaagttaaggaaatataattttgataggaaaatatttgttattagagagaataaagaaattttgtaaagtaaaaaataaacccattgacatattgagtagtagtgtgtacattccctgtccaattctattacaagcaagtctaaatctagagccactaaaatttctatgatagacagtttatctttaactagatgtattttttctgttcaactaaaatgccttagtaatttcagtacgattttttttcttagatgtcaaacatcttttaaaattcaagttatggatcacttaactctaaatacatgcttttattttatttccaaagcttagaagacaaagattattaaaatctgagtgttcaaatataaaatatcttgaagtatatgcattaaatgttccatattttaggctaccattgagaagatgtttctctaagcaacatttgataagactaatcatgaaactaaacagccagctgtttagattatagtacaatccttgctgccatgtataacactattatcatcattggttttataatcctttggctcaacttactacttactggagatagccgaagagaactaacaaagcttttaatgtgatggtgttaaaaggtgatatggttcagttgtgtccccacccaaatctcatcttaaattgtagttcccataatccccaggtatcgtgagagggaccccatgggaggtaattgaatcgtgggggccatgtccccagtgctattctcatgatagtgagaaagttctcatgagatctgatggtttttgtaaggggcttcccccttcccttagctctctccttcctgccgccatgtgaagaaagaggtgattgcttccccttctgccgtgactgcaaatttcctggggcctcttcagccctgcagatctgtgagtcaattaaactgccttcctttataaatactcagtctcaggtatgtcttcattggcagtgtgagaatggacttacacgaaaggcgaacataaatccctttctattgggacaacagtatttggagttaagagttaaaaagaaaacataaaaggatgaactgtaaaccttcattcaaaaataaaacagcatattatattacactttcatatgcaataatatttttaaaagttcaatgtaagtataaatttgtgtgagatataaccaacttattatagttgtagtttcataaattaaaagatgtggatgaagttccaagatttgaaattactacgcttttattatcaaagttaaagatggcagagtaataataattatcttaagtttgaacaataaatcattcagagggtggtgcccagctggttgtttacttttccccttagagaagattgaggaaatagtattaagatttactattagaaagatgtttagaagaataattttgtgacagtgattaaattctaaaatccttgatccaaaagggaattgagagtatgaaattagataatgaaatttcctgctgtgtatcacatgccatcactgaataaattctcttgccacatatttttgtattgtgtttcttttcctctgtgtcataaacctctatccacctcatttaacatttttactgatttttttctcccataaatcatattcttattgtgccaaatactattaatataaaatctaacaggctaacataaagaaagagatgtcactttatccttagaggtatctccagatgtgggcctgtcatgtggcggggggagtatctgctgagcctcttaagactgtggagatggcagaagcagttttatgcctctgaggtctcagcaaattggcatcagtcacacttacctgtctgtttccttcactgatctcttttaaactatttctaaaccttccccctgtccatatcgtgcctctgtattcgaaatataatattattagacacagaattttacttaaaaatacctactcacaggaaaataatgagactttctcaaagaaagatcattcctatatttttggcaaagggatgggctcctctgggaagcctttcagagagctacattgacacatttgtataaaaataaatgaaacagtattcatcataactacgtgtctcttgcaggattctataactcctaaactaacattctgcagatggcatgccaatgtgttcaagagggatcatatataatttggatagttttgatatattaataggatatatacatcaggctttctttttaaaaagtgaaatatatatgatcttagaggcaaatcaatgacttttatatttttgaaacccctaaattaactttttaagccaaatgaggctattatataatagtcatcattctttaaaagtttctacttccatttcttcccctcctgataagtttattttctcctgtatcacaccactcaaatttctagtaacctcttaacttccaaaaggaataatggtgtgttcctcatgccctgtgacttcctaccaggatttgcttacagtcactatccctgaatggaaactatttttctctgatcccaagatcctaagcagagcattgtgtgtatgttgtactctacttccaaccaaccctttaaagcaccaggcactctgcatgttgcattctggccagagtgcactgctttgaattcctctcatttgactctttgacgatccttactcagtgctcttcttcagcctgtttcgtcagtctgcaattatctttttcttctttacctccagttgaaattttacttctatttcaatatctattttaaatactttctccttctaatgattaccctcacacccacttaagtacacacacttgtacacacactcactacctctctaggtagaaatggttgattcttatcttgaattctgcttgtactctcacgtagcaaattttttcaaacagccaatatataaacttcaattggacttatcgctgtattgaaggcccagattattattttttagaaattggctacattctagaatgcctagaaaaccaaactagattgtatacttaaaaaaattaaattaaatcttaaaagtacatattaatatttctaataattcagctaagaaaaaacactttctctgaatgtagcattttaccattttcctgacatttctattttctaatgtattagaaataaatgttaaaggttttggggggtgataatggcctatgttttaacttcggcttaatgtttattaatgtgttacttctgaaatcaattatttctataattgttaaatatgtctttataatgtctacaattgttaaatatatctttataatttaaaaaatcatatgctgaaagcaaaaccattggcaaaatgaacgcgttggacatttttaaagcatataagaaagaaagaaaggattacagcacaatactagagaccttagtgcttaataaaattctatgtgttttcccacaattccactttaatattaagtgtaattgtaaaatgattctgaagatgtagcaagatgagtgtcaattataggcaaaagccaggaaagggtagcatggaaccttctagttctttcttccactaccacagtacccaatgaagcaatgtgcaacagatggtagaggctccatcaacctgaagcagaatatcctgctgcctacaatacacatagacatatcaacacaaaactttttctttttaaatttttaactgacacgtaatatttatacatatttatgggatacagtgtgatgtttcaatacatgtataaaatatgtaattattagggtaactagcatatctataacctcaaatatttatcatttctttgtggtgagaacattccaaattctcttttctacctatttaaaaatatacactatattattgttaactatagtcacttgactgtacaacagaacactaaacattattcttgctatctcactgtaactttgtacccactggacaacttcttattcccccactcccaaatccctctaggcctctgctagcaactattctactctttacttctagaagatcaacttttgaagattccgtttatgagatcacgtggtatttgtctttctatgcctggcttgtttcacttaacatattgtcctccaggcaatttcgtgttgcctcaaaaaacagaattttaatgttttttttttatggctgcataatattacattgggtaaatataccactttttttttttatccattcttcagttgatggacacttagattccataacttggctattgtgaatagtgctacaataaacataagagttcagatatttcttcatcatatttatttcatttcctgtgaatatatacccagtgctgggattgctatatcatactaaagttcaatttttaattatttgagggatctccatacttttttccaaaatggctgcactaatttacattcccaccaacagtgtgtgaaggttcccctttctcaccacatggcctctccaacatttgttattttttgtcttttgataatagccattgaaggtgaggtgagatggtattttacagtggtttgtttgcttgttttgagacagggtctcactctgtcacccaggctggaatacagtggtgccatcacagcttattgcagccctgactccatctcaatcaatcctcccccctcagcctcccaagtagctacttactatatacttaatctgtgtgtgtgtgtgtatgtgtatatatatgtgtgtgcctgtgtgtgtttctcataatgcctttccataatgtaaggaacatattgggaaggtccttggaattacagtaaacacaatacatttaaaagaaaacaacccatttcatagttctagatattatcttttctctttctctttctagttcttggtttattttcttgcctttttagactaaatctctgactcactttttgaagctcctaataatgcaaaaatttcttctgaatttactaatttaacctcttttgttatattcacccacacattatatgcatgtcaccattctctctgtctggaataatctttcccctgatttttgcctggttatgtactactgattcttcagctatcacttgacatgcctttgcgttggaaaacctctgggtcctggacttatatactctctcataatttgcattcttaactctttttattcttaacaaaattgaaaattaaattattttttatatttaataaggcatttctgtatccaccattaagccatatgctacctaaagacaagcaccatgtgtcattatctctgacatatcttgtcacaggcaagcacagtgctatgatgagaacataatagatacacaaaagcatgtgatggataactgcagtaacttataatcaactattttgaaaatggtatttctaggctaatcatacttagcatcattgtatcaatttgtatgttcatcttaatattcactaattttgatcattttttcaaaacacatttctattctatagctttcacttttcatagttaatttaaagttttctaaaaaatgaacattttcataactttaaaaaaagcctttatcaattattctaacagcattcagagtaaaaggcaacttaatttgattgattaattttggatttagttaagttagaagttgccaaattataatatagtatataactgaattttatatatgttagatatttacaaattatgcattgaattcaagttttaatatttaacatctggtaacttttatgaaacagatattttattactatatttcaaagtttcctgttttattgcattttatttacttgaaataaataaacaactgaaatacaggatgaagataacaacaaaactcacagctaacatttatcatgagcaggtataggataagtgattgacatatgctatcttatgtaaccctcacaaccacccagaggggtaaacgccactattctcatttagacatgaggaaactatagtcataactaggtatccagttctaaaaaaggagcttaactcaaatgcttgaggccctgccatgatgcaccactacttcattgcattaaacacagtttaaaattaaactacacatatccttaaaatttatctgtgggagcaggagaaataaaactaagaagaatggttggttttattaaaatccctttcctaatgtcattgagcagtacaacatgtttataattaaaatgaatgaaacttaacattggctttattcttttgtgattcctgcacgtagcatccttctctaccacatagcacaacattatggacaacagcatgagaaccatctttaattctgcctcctgtttccagtaactccagcaataggagtcaatgttgaagataatatgtaaataaatcactaataattcagcattacccctaggtgggctagggaagagcataaattatttcaatgtacagtccagtaaatcctttgtttttggtctctgatgcgtaaccattaaagatgcaccttattaagaaattcttatgtaacatttctagacataaatgtcatctgtctttccaaaactgtcttttaaaacaaactcctattcagctatctttacatagttgagtagtataggacatttgttaaacataaatggaaaaaaccatattcttcagaaacaaaatattattcatattagaagatcaaatggagactttttgcttctctataatattttattacttctctgtttttcttctgatacttcgggcgaaactggtgcaagctaagagttgaaaatcaatgccttagggcatgggcttttaataccactacatattagaatcaccttgaaatagtaaatacatgaaagctgacagcccacctcagaacatttaagttataattggatggggccagaatgtttagagtttgaaaagtttcaaggtgtctctcatatgcatacactattgaaaactactcttaagaggtaagaaacctaaacaaataaagtctattcttaaaattcaatttttctacttactctcccatagcaaattcatgtatttcccacgatattatttttttattctccccatataccttacaaagaggtcattagtactctaattatattttgtccttctctttaggaagtgtttctgtcaggtattatgattattttactttataattataatgcaataatattttgcattaaaaattaattaacacatagaatgtaccaggtattgttccaaaaaacttttccaatactgagtctacagcactattgctatcttcatttcacaaacaaggaacttggagcatagagaaggtcaaataacttgactaaaaatcagtcagctgttaggtagcatagacatgatacaaccccagagcagcatggtgcttcactaataataacaaaataatgagttgatagttatatagcaattagaacagctctggcaagtgttaggttattgcttactttactattatcattatgatcattattattattatttactgtgtgattaccatgtgctaggcataatgctaagaactttacatagttacatggttgtatatgctttatttcattttcacctcacaatatccctgtgagatgagaacacttattgctgtaagcaacttgtttcagtcacccaaccaataagcagatgagcctgaacaaaaacccatagttaaaaccatggcgtttttctttttcattttgtatcctgtacaggatttaataatagttttctcaaacagtagtaaactattatttactgaattgaattaaattgaatttgtatatctatgattcaaacttagttacattactttgcagtagagacattttcctttttttatatatatttgtgtctgtcttatttaatatctcttagcctgacgttcttaaaaaatatcagtttatcagatgagtagattgcaaaaattttctcccattctgtaggttgcctgttcattctgatggtagtttcttttgctgtgcagaagctctttggtttaattagattccctttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaatcctttccccatttcttgttttggtcaggtttgccaaagatcaggtggttgtagatgtgtggtattatttctgagggctctgttctgttccattggtctgtatctctgttttggtaccagtaccatgctgttttggttagtgtagccttgtagtatagtttgataaactggattaagaaaatgtggcacatatacaccatggaatactattcagccataaaaaaacgatgagttcatgtcctttgtagggacatggatgaagctggaaaccatcattctcagcaaactatcgcaagaacaaaaaaccaaacaccacatgttctcactcataggtgggaactgaacaatgagaacacatggacacagcaaggggaatatcacacactgggtcctgttgtgtggtaggtggacaggggagggatagcattaggagatatacctaatgtaaatgacaagttaatgggtgcagcacaccaacatggaacatgtatacatatgtaacaaacctgcacgttgtgcacatgtaccctagaacttaaagtataattaaaaaaaaaaaaaatccatcattcacataaccttaagccaatgacctccacaagcttcactttccttatctgtaaattcagataatggtacttacttcacaggaccatttggaatctaaggagttaatgcatgtaaaatacctaggacataaagcgtcaataaaacagctcttttatctcaaaaaaaaaaaaatcagtttagttaaataacggtttatctctttgggaaatgtaagagagaaaacagtctagaattgcgacatcactgtcttttcaccaaatacagaatatgggtgtggtaggcagcttctaaggtgaccgccaatgatctctgactcttggtattcctactgttgagtctggattggatttaaagacttgtttttaatgaatggaaaatatcagaaataatgggatattacttttgagattaagttataaaaagaaagtatcttcagccttgagctctgagtgttgctatttctctcttcaaccccctatctcagtggaaaaacagcctattgcgagcacccctatgaggagagaggtccatctgaagatgaattgatatctctcatcaacagccggtaaaattctgaggcctgcctatagctacatgagtgagtgtgaaagagcgtcttttgaggcctactgtcagtccctttgacaagttttggggtggattatcttccaattcagctttaagatgactgtggctaaataacatcttggataagctgattcacttcggtgtccttagagaccttgagccagaggaacaaaactgaactacattcacaattgtgagataagttttttcttaagacacttcatttggggataaatttttatgcagcaatagataactaataattatattttggttatgtgatatatgtgaattcattttggaatcttcacataaacttcaaacagatagatatgtatgcagctagaaccaaataaaaacaaaggcctacattactgaatattgggaaagatgtgatttttatgtaaatgcaacatatgtgcagataacaaaaatgtgaccaatatgaatcctgaaatgaaagacaggagcaggcactatgaattactggttttcatgtacagtgaggcttctgtcacagaccaattctccacagcatattctaggttaaatgcaggaagaatttttttttttaagtaaaggtgcttgataattctccttattaatgccaaatatgtcagtaggctttccacaaaaaaataaggaatggtacatcattttcttactttttatttataaaactagaaatattcattacaattataaaaattgatttggataacaaagcatttaaaattgatatggatgaaaaagcattgttaatatcttattctaagtatttagtgggatgataagatttttgtttcagtagttctaacagaaccaagtcattaattagggaaatgatagtccttcaaggacatcattagaatgatgagcttctgctttcaacaaagagagaagccagagaaccgaagtaactcaaatttgatacagattcacaaaggatcagaagttcaaaacatactaatgcatatgaacattatattagagaccactgcatcccaaactggtattttacctaataatatataagcagttataatatttttaaaaatgattcctgctcaaataagtttgagaaaaaaatgctggttagacaggcttgttaattgtagggctctcctgtgctttaaattactaatacgcacgattaatctctaagagtgaaccaagaaacagcatttcctaccttcatttgagcattgagatttttgtgaaggctaaacaattagcctcgcccagagtaatgttccatggaacaataaatgaggaacactcttaagtatcataattcaaagagttcacagtaagctacaagaaagcaggaaccacctttagccactcccagtgtactcccagtactaagtacagtactgacagtgcaggcttttactaagaaattactgatgaatgaatggatagacacccccaaactgtaagttggaaagtattagctacatgcatatattattttcaattgtagccttgcatcaaataatgatttatttctcttcatctttctaccagcatctcaatgcaaggtcacttcagaagtctggaggcttctataacagcacacaggatcaaaggaaggaccctccactcaagaataatctgtcatgactgcggctaatatcaacattatccaagaccttatttaggttccttgaaagctggtatctgtgcagcttccattcaggtggaaggtactgaaataatcatagactggcaaaaatggccaagcgcagtggctcacacctgtaatcccaatactttgggaggtcaaggcgggcagatcactcgagctcagtagttcgaaaccagcatgggcaacatgggaaaaccctgtctcaactgaaataaaaaagttaactggacatggtggcatgcacctgtagtctcagctgctcaggaagctgaggtgggaggatcatttgagcctgggaagtcaaggctgcagtgagctgtgatccggccactgcactctaaacctggcaacagaacgaaaccttgtcaaaacaaaaacaaaacaaaacaaaacaaacaaacaaacaaacaaactctatttttaagtcctcactgctaaatgcaaaattttctaccacagggtggtagtaatagatttctgttattgagaagaccctcctccccacccaccccccccccaaaaaaaaaaacaaaaacttttctctcctggtatttagtacttccttcttttttttctcttttatcaggaaaactgatatactattttcaatgagttttggattttctaagggcacacacagagagaataactttaggctacttcttgaagatataattcaatgatttttaaccaatatttatgccatccagcatcacctggagtatagccaatcaaacaaagcatatgaaccaagtaatcacacaatatctgcattgatgtgttgcctacatgcagcagaatgatctggatagctcaccaaaaacataattcatatataccttttttactccatttgccaacatactttatttcagagaaattttaaattatatctcagctgtttctcagagctcctttgtggaaattacatcctggtttctgttccatacttgagtagactacaggctttccagtacattgtccattggaccaaaatctggagcaagagaaatagtgttatggtagtcaggacacagtagctggagccaaactatctcagttcaaattttcgctctgtcacttactaagtctttatccttgaacgtattatttaacctctttgcctcattttccacaactgtaatcaaagggagtagtaatagtatgagttagggtcatcacttaaattgagtgtattaatacatgcatcacttagaacaggtgtgtggtgtatatatctatatctatatttatatatctatatctatacaatcatccctcagtatcctcaggggattgggttcaggactgcccgcatataccaaaatccatgcatactcaagtcccgcagtcagccttgtggaaatcatggacaaaaaatgttggccttccatatatgcggatttagcttcctgcaaatactatgtttctatctgattttggcagatgaatgtgaatgaggaacccacctatagtgatggccaactgtaattattgaaaaaaatctgcatataaatggatctgcctagttcaaaccatgttgttcaacggtaaactgtatatctcttctggactctccatttggaaacacatggacccagaggatttcttcctttgcttgtttatttttatgtgagtttgggcccacatttatctctattggctgatccagaagattcacagaggttatgttcttcatcttgctatcccaaccgtcaggtccaagactttgtattatctttttctcttacttcattgacttgtagatgcccctggtccttgatccatctttgtgaacttaatgattcaaactctgttgtttatagcaggtttaaaagaacagctcttattactagatgttcagaaaaatataaattttatgtttctattaaatttagaagattctacccatttttagcattaaaaaatatgaaatgtttattcagataaaaatttagtccaatgtagatagatatacagtgtcttctaggtaaaaatgtttagtctcccagacacctttccttcttagtttttgtctccttaagatagtgcctattcatagggaaggggttggggggataaatggaacttattttataaggtttcatggtggtaggggaagcaaacaaacaaataccttgagtgctatgtcctcagatttctacggtttccaaagaattggttatgtgctgttggcacagaattggttatgtgctgttgacatctgctagtgatcactgctgattctgtatcgagtgtgagtctctcagcttagaaagcatgtaaaagtgatcatgtgatcaagtgatcttcatcaagtggaaggttcacctcagcttccactgcacctgtcacttatgagctctcactataatttcattttccttcatctggggatagcaggtagtgattcctaaccttttgtgcaaagacctctgacttcatacagttctcccagcagcctcttggtaaattctgagtcctattgtaactctggaacccagggtggttccaaaaggctacaacatagggccttttctccctgacctgttgcattgctaagtaattatagctgagcccctagtgattcaagtaaaccttcaagaagaacctcatcccagactcctggactatgggcaagagttttctcctcattgttattccttcaatatatgtaacatacctcatggataaggatggctcttatattcttatataatcctaaattaaatgtcaactattaagtattatctctgacatcatctttatattccctccatccttattctcaagcaaatgaaagctatacaacaacatagggaggtactcagaaatgcaaatgatgaaagcataatgtcccctcgtgaacacgaaaacaagttcctggtaatttacgtgcattttgtggtaccgccaaatcccaatcaggaaaataagtactgtgtattgaaattgtacctctgatttcaaaattaaaacataaaaatttttagtagttatataattatgttagttgcatgaaatttgtttctaaaatatgactttgacaaagatatatataggacacatagtaatcaaaacaaaagtggcaattttctcggtagtactatctaccctcatgggctattctatggaattcctttccctattgttttaggtaagccgtcagtatatctgttttgcaaagaaaacaatgatactgggattttagtacaactcatgtcacttagtttccatgtctatttctttatatgagttattatttccttttaaaactatcatttatgtatcatgatagattcaaaatatatctaaatacacgttgcttattatgaatactaaagttaagtaatgcagaatttatagattcatactccagtttaaaattaggtagcttacataggggcatttatattgtttcatggaagcaagtttattagtgctttcctttcaagcatagcctaaatacattaagattaaatacattaaggttaatttgagagtagttttaattccataggaacatacattagccatatcttttcatctggaaaaaattataacaatagcaaaacaataagtctaataatgtctacaaagaaaccatatgagattagaaatatgaaaccttgtataaatccctcttatcagtccccatacaattgtctgaatccccatggctacagtcaattatgcttttttttcccccacagagataccagcaccaataagagaacagtttattctgcctcttgcagtgatttttgtgaatatctcaaaatatcgataataagaaatgggtcctgtcaatcaatgcatctgatggatgctaattctatccagaaaacaatattaaccttttccactgtaagcctatcaaatactagagatctaagatggaataatagctcaaaatgaatttctccatgaaataaaaatagaactgcttgttaatttttctcgaaacacagattagtaaaactgcagctgtttcaagaagtgaatttgtgggaaaatgtcaagtgtgagacatttttctttcttgaccaattaaaagtaataacatgccaactttgagaataatagtgtgggaaatagtggcagtttttaaactttgtaaatagaaatatcaaaacatataattagtttcaaatttttggttaattaaacacaaatacctatttatctgttgtattttgctttcatagtgggcttataatgttggtatgaagaaaataaaaatagctttattgttacagcctatgtaacaaagcatgacaaaaacatccagatatctaatttctcattggtctgggtctttcgcagtgtggatgcataattttgttatcaaattgaatggatatttttaaggatataattacatgtttcttggggaagttcaacaatttaaagtatcttgtcaatgttttatattttccattcctccaaaacttaaaattaagtagtgagtcactgattcaacaagatgtacacaaaagtatgtctactagtataaattataaatgtgaaactatagtttagaactctcatcattaaagttattgggttataatagaaacacatgtaatacatgtaaaaatgtataacacaagctcaagttgagttataaaaacatgttttgctcatgaaatttaattttttactaaatttgattagttgaggcttttaaataaacataaacattaatgaattaaataatgtataattccacaaatgttttctccacatgcatcttatgctatggaaaaatatttatccattctttccacaaatatttattgagctttgaaatatgccagacactgttcttggaagcaagaacacatgaataaacaaaaacattctaaatgctggcctttgtggtacttgtgctcatgttttgtatattaaataaaaaagacaaaaactatttttgtgacatttgcagtttgtggttaagcaggcagtaaactcttcttcacacaagtcaacaggggaagcacaggttgtaaatatctgaatgaaagagtgatgtgatacagaataatgtgtgaaggcccattgtagggaagagacagggaagcctttttgaagtgataactccatggcgtgacacacttttaagtttgcctaagacagttttaatttacatttgttgtcctaacagtctgtcagagtagcctttgctccactcaaatatttaggagaatgactaaggtaaagtagtagactgattgtaagcattgaagcaggttcggtaagggatggttttgattgggtttagggtgatagtaactgagattcagaaatgtggatacacttgatacaaatactctaaataatcttcttttccattcctgtatttaagtcccttatctattcaaagaataagtagcattcaagactctaaagttcaaataacagaatgatacaccacttcctgctttagaggctcacagcccatctgaaagagacagacaaataaacacatgcatataacttagagctacaggaatcctagtgtaattggcaatgggtaagtggatcaccaatgaaagagaggtgaattctaactatattcaaaaacaaaaaagattcacagagtaatggaccatggacttgagatttagaagtgaatgatggtcatttgtcaattgggataatatctctgtaaggtgtatgaggtcctaactttggtgaatgaaaactacaatttgccttcataaattgcttacattttttctgaagaaagatagttttataattccatctattaatatttctttgaaccccctgttacctgagaaggcaatctattttgaaatgaaaataatagaagcttaatacattaacctggaaacactttataatacatatcacactgaagaggtcctacataagtactcttctgttcattttaaacttgagctttattatctgttttttgtaaaccccagagctttcttaatgagcattatgaaaaatcttttaaataagacaaaaacattttaggtttctattcctttttttccctcagtgctttcaaagaaatttctgagcataacctgttgtataaattatactagcaggttatgattgtttggggtacttccttgatttttcacatttaaaaataaaactgctcatgttttttttgtttgtttcaaacagcaagtagaaaaattgtcatacagaatgttacctgtaaactttatctttgttcatgttttagatttttttccttgatttgaatgacttcttttttcttttcaggtacttatatgtgaattattttcaaactgtactttttaagcaatagatgcggaaaaaataggaatactgacttattatgtcctcaaagtctcctctcaacaaataccaggagatttccagttttctcttacatagtttggttggaattagctctgttttgattaatactcatgaacaatgtgtttgttctgccctcttttttaaatatgggagggagttgatgttggtaattatttattatttctctcaactttgctataaaacaggaggaatttcattcaacttccgatcacatttgaattagataccagaagactaataataagtaattttacaatgttgatgtgcgggcaattctagggaagactcaaaacccagaatacataaaagggaaaattcacacgattaattacgtttaaaaattcacatggaaacacattaaagagttcaaaagagaaaagggaaaagtaaagccatgaaatacaaactatccacatgagtactaaaataccaaggtgtaggttatacatgtttatatatttgtcaaaatttggaatgtacacttaaggtttgtgcattttattatatgtaaattttacattaaaataaataaatttgaactctagttaatgatagtaataataaggtatttaagcgaaagtacgctgattcctgcaaagtattttaaattgcatccaaaaataaggtagaataatgtatggataggatgaaggaaatatggattgtttgtgccacgagtttaaataaatattagtgttagaatctaggtggtagatcaatgatgttcattgtaaaagacctttaaattcactgccccctttttttttttttttttttgagacagggtcttgctctgtcacataggctggagtgcagtggcacaatcatgactcactgcagcctcaatttcccaggcttaagctagtctcccaccttagtttcctgaatagttgggactaaacatatggccgaccatgcccagctatttttttttttttttgtagagacgggggtctcactatttttcccaggctggtcttgaactcctggactcaagcaatcctcctgccttggcctcccaaattgctgagattacaggcatgagtcaccatactggctttcactgcacatttgaaattttcataataaaatgttgaaaaatttctacaggatgatttctaataaataatataatgcaattgaataccaattaaaaattgcattgacatgaatggtatcaacaaaaaatttaaaataaacacacaagtgaaaaaaatgaaaataatgcataacttcattgtcgatcacatttataaattaaaattaaattgatatttattctattatgtcttgaaagaagaaaataaattataatacacaaggtttttgagtgtgagggtgttgagaattatatacaatgtccacgtgcatataaatttgtacagccttttagaaatactccttttgaatatatgtctaataaatttaatgacattacctttgattcagcaattcaaattttagaaatgtattttcataaaacattgaaagactggatgcaaagatatatatccataagtttatagttatcaaattgaaagtatataacatacatatttagcaaaattatttgattaaatacatttggtataaataatatgattaaaattttttattgtattgtaagcactgatatagatttatatttatggacataaaaagatagccacacttttttgagtgaaaaaggcaagctatgaaaaattatgttgaataaatatgtgtgtgtatgtgtgtatatatttatatatgattgtatgcataaaagaataaacgtctgaaaatgtagaataaaataaaatttgctatctctggaaatgctatattgtggtcaatgtttactttccttttatacatttccttttacacatttcagtagtttgaaaagtaaaaataaacatttacagataaaaacttgaggaaatatttcacatcagatataatgaataattaatattcttaaagtactgagttcttacagttaaaaactaccaatagtcgcaaatttttaaaaacaatatttatttacatgacaaaatggtagtctctaggaaacacagagaataagaaatatagagaataagtattccttaccttccacatatttacaaccagtattcaaaaatagttttaaaaatatgtttaaccactctaaatgtacattaatattctatacacacaaatgtgaaatgatcacatcaaagtaaaactatttattgctttatatttacttactacatattccaagccatactaaaatgtatttaaaatgtaattctaattgcctaaagaaagcatacgagtttgtataaataaaataccattttcgtaaaatgaaattctaagataaatttgaattttgtttttttgaaaaggattataaataacatttagattatatcatcattcatgagttcaaagaagaaatgaaatctcctttgaatgtcgcaccattctgccctgattagatcaattttggacaatgacaatcgtaattaattactcttagccttcaggatgatgcacaactcaaaatacggaaaactgaaattctataacaaatacaactggctttacaacatctgaacaatttaatacatttaaaattacttaaatgaaaagtaaaagttaaagttattgactcaaaattttaatcagcttgactatccttctgcatctaaacatgaattaaacaatcttaaagctagaaatctaaccacagacagatataagtaaaaaagagaagtttaccagtttacttttttctaatatctgagttgaattagtctcttccaaagtattttttttttgcaattttgaatttactagttattttaatgaatgaagaaataataatgggatataatgtcttaagcaggagtgagtagaatatacaaaaatctaatctaagaatgggaatgagatattggatatttatttatgaaaactgaataactaataaaaatgatctcagcaaatatgcttaatttagatattgtgataatttcttgtgaaacttttgaagttaatgttttgagggaactttaaattctctctcaaccacttgcaatttaattaattagctatcaggcatcagtgatattcaaacttgcctccagaatctcatttatgagatttcaccctggatcacatttttagtttgtcataaaggttggcactctgcacaaaattggcaaggcaaaatatttattttcctctgtattcacttaaaaaaaaatactgtcacatctgacagaaaccatagtaacttctctctaaagttattctttctcaagttttttaccctttgtgctcttgacaacttttctgcaaatttcattgtaacagaaccaatacaattaataagattcctgctgtaactttcctcacgccttctatttatttttgtctgtttattaaaatagtactttttataagagtcgccctatgatattactgcttcttttaattactttttgaaaaataaatacttttatttttaagaagtatgtttaatcaaactcatcttaaatttattttgcgtaccttcaaatatgcagttatctgagataattaatgttttaatatggccaaacaaaatttgtgctttaaagtccattatctcagcgaacagaatggagtgaaaataaattatatttaaaaccacacacatacattatgcagaattttctcctttcagaattgatattcacagaaataaaatgccactcttattgtttagttggaaaatacaattgttagaaaattacatttcatcttatgtgtcaatctctgcagagaaaagcaaattagctttccctggaatgtgagaaagcagcaaaagcaaaacactctaaaattataatttcatattcttatatttttatctttatcttgctaaagaataagaatatattccactcttaaaaattcttgattttgtggaggaaacacattcagcaatctttagaatgatatagataagtgtcacttaattatgaggatacattctgagaaatgtatcattaggcaattttgttattgtgtgaacatcacagagtgtacttacagaaacctaaatgggatagcctcctacacacctagactatatgctatagcctattgctcctaggctacaaacctgtatgaggtactactgtacagaatactggagacaactgtatcacatggtaagtatttcaatatatttaaacaggaaaaggtatggtaaaaatacagtttaaaagacttaaaatggtacactgtatagggcacttgccacaaatagaatttgcaggactgaaagttgctctgggtgagtcagtgagtgagtgctgagtgaatgtggaggcctaggatgttacactattgtatacttcacaaacactgtacactttataaacagtgtacactttataaacactgtacacttaggctacactacatttactaaaaatatatttcattttttcaatgataaattaactcaccataacattttaggtttatttactttttatttactctttgacttttctgtaataacacttaggttaaaacacaaaaacattccacaaccgtaaaaaatatgttcttgctttatatccctattatagaagctttttcctttatatccttactatataagctttttataaaaattttaaaagatttattttcgtttgtagtttctaaactttcttgttaaaaactaagatacaaacacacatattagtctatgcctacaaagtgtcaagatcatcaatatcactgcccttcacctccacattttgtcccacagaaaggtcttcagaggaaataacacacatggagctgttatctcctatgataataatgccttcttctggaatacctcctgaaaggcctacctgaggctgtttcacagttaaatcttttttaataagtagaaagaatacaatctaaaataatgattaaaaacatagtatagtaaatacacaaatcaataacataatcttttattataaagtagcacataattatatttgcttatattttttgtatgactggcagagcagtaggtttgttttcaccatcatcaccacaagcatgtgactaatgcattgcactactacattaccatgactaccaccactaagagataggaattttccagctctattattatcttataggaccaccttagtatatgtggtccatccttgactgaaacaactttacctggtgtacaactgtacgtatccaagatagccaaaaaaaaaaaaaatctaatactaacattgtaagaactgtataaaatttaattttaaaattacatgaatcttttaaaatagagaatgtacccttgttactcctaatacttagctgactctcctttttctagatgagaaaaatatcatcacaattgcaaatcatcttaaaaggagattctcattcagtataatataatttcacttacactgaatatcactttttatttcctttattgcattatctcacatttgaaaggtttgaattgccacctggcagtgtattataatatcatattttacattcactctttatcagatatctaacatggaaattcaagttcatatttctttgcagacaaaaccaatgacaaaaagttctttaaacaatcagtttctccaaagctattctaaatacatttaatcctctgaatcaaatgcataatatgaatatgtatcatgttcataagcaagttacataaaactaaattgttatgccactaaaaatatataggccacatatcatgtgtctacacttatctttttgaatgcattgtgtttcaccttttgagatatagttcacacactggttataaaaatatccagcccaggctggaatgcaatggtgcaattttaggtcattgcagccttgaactcctgggctcaagtatcctttcgaatcagcctccctagcagttgggactacaggtgcatgccaccacgcctggctagttttttcattttttttattttttgtagagacagtatcttactaagttgtccagacttgaagcaaactcaggccacaagtgaacctttccccttagactcccaaaacactgggattacaaatatgagctgccatgcccggcctattaaactattccttatttgttggtggtttttcttttttggtttctttgtattgtgttgttctttttttcccccttttttaactattcttaacatatcagagtttgtctactcagatttgcatgacctcaaactcatagggattatttatcttcattagtcattaattgctaacaatgaaatctaaattggtgagggcagaaaaggatacgcagataaattttgttccatcatttagatacatttttatgtttatattttcctattatgatacttttaggtttctggagctgcagaacctttgtcaaaaggtgcattttttcattgcaaatattctaacctatgtgccataactacaggggaacatcctatatataaagcaaattattctattcaaatttgacacatgtcctctgtctctgacaatatttcaaagtcttcctaactgtactttatttaaaacttctataacttttctagttttattaacggattaattttcacaggatgatatgatgcttgcaatattcagcttccttatgatcaaagccaattctaattctgctatttactcacaagcatactaattactttttaaaatatcgtgtttataatgatcaaaatatctctctgtgtaactgattctttttcctagcaaaaagctcattagtagtcataggactcaataatgttaatattcccaggatgaatgatacaaaagattcattatctttatgccacactggaatcattgaactgaatcattttatacgattacaattatctttcaggcaatgtactcatataaatttaactaaatgcttaaatggcctgttgacccaaagggcactattagttttggcttgataatttaataaattaatgcccaggaaataatacatactttttattccacacttttctcttttattttttgaatcaaataaccgtgtgggtataattagaatattgaaaaaaaaaaagcttcctttcttcttggctacccttccttggtatatgcatgtcttcttcactgattatgatgaagaactgagagaattcaacctacataagttcattttctgtataattgcaatttaaaactttaagcagcatgcttccaaccagttttggtgaaactctaagaacataaataaattatttgaaaagtcagtataaagtataccttcagtatgaatataatatgggtatataagaaagactatttcttgttttctcatgaaatcctaattttcttagttttatgtttagttttctttttatagataaattccttaaagccctaagtcatgacaagcagaaaaagactgaaaagatttcgaattaaaattattttattgtaaaaattatattgattgatcagagacagttaaatattatatttacaaattccaatctgtttaaatgtcctattagtacacataaagttgtaatagtatggcatttgcgatttatcgcaagatttctatacctttacagtacagttctctgacattggctgcacacagcaatttcccatagagctttaaaaaatactaataaaagggcctcaaacccactacttctggcttaattggcctaggatgttgcctcatcatcaggatcgttaaaagatccccaagaagttctattcttgagccaagcttaggaaacattgctcaaaaggtatatcaacagaagaataaagtctaaagtgcaaagtagacatttgctttaaacttgtcacatttctcaaaatttatctagtaatatagaaaacattatttgcatatataagccatttaaaatggccctaacaatacttattatcttaacaatttcactagcaaagtccaaaagaacactcataatggtataaaaatatattaaattatttagacatagccagcattttagacagctaacaggatgttaaaacaattaatataacggtgcttggattggcatgtgtctttgaatgtaaaccctgtatatatatgtatatatatgatatatatgtgtatatgtatatatcatatatatttattatgtatgacatataatcctgggtattactattttaatcaaaagataattcagagctcatgaaatatgatgaattgaacttccttgatactgattcggattgttgtttggtccatctatctgattactgcttaaagaaaaacacaggtactaaatttaccatgaactgattaaattaggtgatactaaatttattatgcactgactaaactaattcttgcaagctataaactaaattgtatttattaactgcattatggaatagaaatattctcatgaacaaattcctaaccctctggaaaaataatactttattttaaatatttctattgctgagttaactaagcaacaactaaacattctacaatatgaaatgttaatatcatttaattaaaatacattgtggatattggtattacataatcactcattctacagtattaatcatagaagttttcttttcatatattttatagaatgttattaatctttattctggtatgttatttattataacttaaaaaagcaagtgattaaatttaaattaagatagtttatattagttgattgggaaaaaatagaattgctcatcatattttccctccttttaagtattttgttttttttacttattttactttttctggttagaatttcatcaattttatcaaaaatatgaaggctgtttaggtatgaatttttcttgagcattactgtgtaaacaagataaatatataaagaaaataacaatcttaaaacttaaattaacttttttctaaccaccccagaagtctctgtaaatgaaacagctacagaggcatctcagtttatagatggtttttgcttcaactatttccattgcacagatatacacgtctgtcttataactttaattttcttgtctttcttatgaatataacagtacatgcaaaatcacattatttagtgttggagaaatcaatatattaaattagaggtgtctggaatacaatagatgttcagaatattggtatatttgttgactaaattaattttattatttaatacggtggtgacttctccatggataaggtgagagacctagttgaatcctttctatgaatattcttcaagcaatcttgtcaataattcactgttcatcatagtaattatgaacataaaaaggaaaaacatctgcagtgtgggaaatctgaatttgaagtataattttcagtctggtacactgggtaagatcatttttaagtggaaaagaaagaaagaaatggaccctgaaatattctgtgtgtgagcattagcagcaattcaaatacatgatctgattgccagccaaacagaatttatttaaatatgtacacaagtaaatgggtttacatgatttagggtagtttttacaggtactaaaagttagcagataactttgtcttgaatgtaagccatgtgtacaacagaatgtaaggatccaggcaattcgtttaactgagtattgacttttttcaattatgatgaattatgataaagtgattaaaaacacactacctcggtcttcacataatatatgttttcatttgtaatatgatttcctactttgataacttcaaacctaatttttttatgtttttcatatggatggtttatggttattaggtaaaaatatttatttagattatgaaataaaagagcctaaattaataaagttggaaacttttgcatacttttcttaaacaactgaaaaagaagcaatttagttactacaggcaacatggtgtccatgattagtacaaaatttaattattcacaaagtgccaggcacatgggatatacaatacgacgtgtctttaaatttcacttatttcattttccattatctttaggtttatattatttcacagataataactacacatttcataactaaatctgaaatctatacaaatgcacattatgagtgtttttggagatatggacccccaaacagatggtgagatgctgaaaatttagactaccatataaaaattactcttgctacactgtacttcaccaaaatacacaggactagttaacaattacaccctaattaaagaatcttgttgtctggggtcaaagctttaattcatttaatgtccgtatatttggtaaaaatggtaatatgtatggatatctccagaaaagttcaccacctagcaatatctatgcctgtgaaaggatccagaatatgttgcattaaaaaattatatatatgttggatgtagtccaatgaatgtcatgactcagaagaaagtacaataaaccatgttccccatagatgaccagttgtctccacaaaatgtacatttgttataaaatgcataagaatgaactaggtgtacttaaaatggatctacataggtttaatctacttggcaagaaaaacatttatattattagatagagaaagtggttgcatcaattacagcaaataaatgacagtatttgttttttatttgtcattattcttaaatcctctagaggcaaaatggttaatgaaatacttctcagcctgcatttatatgccagccttttaaataaaatctgtaaatattcaaatacaatctatgcatattctgtagtaatctttaaagattatcaataaagttatagacataaacacatacatgcatgtttgtgtgtgcatgtatacacactacaaaggctagtccttgcaaaagatgagaggtatgttctcattgttcattatctattcaaaaccactagcttactgctacactgtgcagaatcaaacaaaactttctagaacataccaaaaggcgaaattcaatcatcgtgtttgctatttcaaaaatctgaaaaatgttgcttagtaacttgtctgcaagtaggttaattgaattcgaataattattttaaaatactttgcaaattactttgtcctttcatttttaattttacatctacattactattgatcaataccttgcttgagacaaagtttagggtactttgcagttttcatcttttgaacaagactggcaagtagtgggtattaaatgagcattggccaatttaaatgaatactctgaggaaaataattcatcccagttatccgaatattcaaaaccgagttcattttatttatttatatatatatatatgtgtgtgtatatataaatatatatatttagtacatatatatgtactctatatattatctatgtagacacaaagctaaatgatgtttactgtgccacatttttactgtcttttggataatatgatttttaattttttaaatattatgttttcttgagaccagatatatatatttgatttttaaagtatgttttcccccagggcatctacacgaatacttctcagatatggttacttagcaaaaaaagttctcagccaggtgcggtggctcacgcctgtaatcccagcactttgggaggccaaggcgggcagatcatgaggtcaggagatcaaagtcaacctggctaacacggtgaaaccctgtctctactaaaaatacaaaaaattagccggtcgtggtggcgggcgcctgcagtcccagctacttgggaggctgaggcgagagaatggcgtgaggccaggaggcggagcatgcagtgagctgagatcgcaccactgcactccagcctgggcgagagagcgagactccatctcaaaaaagaaaaaaaaaagaaagaaaaaaaaattatcaaatagtatgaacacaaattaatttgatgtgaacttcttgacacaaaattgtatcaagagttagaagaacatgttaatgcattagcatcaagcattaaacatttactcttacagtttttcagttttaagtaattaattttattaaattatatattttagtataatggaaggctgatatccaatttttaaagccagcttttattccacatgttttactcatttattctgatgtaatgacatttttctagtgttaatagtcatataaaatgtttctgctctgtgagtttcttcactaattcttgtgtttaagttttctgagtttgttttaattcactcaaaattatttgttcactctctagaaattcattactcttgcaaataatcaaatcactgtttaagacaattaatgtgttaatcaaccttgtttgcttcaaacaacaaacccacaagttagaccaattttaagactaattttattgaaccagagaatttaatatggcattattttcctatatgttttaagaagtaaatctttaggccgggcgcagtggatcacacctgtaatcctagcactttgggaggccgaggtgggtggatcacgaggtcaagagattgagaccatcctggccaaaatggtgaaaccccgtgtctactaaaaatacaaaaatttgctgggtgtggtggcacgtgcctgtactcctagctactcggaaggctgaggcaggagaatagcttgaacccgggaggtcaaggttgcagtgagccgagataacgccactgcactccagcctggtgacagagtgacactctgtctaaaaaaacaaaaaaaaaaagtaagcctttattttctaataaaacgaagaaaaaataaatacgtatatatcttagttcaatatttttaattcaattggtgactgatcactatgactaactaatacattgaagcttttaaaaatgttattatttccctggcttatttatacgaattaagtattgaatatgtgtataaacattaaaacaaataaaaattaaacatcatatgcagttacaacaaatgatttctaacattaggacatggatttttatggaaagggagaaatattttttatactttctttgatcttcagttcaggtgattttaaataatttaatgtgcttgtttctgcacatattcattaaacatcaagagtgttagaaacctatgtataactaagaaatgttgacctggagaaaaaaaatattgtttcacctcttatctatatttgatattaattcagcaggttgacaatataacaagagcctgtgaacgaagctattgatttacttatgagggacttaaaatatctagtttactagtgacagtcagaatgcaaattaatagagaaaaagaaactcacttgttacgacttcaaaaactattctatcattctatcacatatctattggtaaatgtttaatgatacctgaattaaaattacataaaattagcaaggtatattgataaatgtttaatgagacctgaattaaaattatataaaattagcaaaataagttcatatggtattatttataatatattttttaaatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacaatccccagagtgtgatgttccccttcctgtgtccatgtgttctcattgttcaatttccaccaatgagtgagaatatgtggtgtttggttttttgcacttgcaatagtttgctgagaatgatgatttccagcttcatccatgtccctacaaaggacatgaactcatcatttttgatggctgcatagtattccatggtgtatatgtgccacattttcttaatccagtctatcattgttggacatttgggttggttccaagtctttgctattgtgaataatgctgcaataaacatacatgtgcatgtgtgtttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccatatcctctccagcacctgttgtttcctgaatttttaatgatcgccattctaactggtgtgagatggtatcacattgtggttttggtttgcatttctctgacggccagtgatggtgagcattttttcatgtgtttttcggctgcatgaatgtcttcttttgagaagtgtctgttcatgtccttcgcccacttttcgatggggctgtttgtttttttcttgtatatttgtttgagttc

SEQ ID NO: 268 - DNA, 60414 bp, Homo sapiens
ttgtgaggattaaatgagatcttagtatctggcacatagtaagtgcttaataaaaataataaggcagagctgggtagattgagggttttgtttacagcactttggcagcaagttgcttgtttcctgccattcagagaccctggccaaactatgtccattgtggccacaagaccattggcatgtcagcctccaaaagagagatgactgctcagcaggcattaaccagatcagaggttctttgattcagcacagtgctctctttttgcactgctctcagtctaccaacagtatcaatcacagcaaccattcatggtgcaaggtgatctccctaaacttacattatatctttaatcctcacagcagccttgggggatggtattatttccatctgtagatgagacaataggggctcagagatggtaggtaattgcccaaggacacatagctgttggagaaagtagtattggagcaaaatctatgtgtgtgcatctagattgaccaaccttcctggtttgcctgggaatatggggttttctaggatgtggggcattcagtgctaaaatcaggaaagtctaagatgagttggttactctatatgcggcctctccgtggagggttggttggtgggcctggaaaagggatagggataagagagagaagaggaggacgcagagagaatggcagaagcaactctgcactgtttctttctgcaaagatgtcttttcaattcaacctgcttgttcagttcaacaagcaggtttgaatgccctcgtccttggagggagtcacgtcaggactttccgggtatttgaccgtgatgaagagcgctgtctgccagggttcgccaggctgggtgtggaaaaatggtgcccaaaccagccccacatggcagaataggaaacatgctgtcatcttgcttcatctgaatctccattccatgagggcaggaattgttttcttttttacttctatagctgaagccccagtgcccagaatatggcagaaactccagaaacattggtggaatgtagactattgaataattccaagtacaaaccaatggtccagggagatttagattctgatgaaggcaatctggggaagactgaatggagaaatagcattggaaacggtttggataccacgtgttgggatcaggaagcagaggagcacagaatgcttgtgcagaagtgacatgggcccactgcacctggggtggaccctgtgaggtagagttggagaccaagggcctgaggactggacatgtcggtggagaccaggtggtggaggatggagaatgccatgccctcagggagtttggactgcctgtcgttaagccatttttttctccaaatttcaatccccctcattccattgtcaccatatttgccatgtctgtgtacctacctatattacttatttaacacttttccttcaagtgacttactttttaactttacatttgttttcatatcaaacacacatggctgttaaaataaaaattacgatttgaacttagaatcatcttgcctaccacatgaggtaggtgtacttccctctgaggaccacagctccagcaactggggaaccgacaaagatttttgaaagaagaaatgattcagttgctttttgggaagactacacacgtgaggaagtactgagtggaagatatgtgcataaaacattggcgcaattgtgactaacatggtaagaaatattatcaacgcaagtttggggggcatttcaaagtctctcaatggtcatccggatgaaatatgcaagaactgctctctctctctctctctctgtcttttctcttcttggtctcactttgccctctttcccagcagctctgccttctcccccatgcttgctgccaacagctctgaggaatgggagggattgcagttcaaagagtaaacaggtctactctgagtaaggctgtgggctgtgcagtgacccccagtgggtctgggtgcctggtaatgatgcctgcactggcatgatgctgtggctttccaggcttgttttacctggttgtgcaaagaatgttacccccagccaaggctcaagttcacagaccattggcccatcccctaataagcatattattcccagctgggcattgaacttccaagttaaggtgacctgccaaactggaaagaaaatggatttgcaaaaatcagatgtttgccaacagcaccatcccccaccacaaccatagacaattgtgagatctaaagttggactccctgaggttttctgccctggtggttctggcaactcctggagagccacagactgatgaatttgaggatcataaaccttaagaagactttaaagtatttttggcattaattgacaaagtccacagcaagccaggcatgctcttctctcccactccccttgtcagagatgtctctttccccttgctcttcttaccccattctttccagcataaccaagcttaatagcttccatgtttccactgtaaggaagtgagccgagtgtggttggtctgtttcacagcagggctatcctcacacgaaaagttttcagatgcattgactatgcagatttttggctcagtttgcagaagacttccttatttcagttttactgtacacccacctacataatactttttggttcttagaatttcagagctattaacctctaaacttaaatcaaaattctcatcaaactttcctagggccttgtcataaaagaaactaagtctcaaaataggactttttggcctaatttccttgtccaggaagacagattgactaattccaaaccctggactcacatgtgattgctaagaataggggtgggggagagagaggggacaaaagtcatagacatgccatgacacatattgggagatttcatctgaatttcccctgagtatgaaattattcagaaataattccaagggcttcttttctgacattccaccagtgtgcaggtgcatatgttttgaatgaactgaatggataatttatttatacaaatgagtctttttgaatagttgcaatggatgtgctgtcaactctccaatatcacttccagggggtttgtagatgcattctttccatgggcatcagcaggtctggatctcctgctttctatctgaaaggcactggtctggatctcctgctttctatctgaaaggcattatgggcagcagtctggttgattttatactactttgatacactctcaattgcatactaagaatgaggatggagaaactgatagtgaacctcaccccaattaggtttcactactgcccttgaccttcatatttaatgcctttgttatcacagcaactctttgctctatttctggatccaaatgcctaaggatctccctggggtgttaagcttgctcagtgctattaaacctggtgggtggcagagtgacctttgtatcacaagagcctcatgacttcccaggcaagaccaagtcacaacttttccaatggatttcccctcgattcttattctgagcatttagctttttaaatatttggctctgaagggcaggggctaaacattgttctgtaagatccaaacctgcttgtatattttatacttttgttttttcatttcaactttccgatctcgctcttctgagaaacattcacatttccaattgcattccagaactgagcttgactttccatgtccatgtaagatcttgtaattcaaatttcagccagctgctaagcttctcttttctggaggggattgtggttaagagatcttgttttgcaatgacgctgtctggtctgagctccagctacttgtcttatttactgtgcaaccttggccatgttaacttatcaggctcatgaggctcggttttctcatctataaagtgagaaaatgaatagtacctatctgatggagtttttctaaggcttaaatgaagtaatgcaaattaaattcttagtctagtcactgggaaaagatgaaaacttaacgaatatgaatagtcactattctgtttctttttttctatgccattccggcttcacctccttctcttactttttccctttcttttttcatttgttttcttttttttttttttcttttttgagatggagtttcgctcttgttgcccagactggagtacaatggcatgatcttggctcgctgcaacctccacctcccaggttcaagcgattctcctgcctcagcctctcgagtacctgggattacaggtgcccaccaccatgcctggctaatttttgtatttttagtagagatggggtttcaccatgttggccaggctggtcttgaacttctgacctcaggtgatccacccacctcagcctcccaaagtgctgggataacaggatgccgcaccactgtgcctggcctcttctactttttcttagaaacatggagggttagttctctggccactcatatgaaacttcattccctgctaaggtggaagtattggagttcaagctctacacttagtggagggagtaaataagcatttccagagagcccaccaagtgccatgcaatctcctaatgctttgtactatttctcatttaaccccccaaacagctcactgagtatgttaatatccccaataaacagatagggaaactgagacctaaagtttgagcaaatatggcaaagttttcctaggctgtctggctttaaaaacaatgtcctttcaccgcatcaggctgcttctgaggagcagagccaccttgcttttgtaagtctgttggaataggctctgagatgccacacgttatcccaaataattaggcatctggatggagattttatacattttctacttggacctgagtttgctgtctctcatggttcctgggtgaaagaggccaggccctgagacctttacccaaggttggctctaccaaaatatcttcttgagtgagttctctggttgatcatctgtggaacaatgtgggagcctactaaatatgaatggaaaatgaggaatgcaaaatggatggttttctccactatcacctcacccttggaggtgtttgctgatttggtagatgtgtggaggaactcaggagtctgaatttgtaaaggtaatttggatgcttcattagcttagaaaggacacagcagggagaactatatagcagagaaggctggatgcctatgagggtagggaagggaaaacaagggggtggggctgtagctgccctacctccggtccatatatggctgcatttctttaatctcttttacttttgggattccatggtagtaaacaaagagttcttatgttaaaacaattgctatctaattgtacagcatggtgaatatagtcaataacaatgtatcatgtatttgcaaattgctaagagagtagattgtgttttcaccacacacaaaaatggcaagtatgtgaggtaatgcccatgttaattagctcaatttagccactccacaatgtgtgtgtgtgtgtgtgtgtatatatatatatatatatgtttatgtatatatacacacacacatatatatgacatgtcagaatgtcatgttttattccataaatatatacaaattttatttgtcaatataaaaagaataatacctggaaaaacaaaaaaaaatcctaagtgctatacttataaagaaatcttcctcatacaaaaaagaagaaattctggccacaggaaggttgcctgaaaatggccacctttttcatgattttccctccctttctgagactgagaaatgagccttcttgaagaccctgatggaaatactgtgaagaaactaagacagttggattcaagaaccaaaatgcttatcgtagcagtgaggttggcttgaagtcagggaacagtgtaaagctatttgtggggaaagataaggccagaaagagattgataaaatacaggcgagaccaaaggaacagggcaggggcaaattagtttaggcaagaatagaggcgtcttgatattaattaaaatatggaggaggagtccagaaaattcatccttggtgcttgggtaagtttagcaacatgttcagatgcctgagttttgtgtgtgtatgtgtgtgggcatgcacgtgtgtgtgtacacagtgggtcattcttctcaggaagagtgagccactctcccctcctccagcaccaaagtggcccccaccttggcacgccagtggcacatgccattgggccaggatttgctcagaatgcaggcacacagacataatgtcaggaggcattgctggtgtgtgtcacatcaacctgttagaacaactgtcaacgtgtgacctcccaaacagaactcaggtgcccccttcagagaccgtaaagcttgtccttagaggataatgaagatccccaggaacctcatctaatccaaaaccaaaagatttgggaaatgtgacctttagaggggagtagcattaagaagcaaaatgatacttattaattctgttgcttatttgactgtaaccagtataataaatgatcatattctgctcgatttaattccccctccccataagtttcacaagaccagaaggagtttcttcttcccattggtcttacattaatattcttgtacggctttcactaaatagatgccgtgttctgccctggaggtaacaccacgtcattaggaggagatgatagacagaaatatatacaaacacacacttgctttcaaaaataaatataggccctctagttaaaaggtattgtgtaaagtgtgtgagcatcctctttcttgcaaagcaagcacacagcttccattaatcttgtagccacagcctgtgttggtgttaagactcagattccttaatgcttgatacttggcttaaagagattctttgtcctggccttgatttgggaattaagatccctagggtttttggttttacagtatggatcttctaggagacaacccgactgacctccgggtctccaggccaccacacacaacctggtttgctttgctctgttccccttttcctctgtggggaccagcacaggactcaactcaagggctctgtgtctgtgcacaggttggagagggtgatagggccttgacctgtagggacaaccaggaagatttctatgcagagtaattgggtttctagagtttgtttcagttgatttgagggcaagctgcttggcctctctctcttgattcttcccatccacagaataaagacaatcagctttgtttatcactctgttcattttgctatgtctttatcagccccccagagaattcaggagcacagaacaagtgctggaggtctctcttgccagagtcctccttgagaacttacaatgtgtccatattaaggatctgctgtgtttgatgattttgtgattacactttaaacttcttatccataaaggacatacttgatatatctgagacttgtagtagaaggccttgagacatccatctcatcccatcattatctatctatcatctatctatctatctatctatctatctatctatctatctatctatctatcatctatctatctatcgccagtactgtcttgttgaagttggcagtagggtgaaagacctcaaactccaaaggactttccgtatggatgcaatatacctgcaattctagcttttttgtgtttttttttttaggttgggggtgaggggtattgttttcatttttgtttttcttctggaaggttcaactaagacccaagtaaaaagaagaatcaatacttaataagtacccagcaagtagcaggcacacttttaggtactttatttacaaaaaaacctccacaaataaagtggcttgtgagtatgaggtgacatctttccctcccctcccaccatcactaccccaatatgactcgtctcaatagccctccaatctaaaatggactaaatacaagtggataaagaaatggagatttaaccagaattcttcagctataaattacagggcctataattaaaggtgattgggactgggtcagagagccacatcacttttgtggttgcatttgaagttcactatctcttgaccacacaaccctagcccttctactcccaccctgctgtctcaggttaatctcaggcaatggtgtaaagaaggccaagtttgtttccctggagtcccacgggctctagcaataatgcttcccttttctcatgagtgccccgccacccaccccccttcaccatcactacacacaaatgccctgcagtgggtggaatgtagttacttcaggttgtgcctgatttgtctctcaagcaaaactccagcaggccattccctcagggccctgctctcagatctggaactgatagactaattggggctaatgtgataatgggaaataatgaaatttgttgtttttatcagtgtgtatatggggcggggtttacatttgcattttcacagggcccttggcaagttcacagggttgaacagttgggaagggtgggaatgtctggggcaggttagggaggcagagggatttattagaactcccctaaactgcactgaccaaagcctcaagcccttcttcaagacctgcccagcttccaagaccttcccaagtccacccttgttttcccactgagtcttttacactttcagaaacctctgaatttgtgtagaaactagaaaaaataagtaagaaaagactaatactactgcacactcactgttcccccttaatataataaccagtttttattctattcagtcagcctttgaccataagcagacctttttttttctttttaacacaagtaacttcttggttttgatcacaaaatctttatctctgccaaatctcaacttcccttccctctcccacaaaagggaggcccgttgagtcaaagaaatctgcttagacactttgctcatgccaggccagtgtcctggaaggttcaacagagaaagttaatggttgggggatggtatttttctttgctaggagcagtcattcacccgtatgggagaaggtacatttgtgacccagtgaagcaggtacaggtaactccccatatgtcccttggcccaagggaatagaggttgcctgggtatttgaatccgtagatcctccctaatattccaccttcttcttgtccaaactgtgcttttttatttccagtttcagcattttggtcttctcatctctaactcttatagggagtgtcaataaaccttttaaaaaagatcatgtaagtgtcaagaggaagtgaagaacctagataatccaccaaccggataatcagctcttgcatatttgagagttgactgcttgacctaagcatctcctcataaggtaccctccctcccaggaccttccctttcaaacctctcaaggctcttacctggggccaggggagataggcttttcaaagtccattgaattgccaagagtctctgtcaagaaggcagtcatggtgcctggagagggaacttgctgggagccccttcagagcctggtacttatagagctagggaaaagatcttgatgccaaagcagggtggactaaatacagactaataaatgagacaggtgctcaagagggcccctccataccatcatctcctccagatttggacttctactcactttgcttttacattccctcttcccgatggtgtctttggtgagcagggtgcttttcacctgaaacagcctctgagctgaaaagaacagtcaccaccaaatcaattcctcatccattaacaggttgtctctctgttcttgagacacaggcattacctggttagacctgttttgtttgaacactaacgtgtgagttggccaaatgcaaatgagccagtgtttgtaatcctttattttatttttttaaagggctgggtagccaatcagaagagggggaagtgacttagggaattcccggttggtggcttattgcttaacatcctacaaaatgatttaaaattattgttatatgcatttatcttcactctgatgagggctcagacttgataacacccgtggtgccccatccctataggagctggtgagattgcagcctgctgcctcccctccaacagccacagctattggatttcccacccagaatctttaggtaaatgaggtaagtcctgatttttaaaacttcttttgaatctggaatccaaacacttgagtggaaagagaagcctgctttaaactggacagatgaaactagaacagactcttggagacggctggcaggaagtgaagctcaccttacctgggcttacctcactgggtcaaatcagaattttattttggagggcaggttggctactttggatattatctgtgaatttcctgcattgtctggacttctaatctctgtgaatttaaaagccccctcgtttccctatgcctgggtggcaaaaccattcccctgggttgaattcttctggaacaaataggcagctagagataggtggctctgatatagctcagagaagaagtggttggctaagtagctgttagggctcagagtacacggtctcgctttctagagatgtcttctgctggtaatttttctgacttatgagctacatggaaaggccaatttgtttttaatatgttccaggactggaaaatggctagaaataggcaagaacatacacaatcacactggaaaaagtggccaggcagccaaggcaggcagaggtattggggagagctgaatatctacaaaaacaaaaattcagaaaaaacaaaaatcaattttggcaaagggcttcactgtataacaaggggacaagctaaccctttgtttacaaactaaccctttgtttactccattttgtccagaaaatacaacaatcagttttggcaaagggcttcactgtgtaacaaggggacaaactaaccctttgtttactccattttgggagactatgatcagacaggcagttgtgactcagcagcaacaaatgccttctgagacagggattcttttgattttgcttggacattgtggagaagtgttagccccaatgtggactgatctgggaacagtgggaaattaacttcttgttggtaaatatcaggctgaggtgagaaagcgacattttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggaggtaaagatgtgttgatagtctttcaatgtgtaaaagggcaattagagattctgtgtgactgtgtgttaattccactggggtcaggggaaaaatttatttctaacagaaaagaagaagatacgttattaggaagaatttcatggctaggagatactatcagaaaaggctcttaagagattttaaggatgactttaatagctgcatttgaagtttgcagaggatccacttttcctctttttgtgacctaaaattctgggatgatgaaataactcaccaattccatcttcttataatatggagtcatgtagacaacaccattttcacacaaatggctaatggtatttaaaaaccatgatggaatgtgaattgggagtcatttggaggtctgtagttgaacttgaaaaaataataaatgtaatggagacaatacttcaccgtgtttccaaaatattttacagaggcattttaaatgaaagtcactttgagggaacagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccgtcgcccagcctggagtgcagtggcatgatcttggctgactgcaacctccgcctcccaggttcaagtgattctcccaactcagccccccgagtagctgggattacatgtgctcgccactatgcccagttaagttttgtatttttagtagagacggggttttaccatgtcagccaggctggttttgaactcctgacctcaggtgatccacctgcctcagcctcccaaagtgctgggattataggcttcagccaccgtgcccagccatattgttttcatttttaatctattagtctatcgtgatctcccagtggaagtatctttggcctttgtggacgtcaggaaagccctacattcccactcgcgattccatgtttatgggtaccctaaatgctcccattaattgaccaactttaccctgatcttctttcaatatctttctgactccttgaaggtatgagacaaaatggaaactgagaggttaaaaggtttactaggttgcattcaattagcgaattggaaactggaaggagctcctatcgggtctcaggtcagaacgtgagtgcttttggccaaagttcacttctgaggaagtagaatttcgctttctggaatcttgcgatattttatttcctctatatctttcccatgcccccgacccacccaatctccacaaatttggggatttgagcactgggttgtgatcgttagaccatcttgcttttctgaaagcccagggcaagacccctgcttcatgtcacagtatcaaacacagacatagaagcttgtacaaattattgagaagttattgtcttttctcccttcctccatatggagtcatctctatgccctttcatacagatgtgatttacgaagacctctgggttaggggtggggtggtgagcaagaatcccgtggcagaatctgctaacacacttgagaagcaatgttgtggttttaaggaactcaatctaaagcttgaacctgattttcagggataccattttgctgccgtttcagcccatttctcttgttaagatcgctctctggtagagttgacgtgacactcatttctgttgtgggtggggccctggttgggaggcattggctccactgcagcctgggtgtctagagaccacattctcaccctgcctttgttactgggaaaccgaacgcggcgctgtggctttcagcttgggtaagccgggtctgcggcggggattgccatctgaagacagaggcaggagggcagccacaccttgcccaggttctcttaaatctcttgctctataactgaaaggagggcatagataattaactttatttgacatttttcatatctaatttttaagaatatgattttaaaataatagatttgttctaaagagcaaacaatcttgctgttattaaaaacgtgtttacttaaattgaacggggtttcaaagggccaagctactaagctgtgcaggaaacaaacagtgcagtgaggagaatggctcctcaccacagctattcttagggtgggacatagtttcaagccaaatgacattgatgtccggaaaccaggatgtgctgaagtagaaatttccagggatccctcagagttatttgctaaaatgtttattattcttcagaggggggtggaaatatttctttaagagtcttccttgaagaattttgaactccagctttggagtgatgggagcacagtgcagggaaggcgggatgtgaggtggtgtgctggacggcagtctagggacctggtctagcactggcagagctgtgtgtcccagagcacacattcccctttgccaggctttagtttcctcctctaggcaaaagggtttgaacctgaccatctttaagatccattttaaccctcagattctgtggctgtggtgattgggggtggtgggagtacctgggggtcagcaggataagcacgaatctgtgagagctgagaacaggtgggagaagccttctaaggatgaggcaggaaagattagcaagagcccttaaatggattctttagggccttcagaattttggctaaaggctatactagtggaggtactaagacctgacacctggagcctttattaaggatgttagaatccactcccatgacaacatcccagctttgccaatttgcctcatgtgtctcaagctggtgggaatgtagaagtggatgaaacagactgttttgtgatggcagggaacagcctatgcacaggggcaggtgctctactggtgtcttctataaaacgccaaagcagcccgccagaaaatggacatttaggcactcgtggtgtctactgagtttgtatggtactgatgagcttgcttgactgattatccatgacttactgagtagatcgaacgtatgtggactcacttctcctagaggaagaccctgtggctgccccagccactgagcagcctaacctggagaccctgatgtgcccagaaagcgtcaaccttgtatctggagaaaccagaacttgcaacagggccaagcagggtggcccatttaaagaggctcctagggttttaattgaccttgttttaaaagagacaccctgtaaaatactcctatgaaaacttatttcacaagcacctaaccgcattctgtctttggtttgttttacggggccgggccccttgttctggtcaattggtctgcattatctctcctcctccaatctcaccacacaccctggcctctgggaggcttcctcccttctttttttttgtttgttttgtttttttagcatcttagttgttactaggggtacttgcctacttatttaaaatatggccagtataggtgcatacaaaatgtgctttctgattaaaacaaagccaaaaataaaaagaaaccaaaatgcctattatagtagttggatttttagactaacagaccacctcattaaccctgtcattttaccataacaacttatttttatctttgtatgaccttgtctcaatgtcctttttctttgatgttgttgcaattatgaacatcaaatttcatagctgcttttccaccccactttctatcacagaagcacaataaataatcttgggggctgggctcttgttggcccaactgtggcttcaaaacatttcagttgcctgtccagccctttcttagcctgatacaacatcccccaaaagtctgttgagcttttcctggaataagaagagggtcttctactttttgaatagagcaatggagattggagaatatggtcatcttgtggaggttattccaggcttcttcttaggaaccttaaaaaaaatctcctcagtagggctgatgatatattctggacaataaggtgagcagagtctgaaagatgagagcaattttcaatcttgtcatgatttcatctagtcagcctcatttcatctagtcatgaggctgactaatgataagacttgctttgtctttgcagtgtactctagatttgactctaaattcagcctctgtcttgatcatgcccacttagaaaattagagtgcagctagctcaccttttagtcatcttaattccactaggcagaaggctgtgggtcaaggaatgttgatggagtaaaatttgactgcatgtgtatctgaaggggtaggaggctaagagattttatggcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttctgttgggtcagagtgaatggatattaaattctgggattttggtttgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctgatgcctggcaagtagggacctgcagaaaatactgattctcctccaggcagttcacatgactagcttttaggagtgagtataccgttgcccacccctaaaattcttgatcatgtctccagatgtctactgaccactgatgctgaggtcatgaatcttgggcattctagaggctttgggaaaaaaaattctacttacttcttttgcccagacactctggggtctacctcttggtaaattattcaaatgaggtttctggtcatgcaaatgtggtttctagagcctatttgaattgaacaagtagttcttattattagtaaaacagcaaggatccctaacttggggtccaagggtaaattcagggtttctgtgaacttggatgtaaaaaaaaattgtctttattttcaataatctctaactagaatttaacattttctttcaatatgaatgtaggcaaaactccatggtagtattagctgcaattgtgactatcaccaggataaatcacattttcatgtcttattacacctattacatatatcacaaaaagtgggtatttgatatcaagttagatctgcactaggtagatattcttatttaatgtattaacaaggaagcacatatattgttatcaggttggtgcaaaagtaattgtggttcttgccattaaaaataattacaaaaacagccagtctggccaacatggcgaaaccccatctctactaaaaatacaggtgtggtagcacacacctgtaatcccagctacttgggaggctgaggcaggagaatcatttgaacctgggaagcagaggctgcagtgagccaagatcacaccactgcactctagcctgagcaacagagtgagactctgtctcaaaaaaattaaaaaataaaaaaaaactctgtaattacttttgcaccaacataatatgatatcacacatttattttaaaaagtattttgacattgtcttttaatataaatttttttaaatcttataatattttaatttgtcatgtaaaaatattattttgagaagaggcctgtaggcctcactagattacaaaacagatccatcgtacagatgaaaggttaagaacacctcatttacagcattctctcacacacgactaacgaaatgacttctgaacagcgccagttgatagatgttctctgccaaaaggggaatatgatcttcccatatgttcctgcctatgggtagccttggagttgtgaagggactttggcataatgaagatgataataagaatgataatggtaatttgttgagtgcctgctgtaagccaggtggttacagtcctgttcaatgtcatgtttagtttaatcctcccaatgacctcaggaggtagtgcatggaacaaagacagaagagatcccctgcccacccacggtaatgaaacatgggtacaggtgaaggcaaaagtggggactgaccctttggagatggctgatgtcacgagtgtgcaacctgtgcagttccacggggccccatgcttagaaaggttccatgtttggtttaaggctctgctgttgccatcttaaaattcttcgtaagttttgaacaaagggccctgcatgttccttttacactgagctctgcaaatgatgtagctggtcctgcctctggttatggtgaaatggaatgtatgacaactcctgagactgggagtctgggaagctgctgcggagagccctctcctcattttcatcaggctcagctacgcaacctctggtggaaagctatggcctgttgaggagggaggatgtcgtttttgagttagtgagttttccagttttgtttgagctccaaagctttcctccaaacaactggaaagatggctgaataattggctgaaagggatttaatcccttgaaaaacctttctggtagggagttgctggcaatactggtgggtttttcatgattttattttacagagggcttgctacgtaaaccagtgagccaggagaaacagaataaagtctgttctggaaggaaaaatgagacctggtgtgccacgagtctagtgttctcataggaaggctctaaaaacaaactcagctttcctgctattgaatgattatctctataaaaggaaactttacttcttctaaaggagaggtcgtctaatttgtgagaaaattcagatgttatttgcttcttaagctgcaaggatgctaatgaaataattctcatgaagttctgttggtgttttagggctaagtttttatagactgttccaaaattcaaaacagggatgtggacgtagtgatggtggaagaggggaagacttttcctcgatttctttgcctgagggatggaattcaggctcccccaataacatattcatggtctttctctggtcagtcagtgatgttcataacacaagcaagcctgtcatcaggaccaatctgtgatggctgagacatcaggtgctcttccaaaagagccataattcacccttcatttcccaaggttttttttttcttgctgttattactgctcttttatcatggttaataagtctgaggtggcttcagacagccagtcctaacccctgagtcaatctggggcctctaacaggaagccagactgaagttctgatagatgggtttgagtggctgtgaactgtgtttctgtagcatccagactgatttgcactgaaagggagcttccatattagggtacaaggatgatcaatatgtctcctgtttatatttggtggaaaaagttgtgggaatcgtgcttaaaggatctcaactttgaaattaaaagtataacgtcctaacagacatcctccttctctttagaaacacaaggatccattttcaagtaatttcaaaagaactatgttgctttccccaccccttcccaagtacacttattataatatatccagtccatttgctagctttgtgtctttagaaaagttgcttaacctctctctgtaaaatggtgcttatattagtactaacattcagggttattgtgaggattaaatgaggtaattcatgtaatgactagttctatttctagcacaatttaaaccctcaacaaatatgaactattatcactgtcatagtttttgttgttgttttctaattatataatcttcaagattctgagatgggggctgttgctctttccttgacttgaacatcttggtcttttcctaggaggaaacttgactcttgaaatggtcaaatccattgtcctagttcatcctgacccctccctggctccaatccccaccccttaccgtcctccacccttcctacattcctgcacagttggtcttatttatcagtcaactaagggtgttgttaaatcttttatttttctgctgcccgatttggttctaagcactccactccctacgctgctcataacaagaatgcctgggaacgctcagtcagccatatccctcccctgtcggaacacccagttcttaatgctcctggagaggcaacatttctgaggccccactgccataagcccccctcccccatgaagccagtggtctggtagtaatgaacccccaacggcccggagaacactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttgaactcctgacctcaagtgatatgcccgcctcggactcccaaagtgctgggattaaaagcatgagccactgcgcccggccaaaaagagatattcaaaagctccctctgactgtgtgtgctgaaggctgagtgctgatgccattgcttaattaatgttgttcatgatctccatttgggcgatttgtttagctccttgtggccctttttggacttagcttatcatgtgacattgacaaattaatgagaagtgagcatgtgatgatgcttggattaggacagaaatcacatctaggacatctcaggccctttccacctgggacctgaggcctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctactccctaaactgtattgacttttggaagtcaaccatttagaagagtgtggttttggtttcgatcgtatcccagcagtcttttctctgcccttgttaatctgattcatgatctgaacctgggctggctggaggctggccatgtcactttgcagaccatggacacccctgagtgccctcacagaaccagccaatggaaaagtacaacgtcttctggcttctcagccttgccatctccctctggcctatttgatacccccttttatattgagggagtgaaaatgtagcatccaaactgaaaacgcaggtttttctttggtttttataggaaaaacaaattggcatgaacactcagtcaaaccagctcaggctgtttgggcagatgcctttctttgcttttttctgtttattttcctacaaatcaatgcttaactgcgttgttatcggagcagagcaacaggtgcaaaaaaataactctgctgccaactcaaatgaaaaggtagggcttataccctctgggaggtattcagaagataacagaagcccctgccagcaactgaattaacagctctgtttacggtgggttttatgttaacaacctgctcctgaccctcctacacataaacacaccattgtctcagagagagacattcagccatccagacaacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgaggcctcaaaagcctctgtgatgttttacaatctgaagcttgccctattcttaatcatatctgatgggtttgataaaggccctgggggtcatcttaggcaagcttgtcttttgatcaacttgagtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattcttttttttttttttttttgagatggagtttcactctttttgcccaggctggagtacaatggtgcgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtcttttttttttttttttttgcacctccaaaccagctatggtatgtgggagtgcaaagcctttgacaacacagagcttaggagcatatgccttaccactgttcttggcagccttggcaatgtgtctagtgagaggaagagggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacgttatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagcaagcctatgcctattctccgggagaggaaatggcacccaggaaggctaagggacagcctaagtttgtcacgtcagtaagagcaaagcctgagctgtctgcctccacaagcttttaaccagtattctccactgggggtggtttttgcctcagggacatggtgtgtgtggagggggtgctgctggcatctagagggtaggggccaggggtgctgctacacatcttacaatccacaggccagcccccacagaagggattgtccacatttcagtggtggagaggttgagaaactctgcttttaaccactacctagggtggctgaggattcctcctctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgcgagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttataataaggtttttttacaattctcaagtcacatttgttatccacgatctcattccatctcaacagtcctgtgaggctgttggggcaagtgtcttcactctacgcctgaaaaactatgcctcagaggagggtaggactcggccaaagcccttctgctacactggccctgggcctcatgtgcccaccctgaggacatctttccctgcagctccctgcccagttggaaatgctgaccttctttgcttacaagcccaggtgagctcaagcgaactctgactcactaagggttaagccacacaaactcttttatgagtggaaaccacttaatgtgccctgtaaaaaagggcccctcaccatgctggctgctttcccttggaaagggagtgccagcagggagcagggctatgcacaggccatctttttgcaggaggatggtgatggggcagctgccaccctgtagtcttaaaggcatctctgggggttgggagaagttctggatgtttccagaaggtcatggtggaaaatgacgtcggccctgaggagaggggcttgtgggcatttggccacaggtggagaactggcccatattgttctgcaacatttattaaattctttttttttttttcactacttgccaagctctctatgtgcatgacctcatttgattcttacagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctgggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcatgataacacctgacgtgtattcgtgccctactttgtgccaggtgctcgaggtacagaaactcatttaatctccaatcaatgtacagacgaggtatgattagctgcattttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgtttgtgtgtagcctagttcaacctttaattactgctctctccccagcacctagaatagtgcccagcccattattgggctgataaatatttgttgaataaatgaatacatgaatatattcgtatgccttttgcagacccctcttctcccccaataggccttactcagaacaagaggagccgtagctaaattaggggaaggaatgccaagggctgaaaatcctctgggttggcaattgtaatcctgtggacattggtaatacccgaggatgcaaaatttccccaaaacaagcagaaaattttccatgaattgctgctataaagctgaattcctctccccaccccaacattttataaagagcaagtgacttttacagcctctgggtattgcccaatagcgatctggaaacaggctgctcttcgtttaaatgactgaacacacggttggggatctgttctgaaaggtggagggtgcccgcttgggaatagggacattataaatactggacaattgaagacaatatttctgaagtgtaaaatgtttgcattgttataaaataaacccaaacaggcccatggaagaaatctcttctcccaagtcctttactgaaaaaatgatcccacagactgagaaagccactttgacttaggtcagcttggaaacccactaaattctccaggtctctaacaggagaaaaaaaactggttataattgttaccagaaaggaaaaatttttttctttaccagaaatgggcagtgtctgtcagagaaaccaactgattcctgatattatcacaaagccagatacttgaagagctctattaaaatatgactgaggccctttgatgaccagcccagcctgtggcagatacccgcactgaggaaacttgttactgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaagaaaaaaaaaaactgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccagcccaaggtctgtgtatttgggactatttccatataattagatttttagattagattgttccattcctcccccaacccctgactattggcttcctctttagagcccacgttgtgggccaggggctgcttttgtttcgccatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggattgggtcagaaacatttccctttcagtctctcctctgagggtgttgtgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggcatctgaatgtaccatcttgtgaatgtaccatcttttaaacgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccacacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaagagatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttctggaattgagattaagagctgaggccagcatagctctcgacttctccttcccccagtggtccttagcattatgtgtcacttgaggtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgacagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacgcctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttggcaatttcctctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaatgcgtgtttcattcttcaataagccattcaatgctgggcttagagaaaatgcacttagcctctagcaacagaacacatacagcttctgcgttactttactcaaaaagcatttatcgagcatctacttcgtgccagatattgttctaggcaccaaattatagcagaggatgaaagagacaaaaatctctgctctcataaaatttatgttgtattgagtagaaacagtcaagaaaaaacacaaataaataaataaagcatagcatattggatgtgtagtaaagaaatatagaggaacagagactgctagagcacttaatacaataagggcatgctgtaaatttaggcagtgttaagaaggaaacatttcagtaaagaactgaaggatctaaaggaaggagccacacagatatacagataactgggggagtgctccatactgaagtgatgtgagagggtcctaaggtgggtgtgttccttatcatgcccagggaacagtgaggaggtctgtttgccagagtagaccggcaatagttaagaaatggtgaaacagaggtactggtgggccagatcacatagaggccattacgaaggctctagtttttcctttgcatgcgtgtgatggagatactagaggagtgacatgatccaacttctggtttaaaaggattcttctggctgttgttttgagaatggattgcaggaaggcattcaatgctggatataaagaaaggtagaaaagatgacccttatatccaggtctctaatacaatacttaaaaatgtcaccaggcagtaagtgagctccagtagttcatagcacgtttctccctgggtccagaaagcctcagctatttagtcacataatttcataaatgatcatgaaatcaataatagctaactactctgggaagattcacttgtcccaggaattatgataatgctatttacatatattattatattcatttctcatataagcctggatttatagatattatctccaattttcatatgagggaaatgaagatcagaaaagttaagtgactttctgaaggtcacacagctggtaataaggggtagatctggcattgtttacacacgtccctctttcctccctaccatccccaacgcaagtccatgttctaccagtaatatttctctagtttctcaggacgctaatgttttacacacacacacacacatgcacacacatagaggtttctatagttaaacagagctagttactgtaagacttctcagagtttttactatgataatgtgcattgtgaatctacaagagagggaaaaagtgtgcccacttccctaagcctatttgacgatggacacctttcatcaaaggagacctcatgaaaccagcaccccttaggacactcctaatctttaaaaattacttctcagaagaggcaatatttttcatgtttgggccgaataagttttctgataatatttctgcacatcaaacttggccagctttgaatatattccattttttcctccttgagaagaaatccctcacttactgacctgggcattatttatctgcgttgatgcatttctcagtaatcacaaagaccttgcaaagtgactctttgaaaactatgaaccctcctcaattttaactcattagaattatctactcaaaactacaggctgtagccccaggtgacaatttaagtttaaattacttacaattatataaattaaaatttaagtttctaatcacactgatccacttttcaagtgccgaatagtcgcatatggctaatggttattttatttgacagtggagtacagaacatttccatcatcagagaaaattccataggacagtactgttctaaaatctgacctgggagggtcgggtaagggtggaaaggatagtgatcaaagctaaccaacagtgaaataagattcctgggagccttagaaaccaaaggtgaccctgaattgtagagaacaaaaaataaagatccaaagcaaataactgtgtttgctggagtgatgacagtagctgccagtacaaacaggtttgatgttgtcagtggagccttggtgtgggaggatttgattattcttatctccaaaccccaaaaataccctacagtcattaatatgaattttccaaggatgtggctttttggtggataatattggcattaagggaagatgaccaaaatgggaagggaaatgaaaggtccccaaatagaaatggttgccactgcccactccgctataaatggcactaataccactttcttccttcttttcaagaacgacttcttgcataagtcatctgcccttaggcgctctttccttataaatcaattctccttcattactatcatgatctggcctctgttcacatcaagtcactgacaatgccctactggaggtcatagtcaaactcatttctgcctcaggaactttcctatagctgttccctatactgacaacgcactttcgatcttcatgtggctggttccttttagtcatgcagtctcagttcaaaacgttgctttcctgattgtacttgctttagctgcccacctacctcgcgttgcttcctattatattgtccacatttaatcttcacagaacttacagtatctgaaattattttttaaaattcattagtttaccaagtccttatgattttgtctctgaccaatcagcattcctggctcactggcttccctccacccaccaagttatccttaaaaactctgctccccgaatgtctggggaacctgatttgagtaataataaaactctggtctcccacctcccaaaattcattacttttatagtatttcttatccctgctagaacataagctcttggagagcaggagccagaaacttccatgttggccaatgtgttcctagagcgacaatgtgcctgacatgtccccctgaccccataaatatttgtagaataaataaataaataaatacataaataaataaaggacatgcttattttcaaattccaaggcctttctttttttgactttatgatttttgacactggtgacaccctaccccctttaattttggaaaataatctaagcccttgttttccgcaccaatgaaattcttgccctctgctttcctgagtattcgttcttcagttctttctcttcccattcttctgtctgtgttccccaagattaaatcctcagcccccttctttctccccattctttgcctcaaagtttagcctcttgaaaggtcagcctcaagaaacttcataatgatataagggaggtacagactgttttcttcctggtcctgacttcaactctaactggctggagactatgaacctgtcatttctccattccttagtttcttcttctatgaaatggggacataccttcttctcagtgttgtgggaatcaagcaaacagattctagcccctgttcatttcataatttttttttttttgagatggagtttcgttcttgttgctcaggctggagtgcaatggtgcaatctcagctcaccacaacctccgcctcctgggtttgagcgattttcctgcctaagccccctgagtagctgggattacaggcatgcaccaccatgcctggctaattttgtattttttttttttttttagtagagacgagatttctccatgttggtcaggctggtctcaaactctcgacctcaggtgatccgtccccctcagcttcccaaagtgctgggattacaggtgtgagccaccacacccggcgcatttaataattttaaagggtttatatgtgcaggcattgtgcaaagcactttgattttattttttcttgtaaccctcactctaacctcacgagacaagtttgggaaattgaggttcagagaggtgaagaattgtacctgagttcattctgctgatgtggaagagctgctatttgaatctctgcctggctgaaaccggaatttaggtcttaaacataatgttctattgtcttcctttgaaagcattaagaaaataagtaagcactaaacaaagtaagaaacttatttttgaatttatgatgacccaaagagaggtattaatatttagagtgtctagtatgggaatacaatgataactagtcaacatggtgtcttcaagtcattttaccctgtgttaaagggcataactgaccgtcgctgggtaaggactaagattcaaagaggatttgatatctgatctgccttaaaatcatagccccagagctggaagattatttggtacaaactcttctcataagagtttagagagcttaaagagcaaactcaaggtcacccaggctcttggctagaaggggaaaccagtcttcccactttcctcttcaaaaatcccacccaatgtgaatcttcttggccatggtccccccatattcacagggctcttccatcctcaaagcagagacatcttcagggaagctcctttttcctcctggactccatggtgataccacgcaactttcttgtgctgattcctcaaatccagccaacatcatcttccctctgggccacagccaagtcaggcaggaagaactgcacatcctagacattggtggaagggccgatgtatggaaccagagggaccatgtcagcgctgttaagaaatgatggatgcaaaagtcccagcacttctgaggaagggacacagagtgttcctggaatctggtaaaagatcccattaatcatcacttctgtcttctctcctctgcttcactgtgtgtatgtgtgtgtatgtgtgtgtgtgtttatgtgttgtatgtttgtatgtctgcctgcccttctctctcttgctctctgtgtctctttcagagtccctgttcctttcccatacccttccttcttcttgctcacctatccctttcagactccttccccctccaaacctgtctttccaggttgctgaaagacagagccaacaagaggacagtccaggaccaggaatggtgccatctctctgaaagcctcagcggtgacaataacaaatggtatttacctaagagttattaacacatcaactgttctctcctttactgtttagtcatgtcactcagcactaatggacttttccaatggcaaacagaaagagaagaaggaaaacaaacagtgcattcacactagatagaatcagtgatccctgctgaagctgtgaaaacagagggcatctcttaggtttgacctgaggacacgtctcacctggatgtggattgcaagattctgggcctatgctggactctccaccaaggtttcctatgagagagaaagcaaggagaagtgaaggacatggcttcatggtgcaagaaataagtgctttacttattcaacactttcaactatgaattgatgacaatcaaggttcacggcactaggtgctgccatattgcaccagacagactgaagacaaggttgtgagtggtccaagttcgcacagtaggtcagcatgagagctcatctcacttccagttttactccaccatgctgcctccattgatgctcattcttctctctctctcttttttttttttaaagacaggatctcactttgtcacccaggctggagggcagtggcataatcagggctcactgcactcttgacctcctggattcaagcagctctccagcctcagcttcccgagtggctgggactacaggtacacatcaccacaactggctaattttaaaattcttttttagagacaggggctttctatgttgcccaggctagtctcgaactcctggactcaagcaaccctcccaccttggcctccaaatccatgcctgggattataggcatgagccgctgttcctggctccattctttctttagtaaggaaactggaatacaggctaacagagtaaaaagcacaggcttttgagttggaacaactcttgttttaattcacataccttcacttacaaggtgggtgaccttggacaagtggcttaaactctttaagcctcagcttcctcatgaaaaagcagaggttctaagtgggagcttatacttatggggaagagaaccaaataactagggtattacattgcagtatgatcaataacggggaactgcagggagacagtatgcctggtttccaggcatggctgtaactctaagtagccatggaccctacgcaagttttaaaaacgctattgccttagtttctttgcctgtaaatcactgtaaatcaatagattggactagatcatctcaggccattccaaacagaaagttccaggaatttatgaaaataagtttgaatcaagtccaacatttctttaaatgtttatatctcagccacactatttaaaaatggcttcccttatgcccctagaacggattgggagctaaagtgaatgctgagtcatctctagtggagttttagggttgagtaggtgggaggggagtggagaaaaaatcagcagagcctggatccctggacatacttagccaattccaagggatgctgtcctttcggatctaagaattgtatccccatctgctaacactgcttcttggggacctggctcacaggtaaccatgaaggctgatactgattaagtgtttactctgtgtcagacaaagtgtcgcactttacctgtatttcacttaactctatgagcaaggtgctgtcattattatcatctttccctggggaggaagatactgagattcagaataattatgtaaatttcccaagtggcagaattaggatttgaacccagctcccaagcaatggcatttctttcagtgaaactcctaaactgctaaaggaagcactgcctgaggtttgaacagctaagagaagtcccttctttctttgagtctgctttcttagaaacaggaaggaagtagacttttgccaaaaacacaaaaataaacaggtccctggggcaccatgtgtaatttgaaattcaaaactcttgagagatgttgccttttcttgagtctggttggtcccagcaatgctaatgatggaatcacagattggactctcagggagctcctgcaacaggaataccctacatgtctactaagagtgttggtcttagggagtatgtttggtgtgtgagtgatgcaaagttaggatacaagatggcagaaaaaagaaaggtgatctctggtcctggcagccaggaaatcctcccccaaagcatggaatttaatttccattaaaaggcagtaatcattttcatttctaatattataacttaaaaaacctgatgtctgatcattataaaaaatgaaatatagaaaatacaaaggaagttaaaaaatatatactacaaatctcacaactaaaagaatcattgtatacatttggtagacaactttcgaggcttctagaataataaaaagatagatgattgaggggtggaaactgagagggtgcagtgaatcaagatttgcaaaactttgtatcagtcatattaatacattagttattcattaaaaagaataattgtacagacaaataattttataataatacaaactgacatgctatttaagaattaaaaattagccaatttgacttgaactcaacttgaagaaaaagatatggagtcaattcaaataaatgttcttttaatatatggtatcttcaagagatatgtgtatgtttataaaaataaaattatgaaaagactgatattggggtaattatgcttttacaaaatccattcatttttagataggattggttagctccttgctgtaaaagatgataaaattaactctcgtgttgtttttcatattttcctttccctacttactgatttgggttagtctattttcatttttattttactgagatttaaatacttttattctttttgacaaaatcaggaccaaaatcccaaagttgtttagtcttagatctaaatctatgtgtgtcaaatatttgctacctgttctttcacatttattactcatcttgtacttctttatttggattcacctcttggttggccaggtttcataatgtaatgaattcttcttggttcctcctgagtttacattcttctcttctctctttctgcgagttctcagtttatatggggaactatgtgattctgaggaaactagctctttcttcaactccagacatggaaccactacccaggctgagcagatcacatctttctgcatccttggtgagggttatctatgtgacctcagatggtgtgacctcagatggaacaatcagagtgaatctc

SEQ ID NO: 269 - DNA, 171599 bp, Homo sapiens
ctcatgttcttactcttgggacacttcccttacagccctgcttgtcttcattcaatgctcacgtaggttaaggttcccagttatcagagtaggggacagaaccggcagtagatggctgtttggaaggcaaagggcacctgacctatgcaggagatgcttctattttctgagagtcttgatccccaccccgccacctcctttggtgtctggtgaccactatatatctttcaagcatcacttccaatgtcacttcttccatcccacctaggagaggctctttctcctccaggctcctaatttccactcaccactattatacctgctagctcattatattgcatgttgattttttgttctcccacgttcttctttatgaacatctttataagtggccatgattcattcttttgcacattagtttattttaaggctttatgaagagcccacatttaaggcctatttagggtgattacaacaaatgaacgctgaagccctttttttgggcatcattacactatttctgattattattggtgcctccttggaaaattccgactttttgttatttcagttacaaacacatacaaaatgtgttaaagtaattataaacccttatatagaaaatcattatttctaacctacaaatatatgcaatcccttatatatatacacctttcaatatgcaatgcaataatcataggatcttgcatatttaggttttggatttataaacagtgcacatttactacctgtttaatatggccaggcattgtgccagccatctcagattcaccatttcactgacaatattaaactctcaccatagaaaagcatgaaccacctacgtataagtaatcatacatttcttttttgtccctgtataaagtgaatattgaccctgctacagggaaggatcctagatacagtcatatcacttgaattacatcccaagaaaaggattttgcagcttctgaacggaacttcctcaagcttagggctactttttcttaaacaggggcaattgctattcttgagataaaccattttgagttctcatatatagataaatgatgcacagtgttgaggagagagaaggaaaaatactgttattacatcaaactaccattccacattttacgaagaatgtcctacttgctcatatactttctcatatggctgaagggtttcatcacaactacaaccacctgtgtagctggctgtgcttccctttataactgcgggtaaactgaggctcagagtgtctagataattggcctgaggtatcagagctagtaagtggcaaagcacaggattgctgccttcagagtctatggtttttgtttgcttttttaaggccatggttgatcaaacagaaacagggccagtgatagctttatgtagagggaggtaaaagttcagcaaacatagaaaattttcaattatactacagtgacacaaaattacttacatggtatacgaaataacacccttaaaaagcaaatgcagactaaactgctaacgtgcatccaaggagaagcatctacatctgtaaagatctagcatcaagtgttactaacttcattgtctgtaatagaaactaatctatcaccattctaattagaaggtgactaaggaagtaagcatttaacaaaagcatttgtaacatttgcagattgtaataataactgaagttctggaaaaagtcaattttccaattttcttctcatttacgtatctctcactcaccattagtctcagttcttagataaaattattgacattatttcttaaactctttttttaaaaaaatataataatggtgatagacatttgaagaaactttgcctagaacaagagtttacaaaaatagaacagctcaaagaagaaaaaaatcactatacactctctcctcagagaaaaatcactgctaccattttggtatacatcttcccaggtattttctgtgcagagataagctttgtccctaattagcaccataatgtataagctcatttattcactttttcacttaacatattaagatgatttcctctatcaggctggtattctacaattttttttttttttttttttttgagacagagtctcactctgtcacccagactgtagtgcagtggcgtgatctcggctcactgcaacctctgcctcccaggttcaagtgattcccctgcctcagcctcccaattaactgggattacaggcgcccgccactatgcccggctaatttttatatttttagtagagacggggttttgccatgttggccaggctggtcttgaactgctggcctcaagtgatctgcccaccttggcctcccgaagtgctgagattacaggcatgagccaccacgcctggcttactgtacaatttttggttgcactgtattctattttatgtaatgccatgatttatttacagatttccattttgctatttagaccacttaaaactttttggtttttatgagcaacattgagctattcatccttgtacattaactgctgtctacctctgtgtctttaggaaaaattccaggagttggatttgctgggctgagaactttgcacaatttaactctatattggtatcaatcctactccaaatcaccaacttagactcaccagcagtgtgctcacgtggcttctgcttggcatcctcagcaaagcttagaattagaatcagattggccaatttgattgttgaaaattacactgcatgaacatttgtatttctttgtcattgtttgtgttcaaggataatttagatttcagtatcattcaaggaaaatgagtaagactggaattcagctggaaaatattctggctcctccttatggtatggggtgctctagaaatccatgttattattttggcagataaacttttccttaaacttgtaatatggaaacaatatttctaaacttgcagtacaggccagtctctaacagattacatttatctcaaagaaacttgagaggctattctgtgtgtgtgtgtgtctgtattcagaaacccatttccattccactttaggattctaagttagaacctttccacggggcaaaggcaatgttaaaggactgcttttgtgagctgcctgaactccatggtcctaaagattcttttgagcttgaaccttctctgatttttgagcatcactaataaccttgtggtgagaggcctgcggacagaaaaggcctacttcctaggccatcattttcagttatagcttagctggcatcacggaacatgaaactcgatggaacatttggggatcagctagtacaacttcttcattatgaataagtgaactgagactcagagaaatgaagtcaattggtgtgctacacccattaactcgtcatttacattaggtatatctcctaatgctatccctccccactcccccgaccccacaacaggccctggtgtgtgatgttctcctcctagaacttaaagtataataaaatatatataaatatatatatatatatatatataaaagaagtcaattattttttttaagatctcaaatctaatcatcgatgcgttcacgctttaaccaggacttcttagtccaagtttctttagtcctgggacatatttcctctcataaaagtaaaagaaggccgagtatagtggctcacacctataaacccagcacttagggaggctgaggcaggaggatcgcttgagccagggggttgagaccagcctgggcaacatggcgaaatcctgtctctgtgaaaaatgcaaaaactagccaagtggggtggcatgttcctgcagttccagctactcaggaggctgagatgggagggtcacgtgagcccaggaaattgaggctgtagtgagcctaatcgcgctaccgcactccagcctgcactccagtgagaccctgtctcaacaataaaagacgagggcttaaaaatatgtatttttgaagttaaacacagtacagaaaaaatgtttgcatagaggtgaaagaacagtaactaacctaaggaacattcctgcctagcaccctcagaaagcccagtgggaacctcccttatcacaaccctccttccctgatttagaagtaactaccattctgacttttgcattagtcattcctttgccttttagttttaccacctacatagctttccctaaacaaacattttttgggcagccagcatgaacttagcagtgtaaggaaagggtatgctctattgccactcggaaaccaacccacgatttcaaagctgggaactttgataatggtgatgaacatttcactctctggaactccagttatttgtatgcttcttctagagtgctttgcttttatcttttcttgcatttcttttccattttttttttctgctgcatttttagatttccccaaattcccaaacattctgctgaatttttcatttctgccaatatgtttcaatttgtaaaagctctttcttctctgaatgttcctctgtagctctctggtcttttttcatggatgtggtgtcctctctgatctgaggctattcgtaagagtttttcctttttttaaaaaaaatccatcttgcatagtctttttttctcttggtcgtaccttccacaaaagaggcttttctctgatgctcataagaacatcaagctggatgggaccatggagcacatggtggggctggccagcattgatcttgatagtaagaacttttggaaagctctttgttgagatgacaaatgtattttttattatggtaaaatattacacgaagtctgtcactttaactatttttaagtgtatacttcagtggcattaagtaccttcacaatgttgtataaccatcactactatttcctaaatttttccattgtccaagactctttgtgcccattaaacaataactccccattcttccctcccagaagcccctggcaaccatgatctttctctttgaatctgactactctaggtacctcatataagaggaaccatatagtatttgcccttttgcgtctggcttatttcacttggttaagttttcaagggcaatccttgttgtagcacctgtaagaacttcattctgggccagaagtgttggctcacacctgtaatcccagcacttgggaagctcccagcacttgggaggctcccagcactttgggaggtcgaggcaggtggatcagctgaggtcaggagttcgagacctgcctggccaacattataaaaccctgtgtctactaaaaatacaaaaattagctggtgtggtggtgcgcacctgtaatcccagctacttgagaggctgtggcaggaaaatcacttgaacccaggaggtggaggttgcagtgagccgagatcgtgccactgcactccagcctggacaacagtgagactccatctcaaaaccaacaaaacaaaaaaaacttaattctctgttatggctgaataagattccattgcgtgtatatatctcagtttgtttagccattcatctgttgggctgttttcaccatttactgtaaataatgctgctatgaccattggtatatctcatgttaatacaagtataaagttcatcttgtataatgtggcagaaagaaaggtgggatacaggatatgtagttttaatgttgttgttgttgttgttttgagacggagtcttgctttgtcgcccaggctggagtgcagtggtgcgatctcggctcactgcaagctccgcctcccaggttcacgccattctcctgcctcagcctcccgagtagctgggactacaggtgcccgccaccatgcccggctaatttttttgtatttttagtagagacggggtttcactgtgttagccaggatagtctcggtctcctgacctcgtgacctgcctgcctcggcctcccaaagtgctgggattacaggcgtgagccaccgcacctggccgatacgtagttttaactcaagtttaggagttcagaattgagccttagggaatgagtgagggatatccccaaaggattttttagttgtgtcatgatggcacctttaagaatgacaaatgagcagcctaaagaacttggggtgtggggagcagggggcattggggtggggtggtagtagtagatgaatggaacctagagaccagttagcagctgatcaacagtccaggtgagagatatgagggcttaaagtaggatggtaaaggaaggttacatgtaatggatctttcacactgcaaaggaaataaaggagttgaaactaaccccagggttttaagcctgtattacttactctcttacctctgctatgccaagactgaataattaatgaacttgagaaagaaagatattatgaagtggttaagacttccattatctacaaatggtgtatctagtgaaatttactattcgactctttgaaatagggcaactccagcttccaagaccactttcaaatatacttaaagtttagagctcaacaataacagaccttgaccggatgtcaactgaactgaggctgacatcagtacatgtgaaataatgtgtaaccccttctaatcagagagctgaacccaacccgtcatatctaatgaatggcagatctctgggagagaccatcatttgctgagggggtgattcccagtgactgactcaatgacaatggcataatcatgagagctgttgagggacctgaaataggaactgtttccatggggagccactcccccacacttgctgggcttcagagaaaactcggaaaaaaactgatgtttcaaatttatcttagcaaagtaacctttatcaatgtgttcattcattcatacaaatattgagcaccacttatggaggcactatgcttggatgtgggccatctgtgagacccatggcacgcagaagagattcattcaaagaattgggcagataaataaaaatgacaatcatgaaattttctactaaaaatgttgctttgagagtgtataatagggaaagctgatctgtaaaatcaggaagggaacatttgagctcaaacctataacaaaatttggggcccagtaaaacagggctgagaatagttccagcacttcaccagtgtggtggaggcggacagggatcacagagtaagcagacacactgttgcatctgtggctggagaagtaggtggggagcagccagtccatgcaaggcttcgggccaggttagaagaattgaagcctttcttggcaaagaatttatggctaagtcctcaaaagcaattgccacaaaaacaaatattggcaagttggacctaattaaagaccttctgcacagcaaaagaaactaccaacagagtaaacaggcaatctacagaatgggagaaaatattcacagactatgcatctgacaaaggactaatgtccagaatctataaagaacttaaataaacccacaagcaaaaaataaccccattaagaagtgggcaaaggacatgaacagacaattctcaaaagaagacatacaagtggctaataaacgtatgaaaaaattctcaacatcactagtcatcagagaaatgcaaatcaaaaccataatgagataccacctcacaccattcagaatggctattaaaaagtaaaaaaaaaaaaaaaaaaaaaaaaaaaaaaaaaaaaaaaaaggtcaggcgcagtggctcactcttgtaatctcagcactttgggaggccaaggcagccgggtcacctgaggtcaggagttcgagaccagcctggccaatgtggtggaaccccgtctctactaaaaatacaaaaattagcccagcatgagtggtacgcacctgtaatcccagctactcagaaacctgaggcaggagacttacttgaacccgggaggcagacgttgcagtgagccgagatggtgccactgcactccagcttgggtgacagtgtaagactccgtctcaaaacaaacaaacaaaaacaaaacaaaacaaaaaccagaatcgtggtgggctgtggagaaaagggaacacttatacactgttggtgggaaggtaaattagttcagtcactgtagaaagcagtttgcagatttctcaaagaactaaaaatagaactaccattcaacccaacaatcccattcctgggtatatgcccaaaggaatataaatcattctaccataaagacccatgcatgcatacgttcatcacagcactattcacaattgtaaagacatggtatcaacccaggtgtgtctacccatggtggattggatagaaaatgtgctgcatacacaccatggaatactacacagccataaaaaagaacaaaatcacatcttgtgcagcaacatggatgcagctggaggccattattgttaagcgagctaatacagattcagaaaaccaaatgctgcatgttctcatgtataagtgggaactaaacattaggcacacgtggacacaaagatgggaacaatagacactgcagactacgagatgggggaggcaggcaagggttgaaaaactgtctattgggtactatgctcgttacctaggtgctgggttaaatcataccccaaacctcagcatcatgcaatatacccatgcaacaaacttgcccatgtgccctctgaatctaaaagttgaagaaaaaaaaattaaggtctttatactacaagcgatagaaagccaaaaacacattttaagcacaaggatgagaagattacatttgtatttcttgaaagattgcaagctacagtgtaagggactgaagtgatgtgagaacatgagtcagtgagctactggaataatctaggtacactgccttggctagattaaagagactgtgaagaaatgttattggcaggctgggaaaatgatgggcaagaaagacactggtgcccaagtctcccaggtttctgactcatgtaataggatgaacagaacacccatatgaatgttgtttttattcatagctacttctttgtaaggtttattcttagaattgacctcttgttatcaagttagatgtcttttagtgtccctgaaattttgtggcattaaaccacatgacggtgttctgtaccagcaacagtggagtgatgtcgagatagggcacgacaaagcccctcggagccagtctttctgctgtcccatccccatttcctgagcagagcatatgcgtgcatgcatgcgtgtgttaatagccacactcatgggggaggatcaggtccttctgtcaccctccttcagagcttacacagctctgataagaaactatttgtcaaaacaaatgtcatttctgagaacacaattttacatgcaccgatggcctgtcacaatttttttttttttaaatggaacagtccaattttacttcatgagtaaatgcccattaaaatacagggccacctctatggcaacccaaggcagaaacttccataccggttaatttgaagcagtaagaaagactaaaaaaaaaaaaaaaaaaaaaaaaaaaagcacttaatggaaggaacgtgtaacactcatttgtaagttagaagcaacttcaaattcacactccagactccatgttgattttttaaaacaactagggtcgacattgacttaacagagcaatggatgtgctgggaagagatggatataacgaaggaaatggatgacggggacagtgattgttaaaacaggtcatgagattgcaggctgagcaaccctgtttcatagcacagccttgtctcttattaaaaaaaaaacctaaaactttgaggatgagattcaatgatgtattttttaaagccttcttaggcaaccaaatatttaaatatatctgctttgttcccatcttcaatccctcaaagggtacagacactgcatactgtatactctgtggggtttttttttttcaatcttgtaaagacaggatatctctaccgtgcagctgaataaggcctttgatgtcatgcaaatattacttctggactaaacacatacaatactgaaattattaaacatacaaacttagagctttcagtgcatttgccatttttatttcgctatgcagaaacatacattcaccatgggctgtgatgcaggtgatcgtgtaatggagaatctctctttttgaaggctatttataactaacactaaatagttttaattacagtggaaattctgtacagtttaaggcttggctctgaactagaatgtaaatatggaccagatttgaaaataaaacactttcttttcaagtaaaagaagaaaaatcaattaaaaaatacacggcacggaaaaagtaactaagaaaacaaagccacaggaagcccagcagtttctcctgaagtgaaatttcataatattgtaaactaacaaaaatacaggttttcttcccaaaataatgacaatttaagctctctggattgaacacagaccaaagcaaacaacaaggaagaaatcgcattaatatgctaaaatcagtactaccttataacaaattaaatgagatacacaaagcaagattggaagcattacatatttccagagggtcagagagtcattactgtttatgggtgagagtaataaaaccagatgaaacaagtacaagttgtttactgaataaacttggttattggcacatctaatctgaggaaaatctgacacaccggacggacctagacagcttctagcatttgagggtaatcttcatttattgtaaatataaggttacctaagaaattgcaattttgtttagactttaataataataaactatgaaaggcatgaattgtttatgtgttacatgagaccacggtttatattgttggttatgaacgtgcaggtatagctgaaaactgagacattttgtgaaaattaaaaatgctgctcttttgtaattttatcgttgcttcatgcattatcggtttagtgatgctgaatcagattgctttattatgggaagatctctctgccagtgtctttattaatggtcaaggtcaattcttctggactgaaattttccacggacagatacaagtcagttgggttagaagagggaactccatataggctctggttttcctaacggtttgcatgactgcattcatgtgcaagctaagttattcctgcaaaaaagacatttgattagttactcatttgaaaacaactgaaagattttctcagatcaaggacacaaaaaaagtatcctggaagttagaatgctcgtttggacaagatgccatgacattccagcgttaagtcactgccaattacatgctttctcttaagtaattacaacaacgcccaagtggctgaagctcatggaagaaatctgttttattttttttgctatcgtccaaaatatattattcatttgagtaaaatgagtattttttatatttctcttttaagagatgccactcatcaatttgtttcttaaaccgatgttagaaaacttactaatatatgaaatctcttaaacattttatcacatcaccaagttgtgcaagtcgctcgactgctgcattcagcattcaaagccctctcagaaacgctcatggccccatgagatcttgcatggcaggtgactatgcatgacaagtctgtgctcacatagatgatatagtctgctcatgatgctggccaaacagtcactggaaaggtatgtgctttctacaggaccacaagactgcattttttttgcctccttctgagacagtgctacgctagggagaaaaatcatcccaaagaatacaggaaatataagacatccaaaaagaaagtgagtgctcagctttcaaattaaaaaaacaaaactaaagacaaaagcataaacaggttacaatcaaacacagttgaagagaaagcttacgacgggataatgttgccatcagaaggagaaaggggtatatattatttccctagtatttggaacacacaaattgagcctctcagagcaaaactgcctttgttccaattaggccacatggcaagtaaaatcaaatttgccattacaaatttggataatcaaagagtgcaggccatggaataaaagggaacaccaggaagaccacacaagcatagaagcatagactctgctcttcctttatcctctaactggcagtgcatgcaaaaactccacaagaatggaagctccaaatgtgagacaaacccataaaccaattctccatcctcttggtaaccagcccaacaaatgccagtgagagaacagaggaaaggagggatcaggtgaaggatgagagggaagtgccccatgcctcatgccagcctaggcaagcctagagaatcggcatcacctcttacctctggtcaatcctctccatcttctggtgtgatctctgtctctttatggaccactactttggtcactgacatgtcagggtgctgctctttggcctctttaattgcctgagccagcgcctatccccgggaaatcacagaagggcagaaacaaaaaggaggtggaacatgcatgatcagtggtgaggtggagacttatgagctagatctatatccacaatttacaaatgaggtacaatgattacaaaaggaatcataaatcatatattggaaagttaattcggaattttcttcggaatacatgctggactagaggaatagcattgaaactgtaggaccaacaggtttttctttgtttctctgccagggtatttaccgtctcacacacactacctggtcatggtcaatgtctgcatcccccgtgatgactattcgcttctcaattcttgtctctgaaatgccccctttcacagtctgcaagacacgtagagaagctttatgaatttactcactgggagaaaccatcatggttcagtagggggaaatggccgaagatgctgacatcattcactcttcgagaattgaaattagagttctatggcacttatttcacatttttaattccagaggtgaggacggaatggaggcccttgggtctggatggcccatgtttctggaacactaccacatgccaagcactggagtaagcattaagcttaggatatcagaatgtatattcctaaaggggaactcgcacgtgaggacaagtgcatcgtaaatctaggggctgtaaaagctccccttgcagctatcccggcgtcctgagcttcaagccaccttgtgcttgtgcagcccaacctgtgaggagttctgaacaagcaccttcctccagctcgctctcaaggaatcctcttctcggttctcactccacttactttggtgatgtgcgtagtggtggtggtactggtggtttcagatgtgatcgtctgtgcactcatcagcacgcctggctccagatctgtgcctggatcgacctaaagcagcagaggcatagacccctcatccaggtgctcacatctgctcttcagaagttggctacgttatttaaggcattacgacaatttcactatctcctattatgcaatcattatgctcttcagagtctgagcgctgctcccaagaataagtactaagtgcaaccacaggtaactgtcattaaaaaaactaaggtttcagaaatgtgagtggtggatgggtgagtgaatatttttctttctctgtggctagggaaacaggtttctgagcctttttctacacttcaagacacataaagacttggttaagtcatctgctgctccctgatcactaataaaatgaccattattgcatcacttttaatagaaatggtctggctgctggatcctctaagtctcatgaattaaatatcgtgcagttctatgtaaacacactaggccatagaggggtgaaataagcagccagggctctggtcttcacagaatatctcacctgtgatgattcatatgtgatggttttggtttcggtgtgaactactggcacttccttcgtggaaatttctagctttactcctcccggtgaaacactgccaaaactgatggtttccgtcttcaccgttgaggactgtgccaaaggggagtaagcagagtggctgttatagtttgcatgaacacattgttttcttccttttcctctcttggtggttataagcacaggttagtatgctataaatgtttatgtagagagtaagctggggaatgaggcatacaacatgcacatgtcagtctcctggactctcatagcacttttatatgaaatgctccaagtaaagcaaaacattttgaaggcaataaaaaaaagttttctatttaataacttcttagaaagaagaaactaataatgagacattaactccccaaatacttcaggaatctcaataaaagaggataaagaataaagttctggcatttaggacccgggtaaacatggttttggtgcttctggaaaagtgcactgataagaaataaatgtatcacattttctaatatcttggccaactttgcatttcccaattttactgccaattataataatttcagtgagagtagaaaccatttcctggtgccatattattaataattaagagatatgtttgcatgtgacaccaaagctggaaatcagtgtggagactcctactaggtatgaaagaaggaaatgagaggagaaatacactatacatgggagaggcagaaaattaaacttagctccacctttatgctgatctaaatttccaggcatcctatatcagttttattttagtgataaaagtaacatttactactagttacctcaaaatgaggtttttgttccaaagtttctgaaatgtggatggctgcactctgctcctcttgtcgctcacgggaagcagcggctgtctcttcctgttccaggacagctttagcgacctcctcccctccttcctctttagccccctccgtcaaggcagagccctctttccctttaatgcctgtgaatgcgggctgtgctgcagcatccccgctgtctcccgccgagtaagaagcatccccactcgcgtgcaccacacgccgctcctccaccaacacggtctcctgcaccaccttctcagtgctaagcggcaggtggtgcacggtgggttccgtctctattccactggactccgtcttggtttccattttctgcatgggaagagattgtggcatcagtgtgaccatccataaaccaaaggtcagaaaataactaaagctgccactcgccaggatgtctaaagccagcagcaagtgcttataaccagaaacactgacgaaaaatataaattagctttcatttctcccactgaaatctctgatgcctgcccctgcccctggtgcatgcacttgaacctgcgctgctgcttcaggacatccgcaaaacaaacggaaggcaggataaagtgcaattaacaaaacaaaaaccaaagcattgcagcgcattcacgttggttttggctgctttcttagactcaactggtgagacataatgcttttagatatttaattctattaaaatttctcaatatgatcgcctttcgaatagtgaagtacattcttgagatgcaactaaaggcatgtgacagatatgccaagcagacacaaaggacaataagtgaagacacctttgagatgttgaaggcaaagccagctggatgcaaccacacactcacgcccaaaaaaagggtaaggaaaggcacatgggcacattcagaaacaccaaggacgaaaacaaatggccacctgaacccagctttgagaagtagaagtaacccctcctatgaattctgttggttttcgcgcagactctaataaactgaagatttcagagccatccatgagcttttccccagaagactgcttagtctgagtgaacaaagagaggcagagtcaagcacaaaagagagacacaaactcaggcacataaacattcacagcttgttagacaaaatcgtaggcagaggagacagggaggaggaagaacgaaggaatctcagagtttggaaacgaaaagaatgggaaataaaatagaaaaccaggtgctcttgtttggtaaagcagagacggttattaggatcagggtggcgccgatttaagcagatatatatattttttccccttcattgcaagccacagcagcactatcacatcttgggaacagggagctggaaataaaatggaaagtgttttaatgctgactttgcactgcggtattgatttaaccatgaaaaaaaattaagaagctgggttggctgctctcaacataaagccaagcagcaagagaaacggaaaggtttggggtggaaggggactgcctcaaaaactgtcatgctggaattgcaaactgtggccccaatgagtgacactggttaccactactcgggaggcggatgactcagtaacgtaatgggcagtagcaacggtaaaggctggttcctgggaatatctccattcggacaggctcttccttcggggaccaaagaggcccacttttaagacctcactctcgggcacttgctctgttttgctgaagcgtctgccttccaggccagggaggacggccacatccttctccagctgtggagccttcttgaggtcatcttcttcaggactctgccggcgagactcggcctccttgatgggggccagggattcggacaatttccgctgtgtcgtctggacctctggtcctctcttggatttctcatcagcgagggtttccaggacctcatattctgccaggccgggaatgatcttcatggactctggtatttctttctccattttctgaagtgcttctgtagtggagggctgctccactttctcaccctctttagctttcccagtcatagtaacaattctcccggagacagtgtcataggattttcctagagtgtatattttctgtttgctgtcttctttcagttgcatttctcgagccaattcttcgaagctttgcattttaatagtgccagattttaacatgtcagctgggagatcaccagttttactgctcacggtcaccaccttgtaagtcacaatctttttcaaatcaccatcaactacctcagttggtattctgtctacaataacccaatcctctgtgccctatatttgaaatataaaagctaaattagaaattctgatggtatctcatttctaaaataagaatcctttaagaaaatcagggcaactgctacatgcaggtctgtgatgggaccatacagtgctcatgttattatctaataattatggctgcaatctcttctcctctgaaatgataaactataaacttcagctcagaatacattcggtaggtagagttgcaacttctttaaactggaacatactttgcagtaaattttttgaagaacagatttgctcttatgataaattttggatcattttatatttcaagattaaataacattattgatgttgctctataagttacttagctttacatgtgtggggataaaagttttcctcgttaaatataatctatacttcatatactgttatcacagagagcttcccaacattctacaaatttatgtaaatattttccatatttgtaaattgtatttctttatacagggaaatgaatccataatagcacttattattcaataaatattgagtgtgactgtgttcaaggcattgtaatgaaatatttcccacaaataggacactattagagcctcttacagtgatctgtacagtgttcgagtcttacattttttttttaaaagatggggtctccctatgttgcccaggtcggcctcgaacccctgggctcaagtgatcctcccatctcagcctccccaggagctgggactacaggcacatgccattgtgcccgctccaatcttatttacaactgaagttcactgtctcaggagtttctctctcactttctttagtgttagttccaataaggcaaaagaaaggaaagctaagaaacttttgtattcagggaggcataatacaatatgaccaggtaggttaatagcttcacagattacagagggaagagatatcaaaccaggagcaggtgagtgccctggtttacattttaaactagaatgttttctagaaacttttctgttttttacagcctgaaaacttaaatctagaaatacgtgtgcctttaaaaataccactacagattgatctacatgttgttgctagattaaatgaaatgaattgaaagaataacctctagggttgatgggacagttttctggaaaattatttgacgagaagtaaccacagagtcagcagagtctccttcctgcattttctttatcacacttggctagtggggaaaccaataagaattcagaactttcaaaatcagtcaacttcatctaaattagcacgactctacaggtaaaaacaggcagtaaaacaacatttcagcaagattattatcagaaagtaagtcaatgacaacatacagagaaaaatcagcttggattagaagccatgaagaaatgatgcataactgataactaaaatattaagaaaattcaattttcccttccccagaatctaaatcaaaattatgtacctaccttggttttaaacaagataaatgttaaagggaaaataaaaactaagagcattttaatgacactgaagtctgaagaccaatttcttctggaaaatcctttatgtttggtttttacctgagactcaaggaatggagcgcttccttgctgcaaaaatataactttttcagaaatctctgtttcttctttggtctgtttgaataaagggggttgggttggagaagaggaagtagacagtttccaaaaaggcaagttaggaagggagttctttcattgtattatctctatctatctatcatctcatatattctcataatattcattcattttcttcctgaaggagtaaattattgtttatgcatttgaaaaatgatctgaaactacctcaaaatttagttttttccaaagagctcagattttctgaaactttggggttaactttggtgtttatataactcaaatgttcttcatttctacaaacacagagcatacaagaacaatataaaggtattcgttcttggcatttaaaccatgtttatgttggtatcaaaaagtgggtatttaaaataaaacattaagaaatttttaaaaatttaaaatttctatttctgacaagtatcttattgtattccccatttaggtgctgcctgttacagagtagtgaaatgcatacaatgtcactgcattagccactaatttaaataaacccagttatacttagatggattgatttattgcccacaaataaagaaaaaatactcaatggctttatttgaacttttataacatggttaataattttttaaagtcaatttcaaaatatcttgctggaaaattaagtatatcaattcatactttaacataaaaaattaagaaatattaagtatttcatgttaggaattaggtttttgctttttaacttctttttatttttttctctagtattaaataggcacaattcaggtggcaatacattagctaccaagcctaagttgaaccaagcgttcaacttcacagagcagggacagaaaggatattctggaagattaactgaaaaataacgatggaaagttcaaggtttctagaagaatggaacttttaaaatacatcttatcattacaaacaatgtaattttatgagagctatttaaaatttctttttgtctaaaaatctaccagtactacatttaatcatttgtttgcaagagattgtaggggaacatctggaatattctgcaggacctaccctgacagattttgatagtatcattctcaaatgactctttctaatgagaaacaagccattttcagaggaggaaaaaaaaaaacccaacaacaacaaaaatctctatcccactgcattttggaggacggtattggaaaagataaaatgtaccatgtggaatcattaaatgtggattttgtttcttttccttttttttttgcttttaatcatagcctcttttgcaaacagaaatgagaaacaggaaggaaaggtcaaaattataggtacttttcagaataacagtgctaggtctctaattataatcactgagctaaatattattcctaagataaaagcttcacaaaacccccagcgaaacagtggttttcagcatatcctggtgtctgaaaccaactaatttaaaaaatgcctctgtcttataattgaaaatattaacagtgtctacattccaaactgtgtatgtccaataacataaacaggtaacatagggagattttaaaatgtaattctgtatatggtcaacctcccaatacagttagcctagttaatagagaagtgaagaggtactgataaagaaaaggtgatctaaaaattcacttttatcaggggttaggatatagtcagatatatagcccaaccatttcatttagttacttaaacattataagttattaatcttaatatcataattggaaaacaaggccctatactggcgcacaaaattcataacagtgtcatttcctgttgggtgattaaaggtttctacaaataaaatttagggaatgggtaaatttgcaaatacagaatttgcaaatcatgggaactgactatagtaatcatctagctcaaggaattactgtacagtgaacacgcctgtaaaactatcactcatatgaaagagaggacaatatcggcgcagaatacatactagcagatactgcttttttactgtgatttggaaacttttggtattcaagtaaccactaaggaatataactctaacatggacaaggcttagatgcatcatgaaagtctgtcatgggaaaggtctgtggacagaggatgtacctggcacgctgtacataccacatgtctacccttcctatgtttggtgggccctgtgtgtgggtttatttgcctattttctaaagcaaatgagatttagatattatttgctgctttggggcatccttgctacttgtctgctgttaactcaaatatctgaaacttgaaacaatcggcaatcaaattttccattttatataggaaacaaacataaaattctcagaacataacatcattattagcttgctgtatataattctaactataattttctttgaattgttcataaattggtagcattttatagaaataattattataacaatttaactactatagatacaacagtataaagaaaaaagatggtaacattaaaactcaagaaatctttagtttttttcttcaaagtaccattttgtcactgagaccaaaaaaaaaaaaaaaacaacaacaactaagctttgggaagtcataagtttggggtcaccaaatctaagtttctttctgattctgacacaaaataaccactactttattagagatgtcaattttaaaaattgagttaaatatttccatttggaagtaactggatttctttctaaactggttgactactgtttaattgaagtaggctttattataaaatagagtaatatcaaattagtaacttattttaaaaaatatcccctccaaaataaaaatcgtttggttatatatttataaaccagtatgttttctatgtgcataacatacaaacaattaaaaaaaggataaaattatcttttgtgcttttcacacacaaaaataacagaagccatggttttaatatagaaataggcaataatttagagcaaaagaactttctggtttgttctgaaggctacctacagggccctcaattggagtataaacttgatgtcatcgatgactatgaggtcctggagaagagtagaagagaggacaggccactctgcctggccctgctgccatggggagcacagcaccctgacacctaaagagatcccttttcccctgggacttgaagctcctttgagatgcttttcagggctcctttgataagcagggttaatcagccctgtttctaacaagttctctatatctagtcaagctctttctgctatgtctccattcacagtgtgacggagcactgagggactacaaaacaaccctgcagacgctgaaagcagtgagtatgccagcctttgctcttctccagtttaaataaccaaactgctttgccattctgcagagggcatgtttttcttccttaattatgctgaaaaaatcctttcctggcgttctccagtttttctgcactaacacagaaaaagcattaatatccagggaaagttcagtatattcaaagtactccttaaattattaacatccttgggcttatcaaatgttaattctctaatgtttagggtattataaatgtaaaaaaaacatatcttactagtctaatagcctggacttatgaagttcccttgtttatcagcaccaccctttaaattctctaagttgttccctaaactttcattcaaagtggcgatcacttagcatttagttttgctctgttttgttttgtttgggttggctatttagtttgtgtttttgtaacttaatccagtatctgatatctttagagccagtaaattatttccaaaagaggtagtagaaataggataagccaaacttaaccaattacaataaaattcatgagagcataactgaatattgtaaggactattatatttaaatcaatcaatgtgaaatttgtctcttgaaactcagtagtttgaatggaactgaagtgtaatggtacaagaatatggtggtagtcgtacttttcacttattctgcataaaagggtcctttttaagtcattcaaatggatatagacctatttcttattagctaggtttgggattgtcatgaacatagtgataatgagttcttgattacttttgataaacagctttcaaaggtttagaacatgatcaacaataagtgtaattgaattcttatttttactgcaaggacttaagcactgcatatagaccactgtttaaagaatttttctctcaccaaagcctaagttttaatgttccattctgtgtcagcttcctgaacagatatttccccataaagtggtcttacagaaaaggttaaccaatacaatgctaaaaaagatgcagttttcaaaaactacttttgttgaaacagagataaagcaacatgatgtctaacagtagacagtcaagttagcactacagtaatttttggttcccacacaatgggagccctgaagtaacaccagctgaatcctcagagtctttggttgtacatttaaaaagagcttccttgggaggctgaggtggtgaatcttttgaggtcaggagtttgagatcagcctgaccaacatgttgaaatcccacttctattaaaaatacaaaaaaattagccaagtgtggtggtgcctgcttgtagtcccagctacccaggaggctgaggcaggaggatcacttaaacccaggaggcggaggtcacaccactgcacttcagcatgggcgacagagagaaacaccatctcaaaaacaaacaaacaaacaaacaaaaacaaaaaaaactatgtctcaaaaaaaaaaaaaaatctctttaaatgtacagccaaagagtgtgaaataaccttacttaaaaaaaaaaatttctggccactactttccccataaaacatctactaggaaccgattataaatttggccaggtgcgatggctcacgcctgtaatcccaacactttgggaggccaaggtgggtggatcacttaagacctggagtttggtcttaagtgggaaaacttaagtggtcttaagcccggccaacatggcaaaaccccgtctctattaaaaatacaaaaattagcccggtgtggtgaagggcatctatagtcccagctacttgggaggccaaggcaggagaatcacttgaacctgggaggcggaggctacagtgagacaagatcaccccactgcactccagcctgggtgacacagcaagacactgtcttaaaaacaaaaaacaaaaaacgtaatataaatcaattaagataatcagttataaataaaaatcaaataaaactcttgttatatcaataaaagcctggtgtaatatctcagagtaaaattgtcctgaaatgctatcaacttcaggttaccatttagtcaaacaatctcaatgggcctcaagcaaaagtagaaagcatatgcggaaaaagtgtcaatgcatgaagagaataccctgatttctctcagctataaatctaggtttatggtcagaatcagctgatttttcacgatagtctccctgtggcttcccgccctaagaaccatctgatgctattactcactcctcagccactttaaccattttattttgcagttttctgttggagcactgagcatctcagctcaggttaaacataggtaggaagagagattttctacccagaagactgtcaaatgcaattccacaccctgtagagaaggaaggcgggtaaacagaatacgagtctgaccacaaacctgactactgacctcttcagggacaagtggttcgatcatgggggcatcctcctgcctggcggccagtcgcacgggggaggtggaaagcctcttctcccattcattcgttacggcagtgtctgttgaggtttctaagaaggttcttttcagctcgctaatgttggtttgatgtttcatcaggtcatcttgagttttttctagctcctatattcagaacataaagtatccaacagtcaatgttttacatttgtgttcctttcagctcttttgtttgctttaaaagtaatgtcaatcttattagtagtcaaaataaaacaaaattttgatcaaggctcatggcactaccacaaacactctggtgaaaatgtgattttcccatggaaaggaaacagaaaaaaaaatctagttcacacaaacatggataccaaaagaattttagaaggcaaactataaagagtacaattcacatgtatcctgagagaattaaaataaatatacacacaggaaaagggatctatatctaggagcgaataacaaatcagaagctgagaagtcatccccacttattaatggatgagcacacagttcatgcatcacaatacgagcccacaggtattacactaaaagaaaaacaacacacacagacatgcactggtatataccaataccaacctctaacataagattactatgtttgacatacacattttcaccctttattcgtttaatcagactattctgaaaaaagtggagaagaaagggaaaagtaaaggacacagttgtcaagggaacaaatgccaacctacacactgcaccaacaacatggtaaccagctacagagcatgctgaaagatctgaacgctgtagacaaacaatgacttatcacacactgttgttttgttgttgttgttgtttgttttatttttaattttctacctgtgccttgagctctgcatcttcctcctggtccgactgccagcatcaagaaagagtgggaaataaagtcttacatgcaatttactctaagattgaagaactatggtctacatagacttgctaaatgtgggcacgtgtacgctcttgcatatggatgccacttctttcttatacacaaaccacaacattctcacacacaattaggaagcttaataagaatataggaatataggagtggaagaattcttgcctggtgggtctttggcattttgaccagcagacacacgtggttgagaaggtgacagcaagggtgtggcaggttgttcttgatgaacattagaaatagttcaggaagtggggggagccagattaaaattaaaatttgtaagaatagctatgatgacacaataatgagagctcacatgtagtgtatgaatcccgccctatgaggttagtgattatgattcccaatttgtagaccagagaacccatgctcaaagaatatgaagaattttacacagaggttcccacattttaaagtttcttgagaccttgattttcttttcttttttcttttttttttttttttttgagacagagtctcgctttgttgtccaggctggagtgcaatggcgtgatctcggctcactgcaacctccacctcctgggttcaagcaattctcctgcctcagcctcccaggtagctgggattacaggcgcctgccaccatgcctagctaattttttgtatttttagtagagacagggtttcaccatgttcaccaggctagtcttgaactcctgacctcaagtgatctgcccgcctcagcctcccaaagtgctgggattacaggagtgagccaccacgcccagccaattttcttgaatgtatatagttaaaaacaaatttgggaggggagaagacaaatatggggcaactaagaaagtttttttttttttttaaaagaagtcagctactattaacaacagcatgatttcttttaaaggttttagatgggacaatttttgaaatttgaaaaaatacagttatcccaaagccacctcattctcctgatttttctaatttcaaggagtggtctaatccctggactgctttctgagtatcagtaattagtaagcaggccaagccacatgtgcatgtagcagcaaagctgtgtctctcactatggctcttggactcaggactggggctttatgcccttgtgctagaagaggagacccagaatgaaattctaggtgagaaaaggatcacactgagtcaggtgccttaagaaaatcatttagtctatctaggtctccctcttcttatttgccaatgggacaagactgcttactcttcatattctacactgaccactgttgtgctggccacctatagatgggacagagtttcatcagtatcacggggcaaacaggaaatttaaacacagtgctaatgtgctggtgacacacccattcttcagtgcatagggggttcacagctcttcattttatttttaagcttcaaagcctacctatgttataggtactcccttgcatgctttaaatgttacataatacattttaaaactactgtagaagtttaaggtattattattaaaatatttttcatttatagcacacattaagattccaatgaaatttactggatgtactaccctgtggctacatgtaactaactcttataaaatcaaggtgtagctttgttatagttggcaaagaaaattaccaacttgtaatagatttatatatgattgcttaaaagaatctgcataatagttttaacaatatcatctttaatgttaaaaacttatgattttcaagctttggattgaactctggcatttctaaaggaagaaacctaataaaacgccatcgcaaaagattttttctgaagatattttcaattaagtgatatacagataccacttacaatatttttagttttttctaaataccaaactagaaaatattattataataggatgatgcaaaaaaaaacatataaacaacctaaaataaacattattacaaagtaaaaactaaattctgctagtaaaaagtagccgaattaacatcaataaatgtcttgacttccattagtacagatattatttttaaagatattttaactacttaatggtagagaagatttgaaaaacaatataagccacacacacacatttaatgtgtttctttaaccctaaagaaaaaaggagaaataacagtatatcttctatcactgtttaatgtgattatattttttaaaaataaagtactaacagtaatttaaaaattcatttcttatgagtgaccgaggctacagtcaaaggctacaaaaatgagtcaggtaagtcttattttaacaataattatttcaccattggggaattaaaaatatatctgtatcaagccaaaatactagttaattgtgaccttcttcccattcattctattatacatctgtagcctctcatttgagatagaatttttttctaaaaaaaaaaaaaatgtattatcagtctaggcaagtggttctcaaaatatgtcctaagatgtgcagagtcaatatcgcctgggaacttgttagaaatataaatcctcaagtccacccccagctcttctgaatgagaaacatgaggctggaatcctccaggtaattctgatgtaggccagagtttaagaaccactggtctagacaacaaaatacatatttaactccaactgttaaagttagaactgatctccattacaacagctcatatgtggagttcttaaacacagagccaccccacaaggcattttcggtatgccactaccagccactctcagccaaaataccaacctcagtggcagtggtctccccgtcggctgcggtgtccgtgcgctcactgtcagtctgttgaccacagaagtgatcaggttccaggaggaaggcagggacagaaagtaaaccatctggttaaacacgctctggcacaggtcagacaggtcattttctttctctgtgatttctctgtgtcacactaccttctcacaagaacacaagttcaagcaaagcaacagaagggccagagctaggtgtcatcaacagagccaactcataggaatacctgaggcacactcagcctgcaggagctggggagccacactgacctgtctggttctatgtctcagggaaaccgatttgtcatccccacacccttcctccaacttttaactaaaaacctcaagcaacatctccttaaaatgtttaatgcaaataaaattgatgtttatatatattttattctagtaatatttcatatttgaaaggtaaatgaaaatgtcaatttacagaaaaagctactgtaacagtcactggactttcagcctctcatttataccattatgataatttatatccatctagggccatcaggctgtctgcattacctgtcaattataaaaggcacatgccagtgactcacaggcatatattttttatgggaaaaacataactcaattttcaagtagcgtcgctaactaggtattttttaagactaaatgttatgtttattttgccccaccctccaatataaagaagtatattaaagtatgtatttgaacatcttgctccaaaaataccattcaaatgaagcaaataagaagaagaattgttaaaacaatagacagagaaagagaaagagagaaacatctacttagaaacaaataaaacaaagcacagcatttgacagagcctaggttttgaggagaatgagaacagtaatttcaggactggtttttaatctgtttcacaggggtttatggcttaaaaactgttttctctcgagtagagtagagctgtggacatctaaatgccctaatattaactgactttccctccacagatatcaactaatcattaataaagttcccttgatcaaatatctgtgattaatattttgaaaacaaaaatgaaaatgggaggcgagtctatgatggtgaatctggttcttaaaataacctcccactacaaagaacaagaaatgtcaggaaggggcaactgggacagtgttgtttccactgacaaaactaaactctggctatgctgatttcttggcactagccacatgtttcatgttacgtactcctaaaagaaagggaggctgaacacatgctcagcacatgtacctgaggacaccattctggcacccttgctaccaagtctaagtggaaaataattttctgtaggttggtaaggaaagcgtgttgacccattttcatgacctgaccggcttggttaacaactgggggcaggaggtggctgttaattttcatataaaggtgattgttgttatgggattagtatggctgtaccgagtgacagccctgggaaaggccagtttgaattagtaagagagaccagttatttgttcaggtgtacagaataactcaaagatcttaggctttcaagaataaataagaatgacttgcacttagtgttttatttttttagacagggtctcgctctgtcaccctggctggagcacagtagcacaatcttggctcactgcaacctccgcctcctgggttcaagtgattctcacacctcagcctccctagtgggactagggaggactccctatagtcctagctgggactataggtgcatgccaccatgcctggctaatttttgtacttttagtagaggcagggtttcaccatgttggccaggctggtctcaaactcctgacctcaagtgatccgcctgcctcggccccctaaagtattgggattacaggggtaagccaccgcgcgcccagctcgaatgacttgcatttagtgttctaattagctgtgtcaaacacttctaaaatttttgaaagtgcttctcctcctatttagcttatttcccttgtggttttaaaatttacttcagtaacttgcaagcattttagcattaggggacagtggtcgttaagagggaaaggtttaacgtcagatgaacatgagctcaaatcctttctgttcaaacctgtggcacattgggcacttttcatattttaatctcagtttccttcccataaaatggggaaaataacagccctaactgtattgggtaatggatagtaagtgctctatataatgcctgacacactcagagctaaaaaaaaaaaaaaaaaatgcctataacaattatattatataattattcctatttttctcagccatacacaaatagcatagtccacatataaaatttcttgaattcctacttagcatttagtcagtcagtcagtagtatagtgcctgatcaagagtcaataaatgaataaggctgaataaaacagtttttatagcaactggtatttctataatgtatgatgactacataaaactgcaaatatataacatatcataaactatcatataatactgtttatgtaatttaaaatgttataaatcagttaatttttcttcctctttatttgaacttatctctatttttctttgtattatcaaaaaattactcagaaatacacatgtaattgcattttatggtttggggaggtaagttcatctcatgtttcttgataggatattttgatatcctgccccttatttgaccattctgaaagtacaaaagaaaaaacatgactggtcaacagctttataatgtgaaatattgaagcctttttatactggatttcactcttagaaaggctggaaataagccaccataacatgttaaaaaagtaagcaatgatgatacaatatttaaaaagaattaattagtagtgacttggcaaaacgaaagtgacaaggctgaattgtatgttaagaagtcactcagtgtagctgccacagtgcttgaggcctagagattaaatcaggccatgtaagcaaatggcaatttaaataaaacagaccagaatgacctcaatatgagttctctagctcagcctgaactagaatgcacagctcttaacacttcaagagacaacactgaacagatggctagttacagagtctgatggcaggagagctatcatataggctgactagggctgcggagaagggtgatgaagactccagtggtcagtgctaattcatggttttggaggtttgcaataacaaggacagttatgactgggaagctccaatcacacgttcgctagcttgtaacaattaactgctgtgatttgttttgccaatgtaatgcagacatgcccaagtttaacattaattctcatgcactgattacaacaagatgtataccctggattaggcacaagatctgtgtggtttgctatataaaagttgaaatatttattttgaatttagaaaagcataaaacagcaatcttttctgccttatgttagcttgatgactaactcgactgttaaaggaaaaatatatctccatgttagaaatcagctaataaataataacattgtatttgtagacaatattgtgttcttaactgtaatatgttctagtccaacactatttgataatattgccaatatgagaaatagtgatattaaagcctaggatttcaagtagttctcaaaatattttccatgtataaaaagttatttatatatcagttggagcaaatcgttatatataactcaagaaccttgaaaatgtctcttatgcaaaatctattaaaagtgtagacttttacttaaaacacctgtgagaccattcacatttttttccttctgctgcaaagaaatggtcataattccactaaatatagatactcgcacaccctcaacatataatactatatactcacaggtgcagctcaaattatgactttctagctgagcacagatttagactttctttccttttttagcattgccttgactttgtgactttaaaaaaaaatgctaagcgtattttgcttttttcctatcacaacagctcttgttctgtgggaacaggagggctgcagggagcctggggagaggagtggggaggggcgcgcatgacagcagccagggcctctggtggcagcttctattattcttccctgcactctatttgaagcctggagaaagagaaactgctgggctgttcactgggctgtgtggcagtgggaaaggagaacaattaacaggaaaaactactggctaccatgtcagctcgcccaattgctcgagtcggggacaggagcctgccctgcagcagcatgccttcaaggatggaggctgatagttcagggtctttcgcccactatgtccatgtctggctggcagccatagaggcccagcctcagcacactgtgaaaatggggggattttgagactcatactgcagttgaaagaatcgctgtcatattatctgcattggcattgctagcatggtgaaatttcagcctgcctttacattgtttgaaaacttcaatttagtccttttctgattgtgtctgaacactgctgcactgcatgccgttgcttctgggcttgtttctgcccttaccaatggctgatgtcatgtgggtgctttaaactgctctgacacaatacaatgcgggatctgattgactgacctctctgtgagtaacaatgactgtctggcaatgatgagcagagggtggtggggacatttcaggatctccagggaggagatacctttgcaactttagaaagctacccaggtgatgatgatacatcccctccggggatgcactcttccacctctccttgactgtcatttaagttgaaaactactcatcatctgtcttatatgtgatttaccttattaaaccataactgatcagaacctttagcttagccctgatcttttacacagctgacgggttatataaaattgacttctggctgagtctttcatcccacgtagaactcagtgggtagcagaacgattccgggttgggctcagactgctacatccacatggtgttgtgcctaaccctggggcccaggttggactccccaacacacagaaacctcaacatattggcacagacaataaatgaggctctgaaagtaggaccactatggcagcagccagctaacactgtttcggactcaagcacggaacacgaaggggaagcgtgttctatgccgaggtacacacctcttcctctgaactgtcactcgggtcattgtctagggaggcgctcaaggaggccgccttgggctccaggtagcagaggcacagagccagagggaaggagagagtgagagcgtatggcactgagaaggaggcagacagcagaaagaaaaagatgaagaggaaacagggcacaagggacggtgagcggatcgggaggtaatgctgcaagctctggggcaggaggttggtttcagaaaggttggggaaagagaggtatccatcatcatctaggagggaggggaatgactcagggagctgcaaggagaaggagaacagggtggtccccttgccagtttgctgtctgtagctaaaagccacatcttgatcccctaggtaaggcctccctgggccatcagagtccaaggcgggctctccaggcaggtgctcagctctggacggctcataacctggcagtttgcagtcattctccttacacctcctacggagctctgtgggagatgtgggggcacaatgggtggatgggggtgacaagggacatgagtcagtgccaagcccaggtgactgatgtgaaagagacagaaagagacagaaagcagcaaacagaggtgcaaaaggacaaaaagaaaactgcaattagttaattttcttatgggtatcaatataaaattgtaaaacaaaaattttagcactagggttgctcatgaatgttaaagtattcaagctgcatgccactgttgccacgaacggctacatttctcccatgagactatcacatacaggtggaattctttaaaaactcagaacagaaggtatttgtgggcaatcccaaagtctacacatttcacatggtcaaaaaatttccctttagactaacaactctagaaagtttcaggttttggggagcaaacataagtaaatctgataacttaacatgaagactttcaatagccttctcctgatttccaggtagcagagctgttactatagttcagctagattaaaaatgaagatgaaatccaatccagattttgattaaaaaaaaaaaaccaatctctagcattagtcctttccctggttattcaattacatccaaaacaaggagtttacattccaaatcaagaagtttctggccccactcctatctgataagtagttacaatcagggattcgacagttagcatttctgaatatctcactcctcagaaaagaactgaagttcccttgaaagctctattttggctcctttatttaggatattagtggaacttcaactgaagtgatttcaacaagctaactagcaaaaacaatgtgttttcttgtaacatgctttgccagtatttactttctattatttatgatgcataataacagaaagatataatttcccagccttctgatttttcttagcagataaagggcatatttagatctttggtttgagtccttaatataatgataaaagcagggttttccacaggtgctcccctggtgagctcaagcttttatggggcaagtgaatctgcttctcctcctctctgggtcctggaagtctccacgaccagggccagtttcctctgcaggtggcggaggggttgctggacaagaaggggaggaaggaaagcacgcaagccccaagcaggacctgggcaggtacagcagctgctgcaggccgggaaatccaagcctgaaagtaattagacttctgctgatgtctgtgtcactgcgtgtgtgtatgtgtgtgttttgcccagtggcctgacagcatggaaattacccagcctgccttgtgtggttatgcaatcctgacttggggagaagtggtaaatatagcgacagaaagaaaatgcacaaataaagttacatctgaggcatgagggaaagaaaatgcacaaataaaatcgtagctcttcggcctttgaagggtctctttttacgatgagagaagtatgtcttttcccacacatttgcatttgacattaaagacggcactttaaacaggaacctgcacaaatctcattcaactaagaataatgtagctgctacacattaacttctgcatgaagacaactgtcctccagcatggaggtgaggcagccccatgacccaggggatcccagcctgggaaacgtgcctccttcccaggcaacctaggggaccagcctttcaagaactattttcagtaatacactttcattttggttgaaaagtaagtaccctctgcgttactttttgaagaaggagaaggataaaattaaggtttaaccttccatgctgattattaaagtcatttctagaagacagctttgcactggggaaaccaagccagcccacacctatatgagcaccagatttcagctacagacttcctgaagacattctgcccagagtgctggcttctcagagactcaggctatgaggctggtagtgtcctttgtcttttcccacatcacaaatggcaccaagtgaggacagcttagtgctacgttttatataaacaaactggtggtcttttaaaagcaaataaagtgaaaatgtccggccttatcttgggagcaaaactaaaaatcacttacattgatgtgtcacttcttcaatacttatacatccatgggaatcttatgttggcatggcgagtttataaaatgttagaataactaagaagaagaaccacatatttgttttttgggtggattatattcttttctgtcccctttaaagccttccttgactgaacagacaggaagagtgtaaaaacaaaatttagaacaaagcacattttaacagcaaaagttatcgaaatatccctgccattatttcctactctctgcttaattttgtgtttgccaaataaataatcttatcccaaaaaataaaagatgatggattgggccatttgtaatattttagcataactacaaaaattatttgtctatgttaagatgtcactgctaaattctcatcaaaaggaacactttccatagaattcggggtagtgattctccatctctatttgaagagcccatgtacaaaagatcactcgtgaatcaaatttactcaaattttaggataacccatgggttattatgagcattttcattctgctatttcctcttactctatgctctgtacaggccaggagccactctgtttttcccttattattaggtataagcctcctgaagggttttttgacttttaaattatttttctgaaaagttgctttgtagtgctggatcaccagaaaaaaacatagtgtttaaaaatggtgttaaaaaagatatttaatttggggtgaaacaatgttacaaagtttaatgaattcaacactgaaagaagaagctgctgccaaattccctttttatctcctgttgcaactttctgccttaagatcccttttcaaaacatggccagtcactactctgctgattaggcgtaagtataaatatgtaggctgtggtcactccatgtacttacagtcagaagaatggcaatatgataattgtatatctagaaaaatatgctgtacttgggtaggagaatggggccagaaacaaagaaaacagctttagtgacagttctgaaatgtgagcccaaacagaaaagtgtaatacgccaccaaaagtatttttaagatacacatacaggacagctattgaaagtcttacatagcacacaagttattaaaataaaaattttcaaagagctatgaatgaacctttcagagaaaaaatgttgaaacagcaatcataatttaaaaattgacatatgaatgtgaccagtgctgacatatgatttatcctaaatctgagcacattcctggtttacagcctcagcatcatttagtcattcttaaaagctggagcaagctcttgcaggcagtctgggagctatacctttccctcgtgccggatggccgagatgggcgtgacttcttcccccttcctccgtttgtcctcttcctcgtcccgctcctcctcagccttcttctccggagtcacagtggtgatcaagttggtctgagagatgccttttgttgtggcgtactggccagtaccaacctctgcagcagacatagaatccttcatgtatatttcatggttttcattcactgatgctaaaagcaaatacaattaaagaaataaaatccaaaatagttaggtcagaagacacatgaacaataccaactatatctttactgaaaaaaaaaataccaacacaaaataccaggtttgccttgaaaaaacaaatcagtgctgcagggaccttcatgagagcatgaccttcctgtatttcctatatgagtgctttaaaattcgtgaaatgctcatgtcttggaatttcatctatcctcagactctctgctgaggatgtgtgtaagtgtggaggtgagtggagggtcatgaggcgaggctgccgctgggcatattatcaccattggctggcactggcaccagtctcgtagtggccaattccacacctaacagcagtctttgcagtacacaattgctctaatacacttggctctttggaagtgccattcaccaaggagcactgaattggttttcatattattattattaatgttgaaaagtctatcactcttacagtataaaagctccatgggtaataacaaatattaaccatcttggtagagattataaaaatcagatggcaattccattcacctaaagtacagaaatgttttcatttctactgcattttaaacagactaccataatatgcatatacatttactcatctctaatattttgggaaaacacaatgaatgttgctaaatgaaattcatgcaaatgcaaaacatgcaaactcaagagaataagacagagcctttcatcccagctaaaacgtcttagtgaaaagatgcttaattaagttttaaaagttggtactcattattttaggttttagatataaaatttattaaaacttataaatgttgcttttcaaatacacagtaactaatcacagacaaaatatctacattattattttaggaatttaaaaacgtaaataaaagaaaggattctgaaatgaaatcctctctgaaatgctttcgatagctaaactatgtcactaaaatatcttcactaagacattttatatctctttacaccgttgaaaaagctcatatgagacacaacttcctaatggaccagttaggccattctctgtgagatgcaaccttgcaaaaaagcagtttatgttgcaacatgcagctgtgccacccagctcaacagcagcagaaaacatactagagctggcaggaccgcaaggagtgagagacaacacatactaacatcacttttgggcagggagaaagagacagcatgacattagtacactgatttcacaattgtcttctgtcttctcagcagtcattatcacactaaaggtcataaggaaaacaacattcacaacaaatgtgttccctggggtgcacgtcactgaacaaagtggatgatattcaggaaaaaaaaagtgcgattctacaaagttcctcaaatactgataacatatagaaataggtaatagagacactctaaaggagaaacaagagtcaataggataaaccagaaagaaaagcttcaatgttaacatcgatatttcaatatcttaattcagctcgaaacagtcctggtaattattttattcaaaagggctggctctaagttcggtattctggaaactcttagaagacacacaatggcaattaacttcctaggctagctcacaaaagcctgtaagaataattatgaatataaaatgtggtatatatacatcatggaatactactcagtcataaaaatgaatgaaatcatgtattttgaagtgacttggatggagctgaaggtcattattctacatgaagtaactgaggaatgaaaagccaaataccatacgttctcatgtataagtgggagctaagctatgggtatgcaaaggcacagagtaatataatggacactggagactcagaaggcagacagtggcgggggtggtggtgacggataaaaaactacatattgggtacaatgtgcactactcaggtgacaggtgcactaaaatctcagacttcactactatacaattcagccatgtggccaaaaaccgactgcttgtatctcaaaagctactgaaattttaaaaaaatgtgaaaaaagagtaattatcaatatgattattgagataattacctatgtaacaagagtgctttcacatatatcttgcttttcacaacagccccgtcaaaggcggccttattcctattatacagatgactaaaacagacctggagagctgaaatcatttgtcaaccaccgcagagacagagggcagcagagcctggacttcaatctggatttacccatgccacaagagtacagtttccacctcgctagtaacatacataatatagcactaataatgccattttgatttcttctataaactgttcataaagtattccattagaaaaagacagttgtttttagttgggagattcaaggagcacctctccccatcaatcacccggctagtgaaatggggaaggcagagctgagactctcaggggaacagtggcaaaaaaggtaggaaaggagatggtaccatgcacttgtaacttttgtttatttttatttatgtttttccttattatttaaaccatacttgcataccagaaactcctaattctttttatttgcacaggataagatcttctattaaaaacaacaaatctccaggtgctccaaatgagaagacagagacctagacatgattcagttccagagtattgttacagcgggcacgccttgcagcagaaagtgtacctccatattacttcagagagcaatcaagaaactgttcgataaaacaaaaccctactaaaaattcactgttgtgttatcccctaaaaaggtagtttgaatgatcatctctccatttgactaatttaacttggcagtacagaacccctacctagcactgttctcccagtccatctggggtagtaattagcacaactaggagaatttaacttacaaccctgtgctctgttatttgaatgtcatcctttctaccagctattatcaactgactgataaaggtcacactttattcataaagattttttagaaacagaaataaatttaacttatagatttataaaacaaatggtcttaaacctaccaatcctttaagacctgttggcaagagaatcaaatcacagagtatgtgactactatatttagaatgagagcatctttctccaaattcagggtgtcagcttatgaaagctattttcttcattcccgaagtgccattcttttatgtaattttacataaacctgcagatgttagactgacaaagggactttcatttcgctgggggagacttaaaaatgtgccattcagtcaataagcaacaactgcttttcaacatacaatatccaggaatatctatacttactgaaagctcatgacagtttcacattctttttggggtaggtactaggttattaagggccagtaagcgatgcctacctccatccaagctgcgagacatggtataacgtttgctggatgagcgttcaaagtaaggtgctgggcgatctatcaacgcactggctcttctcgtttgcgcttgtgtcctgccactataacgaaacttggaacccaaggttaggaatttcttgggaggtgcttctggtaacagtagtctaaagagaataaagaaaaacagcagaaagactattaagtccaatattgagagtgctttttaaactttttactctgagaggtcatgtgttttgcatgctaaacatttaacgcacaacttgcagttaaataaatctgatttcataaaagaatgcatatagtatatatcaactagggatattgtagagaggatatatgcaaatgagggttgtactgaactagatgaatttttaacattccacgcaaagtggacagtctatggttctataagcccaaacagctactaaatagtttgatattagtgaagaagaagagtgacaatttggtgttgggtgcctaatttgatgggtctcgtaccatgcataggtaggtaaagggattcagggtattgagaaatcactgaaatagtaaggaattgaaatagtaaggaatggattggatatttgaagtggacaccctaaaaataatgtaaacacactaaagatactaaagaaggggggtttgggacatgtaagtacatgacaaattagggaaaatccttcaaatttagtctttttctagttctcttaggatttcttatcaagaaatatggtgacaatgaacttgaagggatagaaagaataaaattccatattttttattgacaatctttttcagtataagtgattataattattccttagggaaaaaacaaaataatctcttcctacctgaaaaatgtatgatgctcaacacatactttccataaacgcttggcagctcgatggtttggcagcttaaacccaatggtgctttcaaattgttcaaactaaataaaaaaaaatacattgaagagtaaagtttaaaattataaataacagaagccctgtaaataaattacagaatcatgatgccaccagaattttaaaaatttacttactagatcaattgctatatgcataattcatgctatacagattcatttgttaatttcaaaaatgtgtctttaaaatgctgcaggtataaatagccactttatgcatacagtaaaatgtcttctgaataagtgtgtatcttatgatacaactgaaaaccaaacacgaaaaggggtttttttgatttcttccagaaatcaatttgccctgatatcacttttaaacttttattttcatggtttctcaatgacacaatgacttcaactgcaaggtacagaaatgaacaaaatgtttacaaatatagtctacagcattcttagaaatgagacttttctcctaatacctgggcaggaaatatgtgtatttcttaggtagttgataacttggtgtcagagattgctgattttatttgtgtgttccgctatggattatcgtgttaaatgctaacgtctctctatatcatacgtaagatcagagattgggggaacatattttcatatttttcagcatgtacacttcagatgatgccttatcagccatttgatttttcgaggtgaaatactcatctcatttcctgcataatatactttattactgcagatgcacaggttttcacattctgaagaaggtacacatcagaccaccagagggcaatcatcttaaacagtaaaggcttccccaaagagcacacaatgggtactactgctataatcaatagcaaaaatcatttatatggcaaagaaccgaggtgaggggtcatatgcatggcatgtgagatacaatcatgtttgacctctatttcttgtttgttgaggatgattaggggaagtgggaaacacatcacaaatgcttcaaccgcaattgcctttcccaacttcttattcactctggatgttcatgtgcagtggtgtttgtaaaaatcactactgtctaagggactcagccaagacagacatagtgtggcttgtgactaaatcatcatccatttattcatcctgcaactaatatgcacatattacgccaatgccaggggttatatggaagagtcagcttgcactctgctgcaagaagctgggaagagtctctgccaacctctgtaggcaaggatgatgcaggctcctagactacctgaataggtattaatagtttattaatatctatttctctgtgttttatatcaatttctttcaacttcttcagagtctgtgtgtctccaatttcttctcactcacttttctcaggctgtaaataggattgtaaaagcagagagaagaggagtgaaaaaccagctctctctgagcctgcttatgccagcaccacaaccccatctcactcctcactgctaaactttaggaagcagaagccacgacctgctgcctctgctacctactcctgacctcaacacacctggcaggtgctcctgttgcccttctgaactctgaaatgtcatcatggggcctgactgttaagttcaacacacttttgttagtccacatcctgcgtgccctttctgtaacatatgatactgctagctaaccactttcctctgaaactcatctcctggtcatccatcagcctgtttcttcttttatttctctggctgtcatttcttcagctccttggccctttctcaaatagtggtattatccagagttctagttttgggccttttctttctctaacttgccttgctctttgagtaatttattccatgtctaaggccttgaataaaatatatacagttgataactctgttcaactccttcctatgcaagagttactccctgaaaatctgtttcaaagggatttcagttgtttttctgaaattttcccccttttccctcctgccgaatgtcatctccattggcttcaatcatgcaaactgaaaacctttgattatcctggacttttccctcttttaattacttcctctatcctgtctctacgacctgctgcttctgcctctgaaacctctctcttgcatttgttccctcccgtctattcccacagcctctgccctagtttaggtcttatcacatcatgtttctaagtcgttgaatttcattaagaaatgtatcattccaaaatattcacctagttgtgtcacatcctgatttaaaacctcccatgacttactagttgtccactgattcatttctctagctctcccctctggcatctcacaatactatgctcactccatgtctacagaatatcatctcatttgcatcatgctgttacaatcaaagtatatgagtccgtttttctgctaaatagaaaatcccttaacaaggaacaaggtcatatttgtctttagatttctaatgtctgacaataaataggtgctcacttaacaaatgttcaatgaagtcaaatgactatctattggctataagtttaatatacaatctttaggaaatatttttaaaacactataattttagttatttacatgaaaagcttacagattatttcagttatcatagataggtatgatgttatgttcatactaaacatcattacatgctttatgtttcaatttttttgttatttttgagacagggtctttgctctgtcacccaggctggggtacagtggtgtgatcaaactcactgcagccttaaatccttgggcccaggtgattctcccacccttggcctcccaaagttctgggattacaggcatgagacaccatgcccagccgatattctgattttttaaattgcattttccaccaagaaactccagtagagaagtagattttgaagataagagataattctatatcatatcagaaaatgttcagagatataagtatgctagaatctttgagctttgactgcctctgttatactaaccataccaattagaaatttgaggtatttattaactatctcttaagtaaataagagtagatatgtgttactattatgtacaaaccactaaggaagatataaacgtaagttgatcatggaggctgttgtccaaggagtaaggactagttaacaattctgattgtctcattagcttctctgacttaaaacaaacaaacaaacaaacaaacatatattgagctatagaacattgatataattcacactaattgtcctttgttctaatattccttgtaccttgaagtacaggacctctaaactgttcactttaaagtacaaccagatttgcaggacaaacagaaagagcatggagaaataacaacagcatgtggaggaagagatttatccattactgcttgaaatatacacaaaattattaatgatactggaatttttttttttttgagacggagtctcgctctgttgctcaggctggagtgcagtggcacgatctcggctcactgcaagctccgccccctgggttcacgccattctcctgcctcagcctcccgagtagctgggaatataggcacctgccactacgcccggctaattttttgtatatttagtagagatggcatttcaccgtgttagccaggatggtctcgatctcctgaccttgtgatccacgcccccaccccgcccccggcctcccaaagtgctgggattataggcgtgagccaccgcacccggccgagactggattttatattaaaatatgtttttaaaaaccctccaattaacgtatgcagtaggaaatattggaacaatataataaagaagagaatatttattactgtttattgggcaaacctacaataaactctctcaggcacttagatgtcattcactgtgtcccacaatgctcagaactcataagcagataatttaaatgcttgcttgctatcagggatctttcctcccaacgcacaggcaaatgtgggtatacttacctctcccggccggatcttaatgtaaaagttgttccgtttgtatgaaatctttagaaccttgggccaggcaaatctgtttattcgcagccggtcgcgatatatcaacagaccacttgcacaaactcctaacataatttctaccccttctgagtcctggaaaataaaagcaagaaacaacagatcagtatctaacttatttccattttctgctgggtaaagtatttaagcatccacgacagaaactataaatggctggtttacttatgcaaaatgatgcagccatttttaaaacattaccattaaacattagccttttggtgaagatgtttatcactatggagaggtttgttagaataaaatctgctctcccaggtgtctcagacttacaaagtaaatactgcacaccaagagggcccagctcatgaaggtatgttaataacggtaataatagtagccacagttctcacttgtcaattgccaggcactgctctgctttacatatattaactcttttaatattcactgtaattgagatggtcactattattattcccattttacagatgagaaaataggtacagagttccagctgaacacagcctggttccagaggcagcactcttaaccaacacgtatgctaacaagatggaccctgtcttttcctatgagggttttggttgttgttcctttaaaaagagccccgatattttttatataccattattgtcagagtaaaatttaaatacgaaatagtttttttaaaagtatgaatgaataaaaaaatgtaagaatgtattttccccaacaaccgcccttccctccacacaaacacactgcccagtggtaatcacacttagcaatatggctcacatatataaatataaatactttttaaatatgtgtatagttttttttttaagaaacaaacctgagatcatcctagaactgcaatttccttttgctacttgcacatttcatgtttaggtaatttcctatggatgtgtgatgtccagaggtcatcagagacgttgtatcaagcttaggagatgtaccacatacagtctttccccatgctttaagtcagggtaaaacgaacatttgtggtggccatgaatgaaggaaaaagacaggacacaggcaggattgtaagtgaggtcagagtccacccctggtcccactgattgttggaagcaggggacagaaagggtcatgagctgagcatccattggaagctatgcccaggtctgctgtcaatgcaaggcaggagatggaaatttccagaatcagaaatacatatactggtccatctctgggacatgtaagtttgccaacaaagcataattggtttaaaatgaaatattttactttggaaacgtatcactccatgacacactgaattactctgcaggagtggaaatatttgatggcaggatattacaatataataaaatttgaggagaactcaaagactggaaactgcccaccatttatctaggactttaatttgaaagagtgatttaaagagctgtaacctgatgctgacacacagctggcattactgatcctttaaaaccagccaatctgtctgcgccaccactcagagatgaccaccttacgccatcggcagagtgcaggaacgaggacgcactgccagaatcactgctctttgactcattttctttttggtaactatagaacaggactttaggaagtgtacctttaacctactgagggaaaggacattcgaaaccttttccattattagataacaataaaacttttaataaaaattttaatcacccgttaattctttgaattttaagaaaacagtagctcccttcatgaggaagatgaagaaggctccgatgcctcctcttcttgtcccctccaaaacacacctctctgtgtccccaaatcaaactgttatctctagtacacccttagcaaatggcactgaaataaactaccacttgtcttccttctcctggagacaaaagctggttgagagcaggagctctgtttatctttgtaatctcacggccagcgcactgcctaccttgcatgcatgaagccattacacatttgttgaaatagaggttaatgaaaaatgaaaacggcacaaacgagtgcagttttaaattggatgcaagtctccatttcattaatcgcacggcaaaaaaaaatgatacttttcatctcaaattttctgccacagcccacagtattgaggttagtttgagaaatctttttttttttctttttttttttgaggcagggtctccctctgttgcccaggatggagcgcagtggtgccatcttggctcactgcaccctccacctccaggggctcaagcaaccctcctccctcagcctcctgagtagctggaaccacaggcacgtgccaccacactcgacattttttttttttttggtagagatcgggttctgctacatttattctatcaggtctcgaacacctgggctcaagcaatccccctgtctcagagtgctaggattacaggtgtgagccaccttgctgggcctgagaaatctttggttttaaaagttatgacaacaggatttcttaaggacatgtgcattccactatcaataaatacatgtgcactccctttagcaaggagcactggggtgtacccaaatagtctctgtcatcatgaaaataaaggggcatacgatttctttaattcaacatcagtgtttgaactttgccatcctgctctgtggtatatcctatatggacttatatctacatttcagaatcttacataaaataaatgactctgacaaagcctatcaagatgcacattaagtgacaaacaagcagagacagatgtacaaagaaaaaacaaagcatttgggttttccaaaacataggacctttgtgtaatatgggtatttattcttcatacaggattccagatcagaatttttaaatggattgtaaagctcagggtctttcacaccgtcaacagaagcgaggcatctcgctcataaccggagattagttccaatttgtttcagtaaatttgcttcttcaaatgatggagtttggctgcatgggaaaatggagtctataactgaattatctgttatacttaatattcagaaaaattcctataatgctacagttgcgcttgcttaattctttctttttaattggcataatttgaaatcacattattaaatgaaaaggcagccatctattttaattctgtagctatagcaatgttaagtgattttatatttactgatagaaacactgatacatcctgaggtgcacttcctgaaatgcatatcctaatcttttatttacttatttatttatttatttctgggcagtaagagaatcaaagtgtgtgatgtaactcaaaaatagcttcagattcactcaaattctcaggctcccttcatttccttcttgtttccttatcttttagcctcttagggggaaacactaagagaaatttaaaaatcttaatgtctgttcttattttcattttgaaattctcactctaccttgtacctaacatataatagaaaacatctttgttatctgagtgcaaaataggtgaaaaagtgtaataatgaactggcaagtaaacagagctacacctgctgttgtaattatacacaaatgtcaaagagcttggcattcaacataacagcacatccctggtgtgaacctccgccaagtcacagagattttgctagtgctcaggccttggagagctcatcctgcatgacgtgcagagtgatccgcggcaaaaccaatcaaacctgcacagattcaagggccactattctccccaaatccctgtggattagtctgctctccaaaagctaaccaaagtgcagcccaacttccagtatcaacagaacctacagatcacagagctccctgcaatgggtccgcaggggtgctgaggtgtttgctcgaatggagccagctgaaattctcttcatttccaggccctaaacctgactgtttaagacactcgttggcctggaaacctgtaactgcacattctgtgagtctcagaccatgaaatcggtgactaactctgtccataaaagtcaaacacacatccctaaacaggaacaatgtcatcctgttggacccagtcagaagaaacaacctctgaccttaacattgacctttttaacactgctaatgcatcagaatccaaacctaggatcctaacacattttacatgttttgctaataaaagttttcataaaagcttccttgtatttccacaagacttttattctgggctgtttaaaaagactagtagtcctatcttcattctaccactactgaaaagtacgaagattccaggaaaagcatgacacagagtcaaagctgctctgtgtatcctcacgactgtaaccctcctacagtctcaacccaaattctttgtacccaagactccattcccaagatacacctttaacatttcatcgatcaccagtcaacgaagcaaaccttagcctaggtgaactttaaaacaacaaccttatttcagagctctgattatttgtcagagtgcctaaactttagaggtagacttcttaaattcaatatgaatttactgactgcctggtatgtatgaaggtagggccacacacagtgtctggcacttaatgaatgtgatgcttgagtcttggacaatcggctgagttcggacagacagataggaaagaggaggatagtccagagacggacatagtcagggaaagcgtagaaacagagtctgatgggagcaaaggttatgtgacggcacagagtgggaaatacgactgtgatggggaggcagggtgaagtaaaagtctgttatgtcaaggtaggtttctaactgcatcaaaaggcaatcagaggctttgcctatcacgggctttcagaaggctgtgcccaggagtaatgcaagtttgagacacaaagagcaaacccctcagtaaatatcagaaagctacatttgttgtatcgtggagtagggcttaaaagacaagcagagatttgaattctcagaggtttcatttacattaactgaagtaaaaatcaccagcttacagtaataacaacatcaagttacataatattaaattgaaagtttagggtttaaaaagatgcataccttagcatgatgtaaatctaccccatacattgataattttttggcattttccaagaaatgcatctctgcttctgctggcgtcattcctctgatgagaagaaaaatatgttacaatgatgcttttcccttccctggtaggctgcaatatttcccacttagttccatgctatctcataagaagtcctatggaggcaccagcagatacatgagaaaagaataacaagaaaaagggctttgcaagaaagcactacaaacgaacacctggatgctctgagtgagagcttgcccatctcagaattttactgtgcatggacccacactatgctcacgtctcgccgttaatggactgaaatcagtactgggaagaggtgggttgtgtgcgggacactctcccatcaaggcacaacttaaatgaacacctttctgcctctaacctgtggctcttgtgcagctcgatcactttgtcttccagttctttagtgtggtttggtgcaaagcggaactcactaatgtaatcgctcccacattcatctgggtcatagtctccgagctctgactggacagtgtaggagcccagcaaggccagggtaacaaaggagcagggcagccttccggacacgatgtcatctcgcaactgcaagcagaggtagtaccttccaggaaccaaaagcacaacacaacgaaggcagcatgaggatacaggaaaaggaggtcgcttggtaaaaatcgtgggcaaataatttctccctgtagaacagcctctctaggataaattttctagcgtctatatattttgatatttacttcatacatacttgttctagatagaagggaaaaatatttggttacaaaagacagtatttaaaggcatttagaagcaagtcgacgttcataatagggttttattaataaagcacagtctaaaagaaacttaaagacatattcttctaacatcttttaaaataacttttaaagtcaaatgaacagtccccaatacagttcctgaaatccttgggtgggggaattataatgtaaaaatgttcttaagtacagttatgtgccacaaaacgatgttgcagtcaatgatggaccacatataagatggtggtcccatgagattataatggagctaaaaaattcctattgcttagtgacgtcatagctatcttaatgtcatagcctaacacattactcacgcctttgtggtggtgctggtgtaaacaaacctacatgtataaaagactagcacatacaatcatgtgcagaacttaatacttgataacaagtgactacgttactagtttatgtattcactatgctatactttttatcattattttagagtgtactccttctatttgtaaaaataaaaagttaactgtaaaacagcctctggcaggtgcttcagaggtatcagaagaagacactgttatcctaggagatgacagcttcatgtgtgttactgtccctgaagaccttccagtgggacaggatgtgtaggcggtgacagtgatactgatgatcttgaccctgtgtaggcctaggctaataatatatgtgtttatgtcttaagtttttaacaaaagagttttaaaagtaaaaacaaattataaattttaaaaatagaaaaaaactcacagaataaggatataaagaaagaaaatatttttgtgcagctgtatgatgtgtgttttaagctaagtgttacaagagtcaaaaagtttaaaaagtaaaaaaattacagtaagctaaggttaatttattattgaagaaagaaatttttaaaaataaatttaatgtggcctaagtatacagtgtttataaagcccacagtagtgtacagtaatgtcctgggccttcccattcactcttcactcactcactgactcattcagagcaacttcccgtcctgcacgcgccattcatggtaagtggcctacacaggtgtaccattaagaaaaatcttttatattatatttttattgtacgttttctatgtttagatacacaaatacttaccattgtgttataatttcccacagtattcagtatagtcacatgctctacaggtttctagcctaggagccatgggctttatcctagagcctagatgactagcaggctctaccatttagctttgtgcaagtccactcttaagatgttcacacaacaacaaaatcatctaaagatgcatttctcagaatgtatccgcattgttaagtgacatgactgtgtgattattaggccccaattagccttatggaagtattttgatattaaggtgacaggtcttactatacgagcaaaacagatttcaggtaactcaatagctatgtcattataaacttcactctcaatttcctgcattcttaatgaggtagtctctttataataacacaatttctcctgttttcagttctcatttttagaatttagatagcttcttaaaatctatctaagatataaagaattcctaccttaaaattcgagaatcttgtccccataaataaacagttttaaactggagaaattaacattttccatataattttgccatatcataaaaatatgacctacataaaaatatgttgatttgtcttctccgttattttgcttttgagacttacagataaattactaactgccaaagaccccaaggtaagtgttaacattgatgagttttaataatcccaagcacagcctagtatatggatagaacaaagcacacctggtaccttgtatataagaaatgaactgttcatctatggaagcagaggactatgagaaagtttaaaggtcccctctaaatatgattttaggcaagtgacataaatccatgtaattatgacaaaaaaatccttaaacatttaacagcctcagctctacaaatattacatgagtcaacagaaagaaaccatgcactacattttctttctttttttttttttttttttttttgagacggagtctcactctgttgcccaggctggagtgcagtggcgcgatctcggctcactgcaagctccgcctcccaggttcacgccattctcctgcctcagcctcctgagtagctgggacttcaggcgcccgccacgatgcccggctaattttttgtatttttagtggagacagggtttcaccgtgttagccaggatggtcttgatctcctgacctcatgatccacctgcctcggcctcccaaagtgctgggattacaggcgtgcgccaccgtgcctggcccaccatgaactacattttcaaatccaggtatatgtgggctctaaaaccacaaattagccaaaataaaacagttcttcaatagcaactaaaaactatctttaaataagaaattataacttttctctgatttattgcaatataaaaaatcctctggaactaatttttacccttctcttaatatgtctggtgaaattatttttaactgtagcaagtgattgaagttgttttgagtaatttcccttttctgtaaagccctccaaaaagaatgcaaagcttacacagaaaattctgcatacactgcacaaaattgctttgactggtcataaacttactacggagctgagcaagagagtaggggttctaaggtgaatggagagaagcctagaaggtcagagcacaccagaacaatgaactgagtgtctgtgtctcctcccctccaaatccatatgttcgaatcctaccctcaaggtgatgggatcacaaggtgggggtctctgggaagtgattagggtggagccctcatgaatgggattagtgcccttacaagaaaggctggagagagagagaccccctcaccctttcaccacatgaggacacagtaagaagtcagcattctgcaacccagaagcagatcctcaccaggacctgacctgcgggcaccctgatctcaaacttctagtctccagaatggtgagaaataagtttctattgtttatcaatcaaccacccactttatagtattttgttacagcagcccagactaagacatccagtacagctttataatgagatcccctttcacactcaaagctgttaccaaactgaaatattttaatgttttgatttcttgcttaatatcttctttctagaaaacaaattaatcattttccttgtatatacaggacatagaaattaaacacttaaatttatgtgtgtgtgtatgtgttggttatataaaaagcacaagcatccaaggacatttttactctaagtattaaagcagaaaaactaagagctgctatatcatacaaggctgaattccatccaatttgactatggtaggtggatgacagtatctcagttctgcaagttttcccaccagggtcaagcagagggaatatcagcctggcaccaaagattcaacagtgaaaagataggaactggcaaatctcatcagatgtttgctctcgttcatttgccttttgtttgccatttgagcgtggatgattgtaaggctaccagatgtaagcacgctctttccggagcatttaagagaagcacaactctcccaatatgcttgtcttttgcatagccaactttcaaatacctggtgatatcttcagatagttgggcagggtctggtggataaaatttcacattaaatgaaaagtgccaagcaccacctgcaaggatggaaaaaaattagagtaaaaccttgagaaattcttatgactctaatcgatggccagaactgccttaactccaagcattaacacccaggcaacttttgaccattaatggaaaactgggaaaccttggtcacatgaaatctacagataagtctgaaaccttgtctaacttctaatcttcttcccaatcaaatcctttattggtacttttaactagtatggaaactgatcaaacttcctacccttttcagaatcaaaggtaagcaagcacttggaagaaggaaaaaacatgagtgacacgaataatcttcaatcagataagtctgggagtggctggatttattgctgcgaatttctgcatagctcacagatcaacaccacaatcataattcccattttctttgtcctttctgctctgttattacaggtcatatccaattataataaatgtcaagggactattcaacatacgtttattttatgggaaaggtttgttgcagtgaacagtgttctagtaagtgggctgctctgtgggctgttgaaaattattttcttgctcagggaaatttttgatgaaataggtacttgaatgtattttctgcatattgccaaattttgcacctgcacctcctcagcctgagacttagccagatcctctttatgctttgcaatctttatcctgtggcctctactcaaggcctctccagcactgaaaagggtcaaccaggagtcagctcacaagtatctactctctgtattgtcaacacatatccttgaaacattatgaagccttaactaagctccacatctcattaacactaactctaattgtatatggtttatcaatataaacatggaaaatacccttttctttttttccacatttactatgtgatcattactgtattcactctgttcttccggccttcaaatgcagtaacttaccaaagtctgggtatctcttctctgtggtgctgttcatatttgttccctctacccaagaggtacactagagcctaggtcctgcttgtatttcgaatggtttactgaaaaattcctcccagtcccccaggcttccaccctggaggtctttcacccatgcctcacccagcggccaccgacttgcccttactctaggattctgacttcacagtccaccccttatgcttccaatactctcccaagacttccaaatctccctgtctctccattaaatgacttctggaaactccattgctccatgagcccttcccaaacattcagaagaaggtacagtactgtatttcctagctcctttctctgaactgttctcttgcatctgaggcaatacttagcttcatcagtttcttacattctgtcataaatggcatagatccatccatgtattagttatagttaattcttaacactaccattgacatcacatttaagattccacatggcaggaactctacctgaggtgccctataaaggatttaccataggaccaggcattagtgggaacttaatatcatttttaaaccattcaaaatatatctgtcagtcaaacacattttcgtaattgtttttcccactgttctcaaaaaagtacttctgcttttccaaaaatattctgatttggttttattttcttattgattcctattcacttcctattaaaatagatcccttcaacgcttgccagtggtaaggttcataatgagatctggctttcccccaagcaagtggaattaaaactaatggattagttatgggaaatggatttattgctcttttataatttttattcacttcaaagcaggccctgaatccaatgaatagtttagcaatgtaattatacaatcttataataaatatccaagttagacactaataagtaataaaaaatacagaaaagacatttaatgcaaaaatcctcattctaggaaagcaagtttcaacctatagtgagccgaagaaatacctgaggtacttgttaaaaatgccaattcccaggctccaccccagagatttttattccagagatttggagtatggcctaggaatcgatggcttgaataagcttccttatgtttctaataataaaaatgggctttggaaccacattttgaaaatcactactgctactaaggaatctacttccctaaggttataacacacaaaaaacacatctttcaggacagtattttgaaacaatgggaaagtgtacagaaactataatacaatctacaccccaataaagaaaaaaaagtccagttaaatggggcataacactagaaattaaggagagaggcagattaaagctcaaatacatatccccataaagaatatgacagaaacaaatccactgagaaggaagtgcttacgcaataaataagtttgcaactctacatctgctcaaatgagggccctagttagaaagaggaaatgaaacagcttgaacacattaaaatgaatatttctataatgctgatgtggaattttaagttacaaatttatgataaatagaaaattataacactgatgatagttcattcttatgaaaaatttctaatgttagtcttttatgccagacaaatcttaaaatttctaatatactgcatttatatcataaaagtgcgatatatgctctatgtcataaaattactgtatcataaacatacttaaaatcacaaaatatagtctatttagaaattttaagatcctgcatgcttaaaagatgactggaataagaatttttttcataagaactcttcagtttcaaaattttgttttttagaagcagggtctcactctgacacccagactggagtgcagtggcacaatcacagctcactgcagccttgaactcctgggctcaagtgatccaaccccctcagcctccctagtagccaggactaactaactacaggcatgtgtctctgcgctcagctaattaaaacaattttttaaaaaaatagaaacagggtctcattatgttgcctaggctgggcttgaacttctggcttcaagtggtcctcctgtcttggcctcccaaagaactgggattacaggcatgaagttttagaattttctatttatcataaatttggacttaagatatttgttagctcggtttccattttcttagagatctcattctaaaggaatactgtgagcccacagcataaaaagcatggaaacatccttttatcatttatattttggaagtggagatgatggtacaataattacattagataaggtaatacttctctgccttggttgaatgtaaaattttgtggcaagagggcattttagtggatgggaaacaacaaagaatacaggtaaaaatatcgaattccaatttttttttttttttttttttgacacggagtttcgctctgtcgcccaggctggagcgcagtggcgcgatctcgactcactgcaagctccgcctcccgggttcacgccattctcctgcctcagcctcccgagtagctgggactacaggcgcacgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggcctcgaattccatttttaaagaaattccaactttccttatctcctttatctgcaagactgtcagttttctttatggcaaagtcatatacactgcctaatctgcatgataaaaaaatcttttaaaactcttgttttgattgtcttgtccctttagctttcttctctttgaaaggatggtagaagacactataaatgggaagttaaagaaaaaatgaatcctattaataacaaaaaagaaaattagtttatacagcctttcctgtcatggtattatgacttatccttgaacattttatatattttcaaagtactttgcaattattaatcagctcagtattccattaattagatgaataagagaactttatgcacacaaaatgttaggatatatattcagcatgtctattttagtaactctttaatactccttagaaaaatatttatcttaatttttttcttaggattcctcagaacaaaaaataagtagtgttttcacctatttatcacaactacagctatccctggtttccatctcaattaactgtttctattaacctaatttgttatcaagtttctgggtagtggatacatcaaatttccctcaaacatacggtaaagatgtcttaattgtataaataatcacccgactctcttatatctagaagtatggttatacttttgtctttctgggatattacctagtattgaaccatttccaaactgctcactagtgattatgttttattagtacttggggtattattttgatagctcacgactttcaaaggcactgagaagtatttgcttgctcttttaatagtaaactgttgaaaagttttacttattgaaatgggaatgatgttcttattaataaactgctcttaaatgtgttctttaactagaattagttgtttggaagaatttagactttactgacaaaaatatgaataaaaacgtagttattttaaattagtatccatgtttgcggcaaaagtaagagctatcggaaagggtaaaaaaattttaaaaactcctccttctcaaccccgacactggatgatactgctggagtaattactattaaaaccttcctgccttccaaaagttttccatgcatctatacagacataattttttaaaaacaaacgtgattatgctatagataatattttgcaaactgatttccactaaagagagctaagatgtatttatatggctcttccatgattgacttaataatttctttatacatggataattaaggtgcttctagttttctgctactgtaaatagtaatataatgaaacttcatttgctatacaaatgcacattttcctcattaatagatatgctgaataaatttccacaagtgaaattaagggtcaaaaagtacagcttaaattttaatattgacaattgccctctgaaatgattgaaccaacttactctaccaattgagtaaataagtgctatagtttattattaaaccctaattctttgttaatctgaataggtgaaaaatgtgtcattttaatttgcatttaatcattagtaaaatttagcaactgtttaagacttattagctacttgtattttaaatttgtgacttgctcatgcaattgtttggtccattaaaatacgtatttttcaaattgccttcaggggaccaggaaaagaggttgttaccagacagtaaacctcagtttgacttgttattccttttcaaagctatgaaatgattatgactttcatctggcctttcatacttttgtgactgttggaacattaataattcagtttggaagttttaaatggttaattgccaattctaacatcagttgattaaatcatatacttgacatccattcacaggcagagaaacaggccaagcatcacggtccctttaactccaagttgtgacaactacaaaatgaatactatcggaattgccagatcaaatttgagataagaaaagcttgtattcacactagccacttaggtatgggctaccaattcagacaacttgctctctgaaaaccttcacatttccacaaaaaataatccaaaagaacttacttcgaacctgtttttttatttccttagcagggtccaaccaattctgaaaaggaaatgacattttgaatttgaatcagaggagaataaaaatgacttaatgttgattaggtacagactctccctaaatgcagtgcggagttagtggtcgtgggaaggcttcccttactgtggtccttcccccacatctggtgcccctctgccaagccctccaagggcccaggcactggtctaatgagaaaatgcacatgtatgcagtttgggcctgacaaaagtctttttcttttataaccattgccttcagggattcaagctagcacagaaaaagaggggaaaagacagaagagtctatgttcagacaagttactaggataaattaaaaatatatgtaactggatacactgatatcctagccattcagttccacattagagacttctgcaataaaagatccttaggcatctacctaggaagcttccctaacaaatcaatagttgcctgtgatttccgattttcctcattggtaaaatcagatgtttaataatgaagtgaggcattgtctggagaattcaggaggtattaaggatgatttatggcacaacaccaaaatgagtaacaactatgagcaaaatttctgactcagcttccagtgtcaatgcaatggaaacgatttccttttctgtatttctcaggtagttgcgtggattaaggagatacagccctgaacacagtctacagaggtattgcattaaacataaaacatctactaaacatattagacaagtgtcaggtcagcacacaatccccctcatattctgattcagaaacattatgaaagcataaaaagataaatgaaaaataggacagcagcaatggtgaactgccctgacagtttatgggttacaatcataatatcgtcatagaattttgggatatgagcatgatttttacataaatatcaattgattttcattggttcaaataatctactgaaacacattactccccccaaccccaccccggcaaaaggaaccacataaaatgctttccaggaaccacaaataattcaagcatgaaaaacaaggcttcatttactgttaccagaatattcaagattaaaggaagctgtcagtgatttccttcatcaaggaatagatgattaacagcatttacagactcaaagtagaaagtgtgggagaatgaagggaggtggagaaagtgatccacccattcagtttcagttcactttctggcagtaatgagcagttcaagccatcttattttgcattgcttttgatcactcaccttctggttttcagcatctcgatacgtaagcccaaagtagtctttctctagcaagttcaagtgttcacacactttatcaaacagcacttgtcctctggagcgtttctacagaaaacagaatagcaaagcaagtcaatacaacacaaagaaagttctcccaaatatcagagataaaaccaggtaatatttaaaacattgcttggtgtaactttagggagtgaccaacagtgtgatcacattgccatctcctgtttaagtgcaaaaatggctaaaaaatggcaggggagggcgaaggcttcaacctacaaaagcccaccccacaaataaacaaaagcaaagtatcaacagcgctacttagtatgtacaggtgaccagtgggtgatttctaaatggaagcaactggggaaaataatgtgatgcttggaagcctaaatatgtgaaacataaaaattctgacagtgaaagagtacataacaaaccaacaaaagccataatgcagagtgccctaactcaattatctagatcaggagtcctcagcccctgggccatggacggttactggtccatggtctgttaggaagagggctgcacagcaagaggtgggtggcaggcgagcaagcattgccaacctgagctccgcctcctgtcagatcagtggcagaatttcattctcataggagttcgaaccctattgtgaactgtgcgtgcaaaggatctaggttgcgcgctccttatgagaatctaatgcctgatgatgtgaggtggatcagtttcatcccaaaaccatcctccaccccagtccatagaaaaaaaatggtcttccatgaaactggtccctggtgccaaaaaggttggggaccgcagctctatgagataaacttctgagcctgagaagaattaaccctgctccttgtcttaggcagactctcacttaaaacctatcccaaatccttagttagaaattctaaggaccactttctaaaatccattaaacaaatttcattatttttgttttgtttttcttttgtcacaaatttcagtttatacagagtttttctcttaacttttttagagcaaatccttattaaacataacaaaatattcagtttaaagaatacttgagttatcatatataaatacaaaatagggatatatgagttatatttctgaccatcaagccagcatctggagaaaaagatggtcatttggaaaaaaaattcatcagcttaatttattgtgacgtatcattttttcacctaatccttcaaaggcctttaaacatagtcatgaagtctgtgacgaattaactgacaacaaataaactaaatgagttttttgtttgtgcgctactaacattttacatctaatacattaagcatatttgtctttaagagttaatgtaataccaatgagaaatatgaaaattgatcaactatgtctatgccaaaataataagcattcaaaagacctgtgagtcgtgtgttgtgttatagtgcagctgtaattatgctgaaagcaattacgcagtcccctcaagcatgactatttaggagaaaaggcaaatttatggtagaaaagtaaggcctaaatcatagctagctaaataatcgatgatgtatttggaaaaaacagttccataaagtattatgaaaataaattactcgttagcaaaactacataataacattgctcatcggctatgaataaatatttcgacaatgaagcgcctgcttgctggtttaaatcatttgtttataaataacagcatattatttctgaataatatttataaataacagcatattatttctgaataagccttcacaaattatgaagttttcacaaaaattggttcttctgatgcttctattggtatgatctctagttcacaggtaagaacagaggttcaaagcagttggatgagagaggcagacttatgtgatgacctgggaagtagctttagaatcaagtaaacctgtgcttgaatcttcaggatgtcccttgcagctatgtaaaatgggtatgacactacttacttctttggaatggatgacattaaaatcaaataatgtattcaaatgtggcctagtggtggcatatattaagcattccatagatgtcagctattattatagcctggtggctgacaaacagtagaataactaatgtagagcagattattatgcgtgttttctataggagcacatatccaactcctggtggtgccaataagcagctttataattaacatgtcccactctttagatattagatgcctgcttactacctaattgctttagctagactacttttttttttttttttttttttttacctacatacacacaacgtagaaaaatacatatcagtgtctggccaaatactttctctatgtgtaaacaaaaaccaaaacaaatgcaaatacaaaaacttttctctacaaggcttcactggaccctatgcctcctacattttctgacgcaagagaccacagccatttctcaacggaggaatcgtttctgaatatgctgcaggcgccctggttacagttccaattcgccactttctggctgctgtgttctttcctttgcctaacaagaggcatgggttagctcaaacacagactgttaatgctacctggctctcacttttctggttcctcgcaatttgatttctattaatgagtcccatccttctcttaaatagaccagatcttttcttactgaatattttaaacatattttaaacactggttttaaagacaataacatactagtccacactgaagattttttttttctaatccttagagctaagaccagttgtctggtatcagctgtagatggttatatcatgggatggaagcaatgaaattcttacctgctaaatatcagcatggccaccagccagctggatgactatggaaaaggcttttaagttattcgggcctccattttctcatccttgagtggggatgtaagattctactgagcaagatgtttatgggcttgaggctctaactgggcttccctttgcaaaccactaatggattgaggcactctctcccattgcacccagatcgggcatcagcatccttctacacgtcatgatgagaaagatgctgccaacggatggaggtgggacatgacatgaaacttattttccagccctggactggatcccttctctcccaactctaaaaatgtcttgattcttctaacccagatgatttttttttctagcatattattcaacttttcaagtcaactaattctacttattgatatctgcatgtgcctgcaggtaatcatgtttaccatatatgactaaatctcaacaatcaatcagactggaaattttggagaaatgatgtttattatggttccaaaagacatgttgttctttaagtgatcaaatcattgggtgtggttacatgctatactatgagtcaagaactgagtatattttttaaaaaaatggatagaggtattctaaactaatgaataattacctaatcagaaaagactgatattttggtcttacaattatttatgagtggttatttctgactcaaaagcattcagtttgtatatactattcagtatgatatcatccccaaaatgtgattttactttcctagagtaacaaaccaacggtggcttgccctcttcttaaaatttcccctgacaaattgcatttctgtttctgatagagtaaatggacatactgagtccaacaatcaagaaagttttaaatgaaatgtcctaaaaatggcatatctccaagcaacttaaacaagtttcatgactttttacattttttctttaattaaaaaattttctaaattgattcttgaaattgttaggtgttaggagatgtttgtcaaaagagaacttaaagagaatgaaaagggaagccagagactggctgaaaatatttgcaaaacacgtatctgataaagaactggtacccaagatatacaaagaactcttaaaacacagtaagaaaacaatccaatttaaaaatgggcaaaatatctgaacttacaccttaccaaagatatacagatagcaaataagcgtatgaaaagatgttccaaatcaaacatcattagagaactgcaaattaaaacaacagcgagatacctccaaacgtatgttataatggctaaaatccagaacaataaaaacaccaagtgctggtgatgatgtggagcaacagaaactcttattcattgctgacaagaatgcaaaatggtagagccactcaagacagtttggcagtttcttacaaaactaaacctattcttgcagtattcaacaatcatgctccttggtatctacctaaatgagttgaaaacgtatgtccactcaaaaacttgcacacaaatgtttataacagttttattcataattgccaaaacttggaagcaaccaagaagttcttctttatgtgaatgaagacacaaactgtggtgcatccagataacggaataatgttcattgataaaagaaaaaatgagctatcaagatatgaaagaaccttaaatgcatactgctaggtgaaagaagttcatctgaaaaggatgcatactgtgtgattccaacgacatcagtctcccattgtccatgggattttacgttccaaggcccctaatggatgcctaaaaccacagatagtagtgaatgctacatattctgtttcttcctatacatatatacttatgataaagtttaatttataaaataggcacagtaagagattaacaataagtgatagtaagatagaataattacaaaatatactgtaataaaagttatgtgagtgtagtctctatctctccctcaaaatatcttattgtactgaactcacctgttttcagactgtgactgtgggtaagtgaaaccgtggaaaacagaatggggaagtgagactgcagataatgggggggactactgtacatatcatcctggaaaaggcaaaactaagggaaaaaggcaaaactaaaggcaaaaagaccaatggttgctaagggtttgggggtggggagggatgaataggcggctaacaggggatgtgggggacagtgaaacagtccgttatctgtatgatcatgaaatggtgaacgcatgacattatgtatttgtcaaaacccccaggatgaacagcacaaagaacaaactgtaatgtaaactatggaccttagtcaacaataatgtgtcaatattggctcatcagttgtaacaaatgtgccacactaatgcaaaatgttaaaaataggggatccttcctgtaagaaatagcaaaaaataaaaatagagaaactggggggggtgaggggaagagtgtgagggggtatataggaactctgtgctttctgctcaagtttttctataaacctaaaactgctccaaaaacatacatctactaactaaaaagagaaagacaaaaatacattcttagtttaaattgttaataaaataattaattaaaaaggttagtaaaaaaaaaagttaacctccaaatgattttacttttatcatgagtaaatacaaacttaaaattttcattgaatcgacattttagaaaattcaaaacttaacctgataattctccacttatcttggttttccccttgaaattaacttgcctaagaaactatgtcatttgcctgtggagttctttcagtgtagattctcctgtttgcatctttatggtgtaatttaccagctctcccagtctcctgaatcgcccctgaagtgggagttacatctagaaacttcgtcaggttccggtttgttttccataaatgatacttcattaggaagcactacgtgactgcctgattttttttttacatgtgtgacattagcagtcactgatgaccattgccctgtatcattcattccagactgcaaaatggtgatattctaatccgaatcattccttcttcatttattaactggagcatgtttataaagaggtatttccttttgtcaaaactatttgtttacccagtgacacagtttaattatgaaaatgaagataaatgcttgtttctctccctttatccattttcaagatgatgagttggctccctagcatcacccaaagtcaccaattagatcttttggcttcatactatcatgatgagctcactgagttaaacagttctgatgtgtttcaatccatctcaggcattacccataatgatgctctcaatgtcccacatgttctgctttgcctgttaagtcctctcatccttcaaggggtttccccagtgccaactctctgaagcatttcctgtcttcccagacaaatgtgatttctctctcctttggactttgtggcactttatggcagcactttctatattctgccttacatcccagctgtgtctctgggcactcacttcatatccctgaccgtaaagacatttgcaatggcattgggcctcctgcatgtcatctttcacagggcctctttctttgtcaaatgccattgagagattaaaacagtaacttgatgaaactttacaaaagtatttttctcactagcaagccgtaagcaatgacaccgaagcaatgttttaaactagtggttttcaacagtggatcctgggggcacttaaaacatgtcaatgtccaggcccctatctcaggtcaattaaattggaatttctgaagttgggccaaggcaactgctttttgttttgctttgacggagtctcactctgttgccccggctggagtccagtggcgtgatctcggctcactgcaacctctgcctcccgggtccaagtgattctcttgcttcagcctcccaagtagctgggattacacctgcccgccaccacgtctagctaatttttgtaattttagtagagacatggttttgacacttttagtagagacatggtcactcgaactccctgacctcaagtgatccatccacctcggcctcccaaagtgctgagatacaggcatgagccaccacgcctggctgacatctgcattttttaaatatacccaggtaatgcatgctggtatgctggtatggctgaacagtcactttaaattaaaatatgtttgcaacttataaatttttaaatatgaggactctaaaaatattttacttttttgggaggaagtatatagctttttcggatttcgtctaggccaatattcatagttgcattacagtaaaattggtttacacagacacaagtgcctaaaatcctttttttttttttagaggcagggtctcactctgtcaccctggagtgcagtggtgcaatcacagctcactgcagccttgacctcctgggctcaagcaatcctcccaccccagtctcccagttagcatataagcatgtagcatcatttccggcaaatcttataaaaattcttctgtagagatggggtctttctatgctgccccaggcttaaaatctgaagacattcattccaacacattttcttgaaaaataaaagttctcaggaaatgataaactggccaaatgctaaaataaaatgacacaaatgagaaaaaccactaaactctcgaaagaaacgcaaaaacactaacttccatttaaagctatgaatacaatataagaaaaccagaaatgtttaaaaatttgttgtgtgtgtgtgtgtgtgtgtgtttttaaaaaacggagacagtttccctttgtatagttaaaatacacttttactcaagatcctgtcacattactaaagaatgacccttagtaggttaataaatgtcttgatctccccttttctaatagagcaggagcattcacatcttccctagcaggtgactggggtgactgacgggtacaaacacctggcactgaggccagggaggacagctctccttggcacagctttctccaaaatgggcattgcctccattcctgaatccctataaatcatctcttagtctgtgcccaagacaatgagtgcaaaagcaggaaggcacaaattgcgccaagtctcagcactggactacaataaaatgtgtttgggtttttttcttcagtcttacaaagctatgaatcagcctgagtgaagccctcttctggcacagctgaaattagagaaatctgtcaagtcaaaaactgtcttttagccttggaagacagggtacagttatctatctgaagctgtacaatcatgaagagaatgaggagagcaagttgttttgcatgagaactggagctaagcagcagtccctgctgctcaggaaggaatggggttcctgcatcagaaggtgtgtgcattggcaaggctcttcaggatgcatgcatgcatttctttagacaataacgttgaaaaatgaaaataaaaaagcctcctgcctatgctggcttaggctcaaacccactcatgttaatacatgaaaatatggagagctacaatattgaaaatttccagcaaaactgatgcttctgtatccttatttgaggggctgtctacaccgtaagtacttcattctctccatcacctatcttcctcaaatagacccctgattttcttttggaagttatatttcttcatgagtatagtattttgtgaactcctatttctgctccctgaggatggaaaactgcttgtcctttttactgccctggtacagtgtcctgaacacagcaggcattcgatctatgtgtctaagaagtgctactgacaagaatttcaagaaagaatttcttctcacattattttggacgaatctaacaaaatgtcatctttttccccccatgcttcctgccctaattgcatttttcctcactgaatgccttttcattttcctcacatttaaaggtcacttgaacttgtctttatttctaaatgactgcactaccatttacctcaaggatggagactctaaagagttcggcaaactctctgggccacagcttgagcccaaatcagacacctggactctgtgtaagtcacctttcctgggcttcctttttttctaacgaattcttgatagaaaaatactctataacattgccttgaaatttaagcggagagtgtgttttttttttgtttccttgttttttttttttttttttaatccatacttggaaaatgccaaagcgccgtggtcaaacccaggaacaaaagatgatggtgtctggtctgggacaacagagtccataaagccttagaaagggctggagctgggaagccctaagaagaaagacaaggcaccagctatcctatgtgaatctcctgcctttttgggctgtctcaagtgtacatgcaatgccacgtttaataagcatggaaagtccattatccacatcactactgccagaatccattctcaagaggcaggacttaatgggatctttcagcctatgtactaatcccaaatgtggtccaggcagcatattcatagagggctgacatgagaggcagagatcacatttcttctctctagatggcacatatattgtcagtcctttctttaaattcatgagcaatcagctcttcagaaaaccatgagggtaactactttcaaacattcatcagtcaatcaataattgttctatcacattctcatttaatcaagttagcaataatgatctggagccttctgttaaaataggaatatgaaactacttcctggtcttggtaaatttataaacaaaatagtgaacatgtgtgtttaatttccaggtctaaattatctagagatgagaattcatctggcattatttaaacacctttaagttggatattcctacccactgaaagtttgtcttcccattattcaagtgcagtatattagacagtcccaaggctggactctggttctacaactaatcagctctgtaatgttagacaagttatttaaacctctctgagcttcattgttttcattataaaatggaaataatactggtacttatgcaaaggattgttgtattaagataaaacactggaaagcacattgcctaactcatgggaagcatcaacaataaatgcgggtgattattattaggcctttttcataaggagcctgataaatttaaggtttctaatgctgaatttggaatagagactgatgtactattaaaatcctatttattctacaatgaaatcatagaaaacaaatcataccattactcttacgaaaaaaaaaaatcccttctctttacataggtaaaactgggaaattattcaaaaatagtattgatattagtaaactgagtctacattcaatttttcttttcaaacacacactcccagaacagttttaaatacatattgggtatactggcacattttggtattatgcattgtaagccatatagcaatgtccaaactagattgggctgttcacatgcagtagagttgacctatgttttgacttagattcagtgcgcaaacacttcaagtacatacatgacaaaagtacctccctacatattaagcccatctacctttctttaaaggtgcttttttttttttaattggttcctgccttcatttgttgtaatttccgtctctacttgaaaccagacttttgcactcagagatgtgcactgtggtagatgatggctttccagtgaagcacgcttcttcttggctagcagaaacattgggcttgattttttgcaaagagtttcacatcacacatacgagatgttggcagcaaactgtcagacaacatttcctgctgtggattcaggtcactaagccaacgcatgcaaaatgaacgcagaaaaggaagtctaagaaggaggaatgtttgaaacagacacgtacttaaacctgaatcacgtaaaataatcatattagctaattctgaatgacgtgaaactttgagaattttcctgtgagaggaagtacttaacttcttttgtaagaattctcaaaaaaacccctaaacaaacaaaacttgaattgtgatttataattcatttggtcaaatgaagagctatatgcaactcaaatatagacaataaaaacaccactttcaataatatgaatttaatgagtatgaatttgtagcactgtcacttttcaattctgtaagacactgataatcaaaaaacatgagaataatattgtcattgctttaaaaaactatgtactaagtgaatctgtgtcctttcctgtccatcaactgtttaagcctatattagtagggcaaggctgagaataaatagaaagagaaagaatatcaaggtattacataaaccaccagcatatttaaagatgtaatgatatatcatttcaccagttaaatatgtgtttaaattaaaatgatcttataatctatgtaagacctgtaatgaaatgtaaataagtggttaaaaaaacaggacatgctcacactgtaaatgatgcttcattcagtcttgtctgcacttgcgcatatcatattttagatgagtatttaaagtccagtagataggggaagaaaaaaccttctcaatcattaaatattttgattctgtatactttttggtttttgtttctgatacatgtaataccctgtttgagccactgaggggtatagttgggtctacacatcaaaggtcagtattgttttctaacattcctctatcagggcatcctggcttaatactgcgtgaacccacaatcccagaaagccagtgctaatcctctttgcccagccgttcccactcctgtgacaggggtaaggaggaagctgctgaaccctgctaagaagatgggaggcctggtctaattcgagaaccagacacggcaggccctgtcttctgggctcagcccagtgagaagctggagcagcagggaggcgcgctcactgcagcgatcccgtggctcagcaacctgcagggaatggtagtcactgctccttcccgaatctcagatgactattcctttaagttctgtggttacaatctgtaaaacatatgagtagcatttgcaaatggtagtaaataacaatcacataaaaactgaaaccataaggcaaaccgcactctcaacatggcttcaagataggtacagccttttcctgtaagcaacaactctaccgttcttttatctgtaggaaaatcgcaaacattctattcaagcaaaagtaaaagattccatacatgtttagactgcactgttttttctctgcttgtgataaagcaattgtctttcctggagcttatctgccctcggggctgaacttgagtaaggttcaggactgaggggctcgggaagctctgctcccctgcttttttggaagtcttgctgatcctataaaccagctctccttgctttcatctggtggaacaagtgatctcggatggcacagtaggcagtgaagtgaaaatttagggaggtcatccctgagactgtatcacttattttaacttctgtttttaccattgaaaaagaaaaaaacacacacacacagatctcagggagaagaaagctatatgacaacatcacggtttagctatcagattcagtagtgagagatgcttctggtacacagacagcaaaagcctaactgtggaaagaccctgcaggggcctcccaggcttgcctgcctctgtgacttccctgctacctcacctcgctccctgtgaggctctctcctgcaaagaggagactgtacacacacctccacgccccgaagccttctacccgttcgtccttctctccaccactcaagcaccccttcctcaggattccacccctgaactgcaggactaggttacatctcagggaagctgttttcatagctcctgcgttgccactgtcaggggggcacttttatttttgtttgtattagaatttgagttgtggtcggggtagcctacctgtaagctatatccactcaccactgtattcttacagtgccgggcatcgagcagaaacatttttttaaaaatatcaaagaaaatcaagctaaataaatgcatctggggttcatttcctgctttaagactcttgaacaactgctctaatctttgaaatttgttcatgaccaatttgtttatatttctctaccatgcaggtataatcttctctggctagaactacagtgttgaatttttacccccattcttgtaaaaagagaatactttattcccacaaatgaaaaacctgttttttaatgttccacctcaaacatcatataaaggttaacttcccgataaacttctcaaattttccccaaggagtaagtggtcttaaactgtggttttactctattactttgatttgatacacattttatccttcacaatatagaaaaatacatgatggatcatggtttctaaggagaggtcttggctaaactgtattaggccactcgaatcgcccagttatcaacacacctggatctggacaccatctgattagtgggtgtgatcatctgatgaatgcagacagcagttctgggcatggtatggggatgtgtcttggattcccttcttaaattcaaactcctggataactaggaaaaatattctctcgccctatctaactatagaaaaaaacacatgaataacagtttggaagcattaactattaaatatgtaattggtcttgtacctaaaaagactgttctaaaactgaaattgatatttttgtagcagtcaccatatttagcggactaacagttaataatcctataaacgaaatgaactaattgacataactgggcacgtattttgctttgaggttatcttgaagactagagaaaaaattacattgctcaagcttaaatgtcctatgagtgctttaaaattttcatgggttaaaattattgaagtcatgctctataaagtacagttttgggatcttgagtatgcctttgtctctaaaatggcctagatccaaatttttgaggtatattttaacctcaggcacttccatgaaccacatccttgcaggagggtgatattctctttgtgaatatgttctagtcaagccctcacctctcaggagaagatgcccatcatctctagttctgatattttaaaatacagctctgagttcaggcatggtagagcatgcctttagtcccaacgactcaagcggctgaggaaagaggattgcctggtcccaggaattggagtacagcctgggcaacaaagtaagaccccatttcgaaaagaaaccaacgaatatatagctctgaaatattgcctagatattgtaaccatctggatcccattcattggcttctagtaggaagccaattaatttgtgtattgagagcctaatgtccattggtctctttttttttttgaaggccttatcagatttattatgaattattaatttttgacttttgctttttgtttaagttttctaactgagtgttgggcatacccataacttaactataaccttggtagctgttttagatctttttgaggataaaaagagaaaataaatgtatttttaaatctttcattaattaaaatgaaaatttctggttatataaaggaagttcttaatctgtatctactgaatgagaatgttttaagctgcaatcctcttacggaaataaattcagaaattatatattcctgggatattctgatttctcttctgctaataatatcagtgtgtaacagacatacttatgcatttgattatacatgatgcacatatcaaatgaatgcaatcaaaatgtatcctttttttctaaaataaactattatcatagaatcataaggaaggaaagactgcagactatacaaaattatctctagaagatgacttttaaatttctcttttatttttaaacttttattttagagttggggcacatgtgcagatgtgttatattgggatattgcatgatgctgaggtttggggtacagttgatcttgttgcccaggcagtgagcatagtatccaataggtcattttcagtcctttccctgctcctctctccctcattttggagtttccagtgtctattgtccctatttttgtgtccatgtatgcccagtgtttagctcctacttataaatgagattgtgcagcatttggttttctgttcctacattagtttgctgaggataatcactggctgcttttctctgctgactggatcagtgggttcatggctgctacacatgagtggcctctcatttgggttctctcagtaatgatccttcagggtgatgtctgggaaacagcacactgcaggcacatcccatcttctgtgatactcccaccatctaaacttgttagggaaggaactaggaagtccattttggccccatgtccatgccatattctccagttttatccataccaaaactcctgtgtctaaaaaatgtgatatatatatacacatagatatgtatttgtacgtgtgtgtatgtggatgtgttatgtgtactaaacatcacaacaagttgcatctcacatacataatgaggagcataatctcaaactgatgaatcattacttaatggttattaaaggtttgcttgagaggaagaacaatcagtgagatgtttctgatggctgttcatagtccactccttgaataagctatcagagagctgcagtagagagtttaatcttaaactggccctggaataaactcacttcttttcacctaccaagttgtttttgtggcatggacaccgggttgaggcttcctcctctgtgcctgttagagatctcagaacatgcattttgtggattaacctcatgcttggcttcctactctcattttctcttggtccgctttctacatatttattttctctttgttatactgggtgcatttatgtaaaacagcctaagtccttgctagaacacggtggggtttaaataatagaaaccccaagttaaagtaaaattcacttttgaaatattacatttccagttctggtggtggtgttttatttttttcccccctatcatgaggaatttgcagtcatcatactattaaagaaagttttgtaagtcgtgacgtctgggcagtattttttctaaaggaataactggagacattaactggagcattttgcttggggtaatcatttaaaaccattcatgtgttttacaagctcagtctaatggcatttccctaaggaatgtggtgcctctttagtgactttatttgctgtcaccatggcattccataaaaaataacaagtctctgtattccttccagttttccaaacaccataacaagaaccaattccttatgctgcctgtgcgtctgcaaaccatcacttatgtctataagcagcagcagggaaaatgaggtgcattcctaagtgcaaataggacttagaattttctcatgtgcttattagaaaaggactccaaatgtacatacatgttaaacacagctgtctgtcatgctgaacagatacattcttatacaacaaagatatcttgtttattgacaagaagaaacctgcaccaatcaaagcatttcatgaattaatatctaatctggtcattttgatttgcctatggtagacttatccttgacctagattataggaaacagtcactaggcaatgctaacaaaataggtcagtcttgcaagagaagcaacaggaagatcctaaattctatttatacagaaagaaaatatccacaatagcaatctgacaagggaaatcatgacagcaagttctaggaagctaactttattgatggaaatgttatttgttccaacaaaaaactcccacaactggaagtctgtgaccccttacagaacaaataaataaaaagcttaaggtgcattggctggtcgataacaagccacaaaatggaagagaaaaaaagaatcctttgcctctctgctgtgcagagagggagtgagaccaatagttcagcaccagatgcctcctgccagggccagaaggtaagagcagggtattattacagccccaaactagaaaaatgctggaggctacacttaaagggtttatttttttctaatttcagataaacatttaagagaactttctgaatcacaccactcttcacattttttaataatggtaccttaaaaatcacaattatgcagtatgctgatgtaaagctacttctaatattcatcttaagttgttcaaaggagaatcagacatcagtcggtcctcataaacatgtaatgttatggttcttaccactttgtacagctgaaattctaatgtatgaaagacagcaaaaagccaaattaaataaataaaaggagaactggcaatgaactgaaagaaggcacaagaatcaatcaaagagcatgacaacactcaattatttctccacaatggtaccttatgcaaccttccacttcctgttttctagtccttgcatggcacttagaaaattatatcaggatgcttttctacgcactctctgtttttgaactgtttgatggaccctcatacggtcacaatcactactgcaatttccccaaaggatcaggtactcccagctcataagctggaacagggcaaaaatggaaaacaggttcggtgtggggaagaacccgagggtgggggatttgtcaaagctgtccccactccctacttcaaaggttagtatcccccagagctctgttattaaggctcttttcttcttgctcattcgctcactacctgcataacctcattcactgccaggtttgaattcatataaaagataatggctcccacaaagtctaccaaattgacatctcttgcaaatgacaaacagtatacccagttgcaatagtagattgctactttcatattccaggcactttaaattcaacgcatctaagttaaattcactgtcttcccccataaactttttctcttgtattctacatccattggtagtacaactctctatgcaatcacttagtccacaaatctcgaagtcattatcagttactggctcttaccactacccacatccccctaatatatccaattgatcaggcctgctccttttcaggatagttccttaaaatctactctcttctctctacctcattgccaattgccttggttctggttctcagcatctcctgcctggttctttacaatagagctgactagtgtccctgttctattctcttagcctccaattgctatttagccaacagaagaacattttaaaacatgaatgagccaaataactcccctacataaagctcctcagaagcactcatcccctattgtgacaggcagaattctaagatggctcaagctttccttcctccctggtgtatatgcctgcaccatccctgaaactgtgaataaagtagatcctactcctgtgatgaggtgatgctggagggcacagctgaccttaagaccaggacattatccatgcgggtttgacctaatcatgtgagcccttttctctagctggttgccgatggtgaggtcagagattcctgagaagacaaatcatggtgagggaggttctatgttgctgtgctacaggagcctcatgggaaggattcgagagtggactctgtagctgagagcggttcctggacaacagccagcaagacagtaaggacttcagttgcacaaccacagggaaatgaattatgccgacaaccctaaggagtatgaagctgatctgttcctagcccagtgtctccatgaggatgcagtcagtgaacaacatgatttctgctttctgagaccctgaacaccggaccaactgacatacactggactcctggcctatgcaaaacgtgagatgataaacacatgcggttgtaggctactatgtgtatcgggtgctgttttaggccactatgtttacgcgatgttttgccacaagagaaaaccaatataccaatagaacaatatccaaccttgtgagcacactaaaccgatccttccactccagggctttccactccagctcatttcctgcccatgggtcccagggctttccactccagctcatttcctgcccatggtgtttcaaacatactcaacacttgctctcacatctcttcatctgccccaacaatgaaagtgctaagcaatgttacataaatatcacgcacatagttagaactattccggaaatttaaagaattaaactaaattaaaatatgtgaatactacttgattttatgttgccttaaatacctctacagggatagtcagctaacattttctaacaattaatatctacctgccacaaggtgactggggacctgcttacccattatgcacaatctgaaccaccactgaggaatctttactcctaagaaggtatttacagccagccaaagatctgtggtcaggctttctacacatcagccctgtttcaaaatctggcccctaaaaaagaaagaagaatccaggaaacgtgcctcaaacagctactcccaatttcttcagggcaaaagagaaagtcctctatgacagtagaggatgtgtcccaacatgaaaatgagtgagctgggtcgctttccatctctttccttcctcccagctgctactattgagtccctagtcatttttttaaaacccagactaacatagaactccaaatatgataggagacaaaaaagaaccttatcctatacttgctatggaagggcaaatatagaataactcgtaattttaaaggtacttgaaatcaaattcaatatgaagtctcttcaaatgcaccactcagagttactaagtaagaaatcagaagacatagcagaactagaaagaatgtcctctgccaacgtcccgagggactagagatgaagaaaaagagggttgacttcctcagatcctttctttaatagactttcccacattatttgagtgagttcattactgaagccaaggaacactatacctacttgttccctataaaatgtgagtccattcaggataagagacaagcactgaaagtcacaagtggcgtgtgtgtaattactttcaaaatatattcaggcttgttaaacacctactgatttctgacacaacagcaacagaaccttagctacatcttctgtctaatctcagcaggttcaaacaggacagtgtgagaaaaaaagcaagtttcccacattttccggctcaccttctcaattctaccagtttctaggtaggtgggtttttaaaacaatcttaagcacaattgttgcttcctattcttatttaataaaattgttcagcacttccagaactgccaaattaatgagtagctgatgggaaaacacaaatactattctttccaggttaaacaacaaataaacaaaaatgagaaattgagaggcacatttacatagacatttacattctcagatttaagaaatatttttcggtgtcttatatattattaggcgataaaagtaaatctctaaatagtatgaaggttctgatcctattttcatgttaaaaacccaccaatctgtatggtattttatatttatattcctaaagacaaaggcttagaagggaatatatgttttatggggtggaaattccataactttaaagaacctttcaaatttgccagccactgcagacccaaaaaaggtccctggcacctgcagacataacattcactctctctatcactcacaacaaccctgtgagctccacttcacagataagacaactgaggacttctggggatgaatagttgatgtgctgcctcctaaaatttaatattcttaagttcaaaaatcaattctttatggagtggaatgggagaacttttctaccatattaacaatcctccagtctcatttaattcatgaaattcctgtagatattcagatattcaactgttagggtatctacattctgagttttaagcacacatttttaacagtctgggggtgagtgatccatatgtattaccaccaccaacaaaaaaaaaaaagtaggaaaaaaactatcaaatatcagtatgtaacctttaggcagagcattttcctctctatatttcattatcattttttccatttcccactgaattatgtaattgccatttccaaacagcaaacaacattggactgaaatacaacaatgccagattttcccttactcctctgctgcaaaaaattaacaatatcataaaaatagtaaaaccacaaaaggtatttcactgcattttaatatctccttttaacttaaaaacttttttcaaacgaatagcaccatattccttttgtgataaaagtcaaaaaagtgttacctctctccacatgccaatcagacactggactgtagggcatttgtgttagccaaatcctgaaactaattactgccagtgtacgcttcctgttcagactgcatcagccagtgtgcgtgtcagtagttgtatgaatgctggttcttagtaaatatttcatcatgtctccacgacagggccttcaacagcatactatatttcattcttccctgaacctacttccacattttgttggaaatcatgcacgcaacacgccacacacatcacatacacattttacagggctgaactagactttgtgttctccttcaactctaagaacttgtgttttcaccagacctcaactctgtgtcaaaaagtgctcatagatgctgttgataagcctcagaatatggagacaaagttaaaagacatcctcctttgaaatggaagttaaccaaaaaagagatgatcaaaaactcaagtgactatccatcatgtagaaacttttcctaggatattatccacctatgaaaagatttctaatcttgtggctgatgacagcagcctgcttcctaaacttcctgaagggccagcagtacttccacaaaaaggaaggcatgaattgaaatgctaactaaggggagataagctacaatcctgaaaattataacctgcctttcacgggggaaatgctgtaattatgaaacaaactggcaattgatcaggaaaattgaaaaagaatcactagatggtgcaacttgtttctctccagaagggaaggttagggtccccaggtttgactcacttttccactttaagctagatgatgtgataactatagaacttgcttataatcattctatatgaaggcaaagagctttgtcgagccttgaaacttgttccatacaccactctgaagacttcctatgttatatctttccagctattttcctcttctcactcaaaatgcattgcttcgaagctttattctttacatagtagcttatttcatgggacagtataatcatgagagtataaaccagagctttagcagtcatttttagaaattaggtttaagaaaacttaaggggatgatactctgcccactgactaaacctgtttctcttcaacaggatctgagccccttttctcctgattaatccactgcaggcctagagccaagctgccctgtttattaaaacgggatacccactacagcgtccactgcagatgcacttcaagatttcaaagacttccagccacaagaagacggcaagtgaagaaaataggagaaagtgaatagtaggtaaagactttagtagcctctcttccatctatctacccaaaaactacatatataagttaaattagaaaaattcaccaattttgaagtcaaaagtgtacagaattacaaatacaggaggtaatcagaaacttaattttctcagcttcataaactgtgaagtagatccttctccttctgtttcctttttcttcctatcgatggcagtggtggcctgactggagtggccgctgccatgacaccagctgtagcaggggaggcgcggccaagactgcacgctccacagagccggcaggagccaggaacaggtgggagcctcaccttcctgcccagctgcagctgtggatttgggcatccctgcactctcaggggtacaggaacccccctgcccctacaggcttgtaagtgcctgctcccactgcctggcttctccttgttctgggcacccactccaatttcagagcaaagttgtggctgagcctgggctgtcatgacccaggcaggtgtacatgcacttgaggtggtgctgacactcaagtcccctgctgcctcggacccctccagactttgtgccaacaagcatgggaaggaggctaagggggacactgagggcagcttggcacaggcctgcaggtgcccctcagcacaaatagcctgggcaccctggatgacatgtagatggtgacaggaggccggcaggctcctggcagaaaggggtgggtccctggtgaagtcccaccctccagctagggatggtctgaaacatgtgggccaggctctcagttccaggtggagtccgcggccccctgagtgataacttacggtgctttttccaggcctgcccatggctgctggtgggccagtcagcacgtacttcctcccttctgaagcccataaaaactagactcagccagactcacagactttgggatgacctgctaggggacaggagctgcccatggcagtctcctctcctctgagggctgcacactcgacaggatgaccggcctgcagacaggagctacccactccaggactgctctccgctgacagctgcacccattgggataacctgcctgtgaaaagagctacccgcagaggcgggcagatcatctgaggtcaggagttcgagatcagcctggccaacatggcaaaaccccctctctactaaaaatacaaaaacaattagccaggcgtggtggcatgtgcctgtaatcccagctacttgggaagctgaggcaggagaatcgcttgaacctgggaggtggagatttcagtgagctgagatcatgccattgcacttcagcctgggcgacagagagactccatctcaaaaaacaaaaaacaaaaaacaaacaaacaaacaaacaaacaaaaaacaaaaaacaaaaagaggaaaaagagctacccacttcaggtctcctgaaagctgtactgtcactcaataaagcacctctttgtcctgctccccatccagttgcccacgtacctcattcttcctgcacatggaacaagaactcaggaactgctgaaaagcataactgaaaaagctgtaacacacacagggctgaaacaccccatccctattcctcgccacactgggggtgacaagaaggagagaagggctgcaccccttctgggagcccagacctagagcctccctgagccagggctgtgacatcctctttggggggtctgtggtttctggcatctccaagcttccgggtgtcactgcgttccccttgtccagacatgggtacccacagcagaagttgtttccagtgcatccgatccagccgcaggcttgcccagagctggtgcctgtgccagtgcctggagctgtctgccccgccatagcagccagcatgcctggctgtgtgtatgcctggctgtgtgtagtggctggaccccgcacttgcttgctcatgcaccgatcatcactccacacctggcttgcccttgacaggtgtgggatctgggccagtagcatgagccaactgcagcctgcaagtcgagtgggcggaatgagcccaatgggcctgagcaaaaatcaagcataggcgccacccgccctagaggcttccggctggaaaaggaacgtccgaaagatcctgtgacactactaaaacacaagtccacgctggagacaaatactatactttggatcgttccttctgctgttgtagaatgaattttttttttttttttttgagatggagtcttgctctgtaacccaggctggagtgcactggcgcaatcttggctcactgcaacctctgcctcccgggtcccggttcaagcaagtctcctgcctcagcctcccaagtagctgggattacatgaatgcgccaccatgcacagctaatttttgtatttttaatagagacagcgtttcaccatgttggccaggctggtcttgaactcctgacctcgtgatctacccgccttggcctcccaaagtgctgggattatagacgtgagccaccgtgtctggctgactttgcatgttttaattctgtagtgcagagacctctgaaacagagagcaggagatctgggttctagcctttctctgtgtgtcctcagacacactgttagcttccctgtgcctatttcctcaccagtgaaacaaagcaggagaaaaggtcattcccaatgtcccttccagatataaaattgtttgactttatggtgaagacaatctcacacataagctcaagcctttggctcatttggtcttcagtgcctggaatgtaacaagcgcccaagcaaaactttacattaaagtccctgcaaaatgagtacagctctttggtatcttttgtacacaatgtggtaacatgttttatggattaaaattgtaaagaagaaaaaccaacatgcattaagacaaataataattaaaacccaaaggattcactcttgttaaaaaaaatagttcagtgcttataatgcacaaattgatcaatgcattctagaaaatgcaaagattttaatgaagaccaaatgaggcaaaggcttaaggttagatgtgagattgcctctgccatacagtcaaacagacttatgtccggaagggacaatgaaaataaccttgtctcctacctcgttgaactgctgaggaagtaggctcagacaagctaaaggtgtacctgatagaaactacaccttaagggatttttggaaattataagtatagatctacttctagaaagaagtcgggtaaagcgcattggtagcagacagtcctgtactggggtcatggggcaccagataaacctgtgcagatgggaggccactgtagccacccaaggagttggctgaagtctaccatgctggaaagactcttttcctgaggaagtaaataaggaatgccttggactaaagtgggaagcttccttttctccctgaggttagagctgactgggggcctggactctgaggagtagaaagggtagcatcctacagtaggtgtgagctggtacctgccatgcaggagcagagtgggcgtcaggcaggaagacattgatcaggagctctacgactcctacaaaggctacatgatgtagccggtgtgctttctgttatactgtctgtccttaaaggctgtactcaagtatgctatggggaattagggaaagcttgctttctttctgaagaagcagttgaaagggcagcaccgccatctgaacccagggaaaggtgtcagtggcaattctgagtggccaagtcaccatctcacagggctctgtggcactaaagccacacgcagagtaaggaaatttaaaggacttcttccacagctcatgggaaaactctcgggaatcatgctagggaagattctgacagaggtgaacttcaagcaagtcaactggagataaaaatatgaagtatcacgtgaaatcttagtcacaggatggtgaaaactagaaaacttggaatattttcagacttggaagactgctttccgcattaaaccagtaagtcatgtatatctactatgtgaaaaattaaccatagtattgtacaaaatccagagataagatactgtcctctgaaacaggcaagacgatggagcagagcgtttacctgtgagtccctctgcctgggcatagggaaggaaagtccatttcatgacatcagcaacacaaagtggccataaaacacactggaagcctgaagactcaaaggagttagctttgcacgaaaaggcaaacctagggcttcagcatcacgatgtcagaatactaacatttgggaaatgaatcctgttaggccttcacacaatgtgacaactgggagtgactgggagttagcaaaaagaatgccttagtggattttatctcacatagagcatcgaccatcgaacgcacgtaggcactcaagttccaaagtcactcagcttccaaaacacagcctacagtatgatgaaataggactcctactgtttatatttcttgatatatacactcacatttttaatatttatattgtttagaatatttattaggccttgtctacactcatgatggactattaaagtttattactttttaaaaatgaaaaccaggaaaatggatttaacagttttagtaaacagtctgttttaatgaaaccttattgagacaaatgtcaataccgtaagatttaatggtaattgtgtaaatgagacattgcatgttaacagtccctgtatgtaactgttcctatggttgcaccaaagagctatcacactaggaaacaacgttaattaaagtccttccatcctccagagtcctagaggcatcattcttcaagcaggaaattactgctgctgctggatggggccatttggttacagcacgcgatggatggtttgatgtaagttcttcagttgagcagagatccatggaggagggtggcatgttataggttaaactggaaacttacagagctacgtggaatcaaaagctctgtgatttatgtgtttggtgaatgaacaatacctgtattggtttaaaacagtccttatttttatggtttacaattaatattcttgtaattcaagaaaagcaaaaggtactctaactttctacattatggcaattctatttgctctctggtcaagcacttctaaaggggttggaaaaaatttaatcatgtaacctatagaagttggaaggctacgatgttgaatctcaataagtacagcataaaacagtgtaagatttacacaattaactgaatcacaggcaagacagagtattaggcaagtttttaaccgtcccttactgaccaatagttagaaggtaacaaaagcatcttagaaacatacttccataaatttccttatcctctctggtcccttacaagcatctctggatggtctcaaacaatgcttgttggagtcaagatgaccgtttctgtacttcagattccaggcctatcctggagggatctaaattgtcctcagttactgagcccattccactacaggccactagacaagctctaagtaatctaggggccagatttttatgtgttatggctgcatttaaattgctctcattgatttgccccaatctggaggcaaatctctctccagtgtggcccattcgctggcatgtttccctggaatactagcccagcatggatgtacctgggtcctataagcagtaaattgccctcattattgaattggcaatatttaggggctaaataaactgactttcacatgaggagagaaacatggcagggccctttgagtaacacctaccactcttagagtaatgttctggacacctccaccaacagggctttttggggaaacaaaccaaactgcaccacacaatggcttaaacatttgatagatgcagcagcaaacctatcttatgaaatatggaccgaaatttgagatcaagcttgacttattttcctaaaacaaaatcatactagattagaatggtgcccaaatagagaaagcaaagtcctaattcgatagtcactacgaatacactgtacactaatcagtgagactccaatcagtctgccaaacatggaagcagcaaaatgaaaataaatgagatgagtgagaggactgttacctccattgcatggaacagagatatttttatttattttctcttttaaaatgtagtttgagaaataagcatcaacaacaataacaaactggctgaaggacattgtttgcattctctaacagtacaacaagaggagaatcacatagtgattttgttggcatacatgaaaatctggcagagtgtaaatatttctcaaaaatatatatcaagttcgctataataagatcttttcttatattttaaataatcaagactgagtttgaaaaaaaattagtgaggaaagtctctcagccgggtgtggtggctcacacctgtaatcccagcactttgggaggccgagacgggtggatcacgaggtcaggagatcgagaccatcttggctaacgtggtgaaaccctgtctctactaaaaatacaaaaaattagccgggcgtggtggtgggcgcctgtagtcccagctactcaggaggctgaggcaggagaatggcgtgaacatgggaggcggagcttgcagtgagccgagatcgcgccactgcactccagcctgggcaacagagtcagactctgtctaaaaaaaaaaaaaaatctctcaaatggaaaagcactgaacactacaatgatctaagccaactgctagaaggaagttagagaaagcacgatctgaaaaggctagcatagaaacatcggtggggagatgttggggatcaaacaggcagtaagtgtttagtcattgctctcagataactactccttctatcttgctttctgggtcgatgggtctctcccactgtagccttgtgtgtgcacatgtgtgtgtgtggaggtgtgttgccagggagtcttttacaggtgactataaattctcatgctaccgtcatggcacagttgagccttaatgattttaagttgacgtgatgaaggcattcaatatgccatggagaaaaacatcacaattttatgaaaataaaatgctctttttgatgccttattaaatgcaaaaaaaaaagtttcatctgttatcatcgccttcattcttaattcatctgtaactacacatattggagagagggattagggaaacaattccacctctttcagtctggtttctttgtgtctgcatgtctcttctgtccatgagtggtagtaggaaggggcattggatgtgatatggtctgaggcagcatctgaggaatcagtggcttccataattgcacctacagtttctacgggaaccctcccaggcagtgcgtacatcatcacaaggttgacagcgatcattaaagacattattttccttttaacttacaatctgacttcctataactgctaccttagtttttctttttatacataaaagttatgataacccttcagtctccacctttccaattaactgagaatagctttcctatcctccaccaatcttattttttcatatttaacacatcctatttctctaaccattcctcatatgaaagcttccagatcattcaccatcctataattctcgctgaatatgctcaagtcaaagtccattgttcgtattatcattattaaacagggaccatttattaagaatatgccacatcccagaaagtgttcaaataaattagttgctctaatcttctcaacaatgcctttcgaggcaagtattttcaccttcatctttctgttgaggaaacctaggttcagaaactttaaggaagttccttgaaaccacatgggttaccattagccctccccagtccggtggcttcagagcatttatcgcatgtgattgaaacacagccctgaaggctggatctgtgcaacgcaggaaacaggatggctcgctgccttctgcaaacctaacactatgcttccacggaaacagcctgtgattacaaaatggttttgacaactgtaacacactgttggttcacgatgagtttgtaatgaacttaaagctgaagatgagttttactcaaattgttaccaaggctgactgcccctctcgcaaacacatttccattttgtacttgatcccttttatcagagtaaagttttacctccactcctgctaaatgttagctttcctgctttgcttcagcgtcccacactgtccatttcataataaaactggagtctgacacttggggcatcaatctctttaaataagcaatataggctttaaagctctacattgcttaaaaataattgttcagctgtgtttctgtgccttcgtcaagtctttgatacagattcagtttcaaggagagccaacactgaagcacaccttccctggcctatgcttccccttctctgtttacctagtatgccccgtgtgtagctcaccagccaaactttactttccattgtttatatcaaaacgcaagagccattgtaacatgttttttatttttcaactagcacctcattgcctccttgagaatcactctgcttgatttacaatacatttttctcattcaaccaatcggttacaaattaatccactgaactttaccatgtccaaatttctccatcttcttcacaaagatgtcagccgtgaacatgtattttctgatatcaatgtctgtggtgaaactgaaaaaaattctaccagcaaaagtttttatatcccagaaaaaagttgctcttaagaatctgtcaaatgtataaaaataatttattatagaagaaaataactggccaagtttgctgtgccactcagaatgttcacagtgacattaaaagaaaggtaagtaaaaaataaaaaatttgtaaccacagtgattatcagtaatgaatctgaagcacagacataaattaaatctgacaaaatgttcaacaatacttgtacctcggtcagccctaaggcattatcctctctatgtgaaacactataaactttcttctagactcttggaagactctgatagctaggactcgaagactgccagtttaccctatttattccattacataaatgcaaaaaatagaaagactctcctcaaagttaagaggaaaagtttctcttgacttggatcaatttttccagaaaatgcatctacactgaagaaatacagtatttctcaaggttacaaaagttccataagtttcatagtaaaacccagctagaagtatattactggagctgcctatttccagaattcagatctagatgagtaattggacacgctggcctaagaaatgaaacaaaatcaaagccagaaaaaggcaagaaatagttttgtgcacggtccttggggattcctgcagcagcccatccatgtttataaggatactggatgactaaattttctataaattggtatacaacagactaaataatttttgatgtaagactttattttcaaaaaccatatagacttttttctatgttcctgcaatctgtaacaatttagtaacctacctctcatccccatcctaaatgaattcagcgtgaaatggatttgaatcttctgttccaagaaaaacactgggtgcatgagcacattataaaaacataacaggaatgatatgggggttgggagacagaggaagcagagtaaatgggaacatgggaaataggtgggcttggtattagctgtcatgagggacgaggaagagaaatatgtgaggacacacatgtgtgcactgcctgtgctgcctgggacagagtctcagcacaagcctgaggaaagggtggactctgaaagcacagtggaatgaagggggagaggggctggcttggagatgtgtgtgataccctgccctctttatgacaagggcaggagctggaggcaggaagaatgagctctttgaatgaagacatggcatctgaaaccttgctaaaagtgcaagccattccatcttggtgcacacacagacctgctcatagagcctgaattcatgccctgcgtgaatcctccctgatactcagagaactcaacagtcagctgtctctgcagttccagacaggttgtgttctcaactgctaatttggtcttgacaaacatctctgacaaaaggcattcaaccgccctttctctgagaggaatctgttttctttacaaagaaaaacaaagggtatacccttttacaccgaaactacaatgcccaccacaacgtgtcttttaaaaattactcattctccaagcaagaaaaggtcatggacattttcaaattatcccaccacccctatgtacagaatttgtaagttttctaccaagtaacaagtgacatggccataaattatgcaaaaaaggataaaattcatgtaaataatagctcgcagtcaggatattaaagtctatttttaaagctttcaaaattttttttgttcctaccatattgttggagactttgtcttttaaaaaatataaggtcacagtttacttttgattgtaacattttgggacattatacatatttttaatctgatcccctgttacagactagggaaataattttatatttagagactgggtttgagtaattttccagagtcctagaaaaataaagaggcatcttgtatattttataccaacattccccagctctcaatatctaggacagaaaagtcttaagacacacacttacctctacatcacaggtatattctgatccatcgagaagtatcactttgcactgcatgcttttaggctttttgacaatctttaatggagaccgagagagtttactgctagatgatttctgagaaagtttatcgtcttctaattgctgatattcgagctgttttgcagccctggcagcaaactcctgttccttgtcagtgacctgtgaagagcaaacaatcaacagttttcattgcaaggtgggaaataaatattgcattgctcatgcaatagcacaaaactgctttctatttcatagaggagaggtattgaattaggatattaggaatagatataaatatacagatatttataatatttgcctaaatactgtttgccatttaaatgtatcaataaggccttatttcattttaactccaggacttactttagaaccactgagttagcaaatgctatcaagatttcattaagcaaacaatgaataattgactcctgactttttaaaaaggattggatagtataggcctctaaaatatactgtttagatttcatcttacatgttctattttcttaattcaccagatccttctatactctacaacttgttatacagctgcctcatccctacatatacaagatatctgataaactctaagacctggagagcttcaagtattaatcttttcagtacttttacaactgttaaaatgtttaatttagctctcaatcaattcaatgaagtcagcagaactgaaattcatcacaaagtaatcccctatgtctgcttcccttcactgtaatgaaccagtgtaagaacatatcaaatctgtccaatagctttaatctgctttcaaaccataacagactagtccaggctagttataaaactgcagaggacatcttaagtaacagtaacattctcccgtataccaatctctttggaaatgtgcacacagatctccaactattctctctgtacatccatcttctacctattaaatggccaccaatggtagtactgcaaattcgatccttgggctgcgccaccactgccactagtctgcaaatatgtgctgacagtccaaaggaagacatgcaccagaattctgtttagggctttgaaataagcatggcatttcctttcccgtgtacatactatcagcccttacttttcaggggctcgaaaagtaaaaacaatattgatggtttatcatcttaatttttctattagcctctacatttttataacactaatataattacaaagatatttgggtatatttattttgggttttaggtacagatttctgctttatcttcattttctatcttgttttccatccaaaagattgctaatacagtactctcctccaattctatcttgcccaggatttcaaggcaaagtcttgagaacttcttaagaattgaaagagaccaatctgctgagcttatgaaaagaaagcaacaaaaaactgaatagccaattctaaaggccaaaacagttgagaaggcaagttttagcttaaaaaaaaaaaagtaaataaactaaagaaaacctgctctggcaactcagtcctacttttttaatcactgtctttctatagcaaagtattaaaatagtaagtgcaagaaaatcataaaattgtcattaagtttggccttgaggtaattgacagagaagtttggttactttggtattgtatatcaacaacaataacatattcattaagtgctttataacttacacaaattatgaacatttaagttttatttttgtctcttcataggcaaaggtcattagaagctattaatacatttttatttaaattttacctgaaatcaacattttctatgtaacagggaagatacaatgtcgcttttcctttactaaaataaaaatatctgtatgagaacaagcttctgggttactttaaatgtcaattccagaggcatcttaaggcaccaactttcaaaggataggcattgtttctgggaacactggaaacatgaacccaacactaaggcccttacatacattttttaaaaaaactttaagaactcaaaaatagcagactaagtacctcaaatgaaatgtcaatcatagtcatatgatgcgttctaattttaaatatcggattttagctaattctcaatctcttttaatcctcacagctctatggtatgggtattattaccctcatttgcatataaggagagagagacatggggagcctaagaaactcttgaggcataaattcaatggatttgaatggaattcaaatctagccaaacccatgttctaatcgttactatgtaccaaaatcagcttcattttacttccaacagatagcttcctagcctgaatcaaagaattttgtggaagaatctcagaaattatcttttctgaactcttcattttgtagaccaagtgaggcttggggacttgcgtgagttctccgaagatggtaaaacaatgactagaagagacaggacttcaaggtctctgccttttgcagccagtcatctctccctcttagtgtcatttctcttgttttgtatctgactgcagaagataaataaagtatatttaatcatgtctaggtatagatattcatacttttctataattatctcccattttcatgttatttcatttcagagtaaagaggaaagaaggaagaaaaagcaaacatttactttagtaattttaaatgtttgaagattaaaaaaaacaaaataaacaaaaagaaagccagacactatcatcatcattcctccacaaaaagaaaaggtaaaagaaaaccatgatggctacaacagttccttaggtttgtctactaagctgggatgggatctccctgctctccatcacaaagcatctgagatgagacagagcagctatttatagagtgaaaataattgttatttattaatattgtttaaagcagaacttgtgacattcattttaaagtggtggcacagaagcaagctggtttccctcctcccatccctccacagaaaacctaaaacaaatatacagcacaagattttcaccagcaacaacctggaactcaaatatgaggacgagacagatcctgaggccacagaaaagtagaaaaactccatgcagatggtgtaagaattggacttccatagtcatgatgcccctccccttgattctgcccggcaataaaagtgcagaaaatcttcccccaactcgtagaaaaatgatactggaaaagtgagactgaggtggccaaccagctttcccaccttcctgggattccctgcaggagacctgcccttgccttaacccatgggaaggaagtgatgtgactctctgaagggagaaatatccccgaggacaggcggagaaaaagccgggagatgggaccaccaccccagtcctggacactctgctctgtaacttggccaaaggagacactgaatcagagtggctgttcagcagcaccacactggagaaggcacattccacagatcccttgggcacaaactcctagtcagccatcccacattgccaggataatccctcattcaggacaagcggcactcccatcgcttacgagagccaaggtgatctgggcttaaaggccacctagcgccaaagaggtggcagaggcctagcggtaaaaaatttctaagcaaacatatccaataaaaaacaaaacaagccagacagagaaaactgcaatttaaaactaatccttctatacaaagacacagacacccacccacaagaaacaatagcaaacaggacctccccaaaaagacaagggaaaatccaaccctacaagatggcgatttgtgagctaagaattcaaaataacaattttaaggaaactcatgagctcaagataaaaatgaaaagcaattcagaaatttatcagataaatttgatgaagagattgaaatacttttaagaaatcaaacagaaatctcagaactgagaaatacatttgataaactgaagaactcattagaggctcttagtagaatgaacaaagcacaggaaagattcagtgagctcaaagaccagctatttgaaaagacacagagaaaaaagaaaaatgaacaaaaaggaacagagtgcatacaaggtacagaaaattacctcaaaagaccaaacctaagaattattggtattcaggaggcagctcagcaagagcaaagggtagaaagcatattcaaagaaataatcacaggaaactttccaaaactcgtgaaagatataaatattcaagtacagggaagtctgagaacatcacacagattcaacctaaataagaataccacaaagcaataaactctcaaagctcaagaacaaagacagaaccctaaaagcagcaagagaaaaagaaacaaataacaggtaaaggagctccaaattgcctggtaacagaattctcaacagaaaacccacacaggccaggaaagagtggactgacatttttaaagtgctcaaagaaaaaaactgtcatctaagaatattgcatccaacaaaattatcattcaaatataaaggagagatcaaatctttcccgaaagaacaaaagcagagagaattcaccaccaccagacccatcttaaaagaaatgctaaagagagttcttcaatctgaaataaaaaaccactaatgtgcaaaaaataaaaatgaacctttcaatgtatcaaacctagtggtaaaatcaagtacatggataaacccagaatactctattactgtacttactgtacttgcagtgtacaatgtactactagtactaccacaatcataactctagtatgaagcccaaaagacaacctatcaaaaacaataatacctacagcaaccagtgaagggataggtaatattaaaatatgcaaattgagacaactaagtcaaaatgtaatggggatggagttaaagtatagaattggggtgtgtgtgtatgtgcgtgcatgtgtgtatgtgtagttttttttagcctttgtttctgtttttaaatttgtgatctaagataagttgtcatttgtttaaaataacttgctgtatctataagatgtttctggtaagcctcatagtaaccacaacacaaaaacctataatagatccactaaaaataaaaagcaacatattaaaacacattaccagagaaaatcacttagccacaaaggaaaaccatgtaaaaaagaacaagaggagtttcaaccagaaacaggcagcaaaacagcagtaataagtccttatcaataacactgaatgtaaatggtctcaattctccaattaaaaggcctaaagtaggtaaatggatataaaaacaagaaccaactatatgttagcttcaagaaattcacttcacccacacagactgaaagtaaaaaggtggaaaaaaaaaccattctatacaactagaagccaaaaaaagagcagatgtagctatacttatataagagagactaacaaatctaagactaaaatgagaaaaagcaggtcactacataatgataaaggggacaattcagcaagaagatgaaacaattacaaatatctatgcacctaacaccagagttcccaagtatataaaacattcgtaaatctaaagggagaaacagacggcagtacaataatggtaggggacttcaacactccactctcagtaagggacagaacatccagacagaaaatcaacaaagaaacagtggagttaaactacacactagatctaacaggcctaaccaacatttacacatttcacccaactgctgcagaatacattcttttcatcagcacatggaacactgtccagaacagaccatgtcttaggctataaaacaagtccaaacaaactcaaaaaaaaaaaaaaaaaaaaaaaaaaaaaaaaaaacagaaaaaaaaaatcatatcaagtatctttcctgaccacaatggaataaaactagaaatcagtaagaggaacctcagaaaatacacaaacacatggaaattaaacaacatgccctgaatgaccaacgagtcagtgaagaaactaagaagttaaaaaaaaaattatcaaaacacaagtgaaaatgtaaatacaagataaaaaatctgtgggctataacaaaagcagtactaagagggaagtggagagcaataaacgtctatatcaaaaaagtaaaaagccttcaaataaataactcaacgatgcacctcaagggactagaaaagcaggaatgaaccaaaccccaaattaggaaaaaaagaaatgatgatgatcagagcagaaataaatgaaattgagataaaaaaaaaatacagaagatcaacaaaacaatgagttggttttttgaacagataaacaaaatagacaaacctttagctagactaagaaaaagagagaaaatccaagtaaataaaatcagacatgaaaaaggagacatagcaactgggacctaagaaatatgaagactcattagcgactattatgaacaactatatggcaacagattggaaaacccagaagaaacggataaatttctagacacatacaactcaccaagaatgaactatgaagaaacagaaaacctcaacaaaatagtcatgagtaatgagatcaaagctataataaaaagtcttctatcaaaaaaagcccaagacctgaaggcttcatttgaattctatcaaacatgtaaagaaaactaatactgatcctacttaaactcttcaaaaaaaaaaaattggagaggagggaatacttccaaactcatgctacaaggtcaatattactctgataccaaaagcagacaaagatacaacacaaacaaaacctacaggccaatatcactgatgaacattaatgcaaaaatcctcagtgaaatactagcaaaccgaattcaacaatacattaaaaaggggactgaaaagatcattcaccatgattaaatgtgattcatcctagggatgcagatggttaaacatacaaaaatcaataaacatgatacatcacattaacagaatcaagaacaaaaaccatatgattatttcaatagatgtcaaaaaagcatttgataaaattcaacatgtctttatgattaaaaatcctcatcaaaatcagtatagaagaacataccccgaaataatacacaccatatatgaaaaacccaaattagcattgtattgaattgtgaaaaactgaaggcctttcctctaaggactagaacaagtaaaggatgcccactttcagtattatacaacataatactggaagtcctggctggcacaattgggcaaaagaaagaaataaagggcatccaaactgaaaagaaagaagtcaacttagtcttgttcacagaagacataattttatacctagaaaaccctaaagactccaccaaaaaactgtgagaactgatagatgaattcagtgaaattgtagaatttatcaacatacaaaaatcagtagtgtttaaatttgtcaatggtaaactatctgaaaaagatatcaagaagcaatcctatttacaatagctacaaaatataaaatacctaggaagcaatctaaccaaagaagtgaaagatcggtgtaaggaaaactataaaactctgatgaaagaaattgaagagaatgcaaaaaatggaaagatattccatgctcatggattagaagacttaatactgttaaaatggcaatactacccaaagtaatttacaaattcaatgtaaattgaatgtaacaaaatacctatgacactcttcacagaattagaaaaaatgtcctcaaatttacatggaactacaaaagaccccgaatagccaaagtcatcctgactaaaaagaacaaagctggaggtatcatactacctgacttcaaaatttactacaaagctataataatcaaaacagcatggtactggcataaaaatagatacataaaccaatggaacagaatagagaatccagatataaatcctcacatacagccaactcatctttgacaaaggtgccaagaacattcaatagagaacagtcctttcagtaaagggtgtagggaaaactggataactgtatgagaccaatgaaattagacccctatttctcaccatccacagaaatcaaataaaaatggattaaagaattaaaaatgtaagacctgtaactatgaaaccactagaagaaaacactgaggaaatgctccaggaggttggtctgagcaaagttttttttgtgtataagacttcaaaagcataggtaatcaaaacaaaaatagacaaatgggattacatgcagccaaaaaactactgtaccacaaaggaaaaaattaacaaagagcctacaggatagtagaaaaaatttgcaaagtgtctacctgacaagggattattaaccacaatatctaaggaactcaaacaactcaatagcaagagaaatgagatttaaaaattgacaaaagatctgaacagatatttctcaaaagaagacacacaaatggccaacaggtatatgaaaaaatgctcaatatcactaattatcagagaaatgcaaatcaagaccacaattgagatatcatctcaccccagttaaaatggcatatatcaaaaagacaggcagtaatagatgctggcaaggatgtggggaaaggagaatcctcataaactgctagtggaaatgtaaattcatacagccactgtgaaaaacagtatggaggttccttgaaaactaaaaatagaactatcatatgatccagcaattccattactggatatatgtccagaagaaaggaaatcaatatatagaaaagccatctgcactccagtgtttactgcagcactattcatagcagccaaaatatgaaatcaacctaagtgcccatcaacagaagaatgaatttttagaaagtggtatatacacccaatgaaatattattcagccataaaaaaggaatgaaatcttgtcatctgcaccaacacggatggaactacaggctgttacgttaagtgaaataagccaagcaccaaaagacaaatactgcatcttctcactcatatgtgggggctaaaatggaatctcatgaagatggggagtagaatggtgattacgtgaggctgggaaggatagggaggatggtagggaggaggagtgatgaagggaatttttaaaaaatatacatatatacaaaatataatatatatattttttatataaaaatataaatgtacttattaccactgaactgtacacttaaaaaagatagtaagttttatttgtatattttacctcaaattttttttttttttgagacagagtcttgctctgtcgcccagtctggagggcagtggtgtaatctcggctcactgaaatctccacttcctgggttcaagtgattctcgtgcctcagcctccctaacagctgggattacagacgtgcaccaccacactcagctaatttttgtattgggcccggctgtctcaaactcctgacctcaggtgatccgccctcctaagcctcccaaaagtcctgggattacaggcatgagccactgagcccggcctcaaatttttaataagtataaaattgaaaaaaaaaaaaggcaaacctgcaaatactctaggtaaagaaataaaataatcaggttgcaaatatacagtttaatgctgtgacttccaaagattttcactaatatgctgattatatctcttatctcaacatcttagaatttctagtttgaaacacttctgacatataagaggccaatcacttgtggggactccagattgctttaccacatacaaatcggcactctaaaacattttgattccaagtttgaagttttaagacaaaagacatttaaatatggacttattcaaggcccacatgtaaaaccatactttaaaacttttaaaagtaatgcattattcctgactactcaaacatgtacagggaaaaagagttgaaaatgtagatgtgtatagggagggaaagacctacctgaagatccactaagaaaccatggaatactatgcagctataaaaaaggatgagttcatgtccttttcaggacatggatggaaaccatcattcttagcaaactaacacaggaacagaaaaccaaacaccgcatgttctcactcataagtgggagtcgaacaatgagaacacatggacgtagggaggggaacatcacacactggggcctgtcggggactggggggctaggggagggatagcattaggagaaatacctaatgtagatgatggattgatgggtgcagcaaaccaccatggcacgtgtatacctatgtaacaaacctgcacgttctgcacatgtgtcccagagcttaaagtataataataatgatgatgatgatgataataataataataataataataaaagcagatctgcaatattagggccagggtgatgcctggggaaatgcaaactcactctagcccttagacttgaaagaaaaagcaaccacaagcataattaaagctctcagtttggtgtctatctttcctctaaatccagataggaccaataatctccagtctggacttcagtgagtttcagtgttttaattaaaagaaggagttaccaagcaaggttgtggaatgtcattcactgaaagccttaaaatagcatacattttcatctgcctggggctagaaggggaacagcagatgacccctcatagctgcctctagggctaagagaccaaggttaaagccgatcctggagcagctcagcaaacactgcgtcattagttttctggcctgggctcacctccctccgcaccggggtgctgtgcgctgcagcggcggcgaactgctccagggcctgctgctgctcctccttgggcggctccggcacgggcgcccccgcgcgcccctgcgcccccgccgcctcctggggctcggcctcctggtccggcttggattccgagtctgatccagattcggtcgtcatggttgattgttctgcaagcagaaaaaagggaagagcaggtcactccgtgccactaccttccctctgcaagaaaactaggatgctcaccgtgaaaggctcaagagaaccacagagagggagatgctaccaaaccccatcctattccacacactggacagatgacttgtcaacttcaccactgagatgggtgcccaccaggcactcaaaactaacatttatctaggaggaaaagttgatctgtaatgatcacaggctttattcctattagatttttgccacaacggattgttaaatgacattaaagaaatgtcataataattaaatatcttacattcaattaaaaaaatttgctgtatcacctgcatatatatttcaatcccttggaaggatgatttaataacggaagcagacattctttctcatttccctcccccttcctatctctatacaggggccctcccaaccccctgaatctacagatacttcaaggaacaaatgcctttcccatgtgatttctcttaatccagttatccctctttgagttagcaactgagctacaacagcagcttcttcagggactcgggatctgtcccactggccatagctgcaggggcacaggcaggatcacctctccttccctcccaagttaattctcatcttcttcctggcttccccctatttccattgagtgttgaaaggtaaatttatctcatatctcatagggaactcaaacaacagatcttaatatataataatctgctgatacatcctttaaaaagaccttctaaaatatgaacatcttcccaaagattgcaagtcaagatgtttcaggatttcgtgcctcagtttccacatgtgccaaatgaggacactgaacgtgataatacctaaataacttatttcttgctattacatttttttctcctactaataagatatgccacaatgtttttaaagcagatttttgctctaagcagcaagagagctgctattacgccaagtagatcccatgtcattttaagcaattacttaccttaggtatatggagtaagtatctcaagtacaaatatctcattattgtcatacaatttcccttcctaattataattttatagtaaaagtatgagcaaaggactagtgtagtgctttaggcaaattatataattggtataatatagaattgtgcaaaaataaaactagtaactcttagttcctatcttcacaatatatataaaaatatgtttaataatttgaagaaaagggagcatcacaaataccaatctaggttataaactaaatgctatatctgggttttctatttagggttactttcacaatcaccagatattctttctgttgaataaaagagacatatcaatttggcatgtgcttagttgcccaaagcatatataaatatcgagtctgaatacagagaaaggtagtgatgcaaataaaatgaacagactttcttttttcctgttataatacattttagattttcgagcaaatcttaaaagtaaatattatattttcttttgtatgcttatcctggaaagtggcataaatatatagagaaaacagtagaggaggaggaaaggttgtggagggctgcagaatttagagcttctgatcaaactccatcttttggaagggaaaggattagctttaatagtcaattcaacccaccaaacacttactgagtaccaaatataagccaagcactgcttgtggtttagaaacagagattcatctgttgtaaccactaccccccatctcaaggagctcctagtctgtgccggaaatatgctctctggaatccattttcttcatcttcttttggtaactaagctttcagatctagcaggtgcctctgcacccagcctgagactacaatgagctgtggctgtggattaagactggaccaaggagacaacagaagaaaaatgcactcaatgtttaggtcatcttcataaagacaaagccactcaccctagatttccctttcccactggctggatgtgcaggtcttaaacccagtcctggacatgtcacattcaggggaatgacagagccaccccttccagcacgggtctctggatgacctcatggaccatgacccacctactctggactgtgacgtaaggcagaaatcaacaactttagcttgtgttcatttgctcaggaaattgcttattctatttcctgagcaaatgaatatcccatgattttagtgttatcagcctagtcgggaaaccgttttgcacctgcttttgtcttaaatccaggaccatcaccaaagcagagagccagcagtacacaagctaaataaaaatgtaaaatggatagagcccaacaaccacctaccaacaatctaaagaataaaataatgtaccattaccatctatgactgtaccatataataccttacctgttgtatatcacacaactcacagcagctcatacctcaaaatcatctactatgcccttgtcatatatttcctaggtatattaattttccagcactataggcataatataataaatgcaaattgttgccattttggccacttttaataaaataaaactgtcaaggctactgagagataaagtaataaaactttaaaatgtacgtcttttttaatgctggaatctcactagaatcaatatctaattccacatttctcaaaggacataagctcttattattcctacaaataaaccagtatggatggcctagatcagcaaattctatttcaaaacttgtttcctcttccccacccatataccaatgtaagcaagcaataacctgatttttaatggcaaactaatatcaacatctaaatacaatatgtctggctgggcgcagtggcttacacctgtaatcccaggactttgggaggccgaggcgggtggatcacttgaggtaaggagttcaggaccagcctgaacaacatggtaaaaccctgtctctactaaaaatacaaaaattaaccaggcgtggtggtgcttgcctgtaatcctagctactaggaaggctgaggcacaagaattgcttgaacctaggaggcagaatttgcagtgagccgagattgcaccactgcactccagcctgggtgacacagagagactcggtctcaaaaaaataaatacaatacaatataatatgcctaactttaactcgttattttaataagcttttagtgttctccttcactcttaaacccaaatgccaaaacatttcttttaaactagattttcaagatatttacattgctttggttctttttcttatactcattccttgctttctaggatggtgctgccatttaaaatcacagctttccctttccaactaactaaagactattgttttccaaggttcccttctcttctgataggttcactttgcacgaaactatctgccaattatttgggttactggaagcaaacatcatcacttgaaatcccaaacagaaagtgagacaaaatgtatttatgcttagttttgactgaaactgtcctttccttatactaaatttaccttaaaattgtgttttgctcaggctttaaaggtttggattcctggaaactccaaatcctaaaagttggggtaaggacattcataagtatgctaggcagatggcaagaggagtccttaatttttttttaaagaaacgtaaatcatatttcaatatccctctctcaggaatatatttattaaatgaacaccaaaagaaatggtaatgagcttcaaaggatgcatgtgcaggtgtgaatgaaatcatcttcacaatccccaatctaattcacctataaaaagacggtcattgccatgcattttgggctttgttccttttcagctctaattttttattccacagaagcaagaaaaaaaagtcagttaatcctcatcttttccacttttagaagtggcagctctaaaatctccatctcctaactaaatgactgctaaattagtttctgtattcaaatttatctacctctcttgctgacataaaaattcagtggcattttatgaaaagacacaaactaaagatttagtgaaggaaaatgcttaatataaatttctgtcatttatgtgtaagacaggattcctacagaataacaaagcatttcataaaagaaaacgtcttcgtaccatttacctgtctaacgagtatataggactcaaatggacaaactttttaacatcaacctttttttcttttatatttcaagtgtaaatttataggagaagtgggtcttacttaacataagtatttgtgactatagagtactatccaccagtctgctaaaaaccatcagttgctagcaaactagaagacagtaatattctttggcccttctactgaattttttctatttgcatgaaaaaaaaatgccctagtatcatccatccaaaaagaaaatcccaaaaagaaaccaaaacaacctgctgttggtctcactttccactctcctactccctctagtagggccctacctctctacttttctgtggtgccaagcttctggaaggaattttcttctcatgctgtcaccacatcctcccactcactcacacttcagtatattcctcataattctagtaacttcgctaaggtgaccatgacctccccacaagccagtcaatcctaggtggcacccctcctcatctttcagttctccaggtttgacaccctcttggtttccttctatcttttctggctactcttcctcatttccacttgtctctgcatatcccatttctcatattctatttctaaacttcacaattctttacaaatccatctcactctttaaattctctttcttggagagctcatccacttcatttcaaatacaatgacaattccaaattttgtgacctctcactgagcttcagatccataaatacaactcttcttctcacttctttacctggatatctcagaagcacctaaaaccgaacatttttccatccaaacctttgatctctgcaccaccccctgcctgctgccaaccccccaatctgcttgactcctgtcctccccattgcagcaggtggcctccatctgtccagaggctcatgctgggactgggacagcacttccctccctatgcctaactccaatccacctcactcttggcaatatcacctcctgagttgtgtttaaagaaacagtagaagaggctgggtgcagtggctcacgcctgtaatcccaacactttggaaggccaagtcgggtggatcctctgaggtcaggagttcaagaccagcctggccaacatggcgaaaccccatctctactaaaagtacaaaaattagctgtgtatgcggtgggcacctgtaaccccacctactcgggaggctgaggcaggagaatcgcttgaaccggggaggcagaggttgcagtgagctgagatgatgccattgcactccagcctgggtgacaagagtgaaactccatccaccctccccccacccaaaaaaaaaaagaaacagtaaaagaaagaatggaaaaagttctaggcagaggattccaatcaagcaaaagcagaacagcatggaggatcgcatgcacttacttgcgtgaggttacatggtctgatgtagcaggaaggaaggggtgcgtgagagtgatgagaggtgaggaaaagggattgagagcgagacggacacaggcaggtcctgcaaggccgcctgaccctcgctaaggagacatcatcttgttactcagggatcatctggcagacatgggaacctcagaaagcattaactgggcttctccattgtttcagctcaaagctaggccaaactcagagaccacacaggccctgaaggggcagccgggacaagttactcctcaaagtaccaaatggtaaaattcaggactggtcattattaaatatcttcaaaaagttgacaataaagggttgagatgcagggacaattctgatggtttgtaaaaaacaagctttttggccatgctaagttcaaatcttgaaggccaatacaccagctcctgtggagctgactgactttttaagattatgtaagaagcagaaagtcaggatttttatgaagacataataattcaaaaattaatctcacaatggccactgtaaatctgcaaagggttaccaagattcatcaatatggagacaaagatttcataacagaattgcacatttacaaatcagtattggaaacttaaaaaaaaaaaaaaaaaaactaaatgaaacagtaaggccacaggccccagtcccctgcttcaaggaatgcacattcagacaggttacctcaagaagcaagccaagcaccatgcccagggtgttgagaacacagcccagagagggggctttaaccaagtctgtggggacagaaaggattttcacaggaaagaacacttgtctgattaaaaaaaaaaaaaatcactaactttcagtctcaagacaactagttttaaactttagacacaaacatcacaggctacttcagaaagatacaagggaaatcaggaataaataagagcgcagggaggcactgtgacggggcaggaaaagtgggttccgcgcccaactctgccatatgctctgtgaccttaacagaacgtggcttccctttctgttctaaaattccaaaattctaggattcctgagaaccaaagacactgttatattcacagcaagaaatctaaagaaatgttgcgaagtgaagacagatactacctgatcctactgacaaggcccaagggcataaaggtctgagggcaggcagccgccagccctgtagcaagcacagacctctcccaccactgtgtgggtcaggctgaaggcttcattaactatttgagtctataaaggttttatttagttcactgaagcaatactttacacagataacctgaaaaagttgaaaaaaacacttaatagattgggaaaatctggtttatctgcagtaagcttttagcttttaagttcaaaaatgtttagatcttctatgcgtgagcagaaaaatcaacaaatatagtttagaatatatagagagagatatggtgactatggaagcatccaccttaccactatatgttcatgtttccaaatccaacaggtaccaaatgccagcgcataaatttgcctatgcttctgaaacaccaagaatctttggttgatcccacatgtacccaaatacattttaataagcaaaggaagcagctgatgcccctactcaaggaaggggacctatgttagcagagaactttaatagagttcagtgacagtattaataggagaggcagggttcccctgggggcaaaactacttgcaaattaagtctattgagggagtggcagaagaaccaattcaaattctgttctaggatctctgcactgtgaacactctgtcaaaagcaaggaagttcccagactaggattcctgaacttcagaggttcagcaaaggaggcctgattatctaagatttcgttttgctattttaaaggaaagtgtacattcagcagtgacatggctgtacacactgacaaggcttttttgctttatgttggaaacttatcaattaacttagaaatactggctacatcattgcttcattcattaatacattcctttaacaaacatttcctgaacagctgttttgaggcctagggatacatcagataaagatgaacaaggtctctgctgtagtggagcctacattctaattggaggaggaaaagaaataaaaagtgtcagagatagatgctgttaaataacccacttaaaggaaatagctggctgctctagactggatggttagggaaggcttctccaagaaggaaaaatttaaccagtgttgaaatatcaagaagaatctgccatatgcagatacgcacagtggcgataaagcctgtgaggaagatgattgcccaggcttgggcaaggaatgaaaagaaggccagggtagctggaatgcagggggtgtgaggaagaggggtacaagataaggtagatatgaggaggggtcagatcccatgggtttgcagagctggattttattttaaatgcagtggagcattctgaggtgaggaatgatagggtcttatggatgcttttaaaaggtcattctggcttctgagtgcaggtgcaagtaggagcaggggacccagtgactaggggatggcaacagtccaggtgagggaaaatgccagagcaaggtagcaggtgagggaacgaaggtaagtggtgcctgtccagcacccatcagaagctctcactgcagctttggtgagagatgagaaatgtacgaagctggtaggacaaagctcccacaagtgttaggtctcttaaaacacagggatccctagtggcaaaaatattgtttccaataggccctaaggcagggagactaccaacaaacaagcgtcaagtttcaacaattattcttctagactggatgctccatcacctttaacacgggaaatcattcatgaacccgatatcatcagcaatacttctaaaaatcatccagttcaggtgaaaagtaatgcctgccttcatttataatggatatattcctgtggtttaagtgacagctccagtcttccaaaaaagcaaatttaaaacagattaacatgaatatgtttggactcttgagtagagaatgtgcttctagacttcatctgagaacccaactaatggataaatgacatctgtacttacacatttgtttcgacataatttggcagagaattttagtctccgtaaaattttaacgtgactatcactgatgctgccattatcagaaacttgctattaaagtttctatgtggtctgtacaagaattctgttagtgctattagtctacacgtgaatcctgccttgccctgggttggacttagaaccacctcactaagcacagggcagtgtttcccagaacatacttaaactttttcacttgacaagcattttcacatattgttctaaacacagcagaaatacttgttcccaagatacaaaactgctaaaaaaaatttttccaggagttaacacaaatattccaattgagcttcctgatagctgtgcttatagcagttcattagtgttccctatcattaaaatggagttcagacggctgggcgccgtggctcacgcctgtaattccaacactttgggaggctgaggcgggtggatcacctgaggtaagaagttcaagactagcctggccaacatggtgaaaccccatctctactaaaaatacaaatatcacctgggtgtggtcacgggcacctgtaatcccagctacttgggaggctgagtaatgagaatcacttgaacctgggaggtggaggttgcagtgagccgagatagcaccactgaactcctgcctgggtaacaagagcgagactccatctcaaaaaaaaaaaaaaaaagaaaatggacttcagaactgatgacatcatttcccttagcaaaggcaccctcacaacagcatccttgaggttttaagcaaaaaaatcaaatcaaagtggacatttcagagcatcaatgatatacataagagcaaaagtattcagcccttatgttaaaccgaatcctggaaagagtgagcgaataaactaaatatagcaactattttctccattttctgttaaccgtaaatcaccctttgtgaagaagaaactgccattgtgccctcaatgtgccaggcataatttaaatactgcatatttgcttcttaactaaactttaaacaaatctgatcatatcctccctaatggttccctaaaaggaaagttgtgtctaaaatgcacaggatcttcatgagtttgacagaaataattctctataagccatgtgtgatggtgtgattactttttagttaaacagggatgacgcctgagaacataaaggaagctagtcactcggaagacacaggtggggatgttagttagtcacctccctcctgctctctacatgctcagctcaccccaacaggacaggggttcagccaggttagtgaacaactcgcctaagtcacaggataaggagcacagcatcaagaattaaatctgagttctgcctccaataacagagctgtttatcccacacaagtcatgtacattggtatgcggtactactcttcacctcctattcctctttcagaactgggcaatttatcaaaggtattgctttatgggatcacctacagttgcatgttgccaatatgccaccttatccttttactcactgtaagtcaaatattaatcaattcaaatttttgtaaaattatactttgttttggctgggtgcggtggctcatacctgtaatcccagcactttgaggggccaatgtgggtggatcacgaggtcaggagatcaagaccatcctggctaacacagtgaaaccgtatctctaccaaaaaaaatacaaaaaaattagccgggcgtggtggcgggcgcctgtagtcccagctacttggaaggctgaggcaggacaatggcgtgaacctgggaggcggagcttgcagtgagcccagatcgcaccactgcactcaagcctgggcgacagagcaagactctgtctcaaaataaaaaaaaaactttgttttaaagactatattccctactacatacttactatgtgtgtgtatatatatatatatatatggcattacaacactagtgtcttcctttgctgaaaaagttaatctagtgtgaatctttaagatcctgtcattctgtcacaggttgacatttattcctgggaaacaaaaaataaacgctcactgttgtttctacagaaaacatgaatggcactgagtctgcttttcgaggctcaataactcataactttccactatggcggctttaagctttaaaacagactgagcctacattttaatcagttacgattttgaagctgttattagtgggaaacctcaaattgataagaagtcagtacctttcaagatataaatgtccaaccctgtttaaaatttccaagcattcctttgctaaaatcaaaagaggagagagaaaaaggtagcatattttatctatattcttcgccaattctattcagagaagaacttattagcaaaaagatatctttggcaccttaattcaggagcatatttttctattccccaacatctgactctgcatctgtgagaaaggaggtgtgaaccacagagagtgaataaattaaaacagagtcagactctttgtacagtcatccaccaccaaataagagctctccaactccttctgaaatgggtctctctttcacagaaacactaattttaaaaatagggaaaaggttatggcaaaaaactccaactttatgccttagcgagggggcaatatactgtctgctatctggggatatttggccaagaatccacgattcaggtttcgctttgtaggtgccagtaccacggggtgaaggacagagagaacaacaaaaatggctgtctcaaaatgacctgggcacaaataatccgtgcttctaattccctgtctgtccaggagaattttacatacaaataagccctaaacaaataatgaatgaatgaacagtctgtgtttctgcatctcatgaatgtaacagtacagtacagtacttatttctaggagccctgtaaattcaaacgaacagcagaacaaggagctgccctggacattttctgtaactgcacacatgtctcaaggcttttatctctgtggttacctcctaatggtaagcttcatgcaggtccccaaaactagtcactgtaagaacgtgtggtgagaacaagaaagaaaacaaaggagggggagtaggaacttttagggatccaggaagacaagctgcctgtaaatatttgtatcttgccttttaaaggagtgccaggaggtgagtactgaagactcacacagcatgaataatgtttgatcaaatcaataaagaaatatgataaaaagccaattctatcgctacagaaaagaaataaaatacatagaaaaattccaggtattctattattgtttctatttaatacttataaaatcctaccaagtaaccattatcagcagactgggggtcattaagtatttaaatgaatgaatgaatgaatgaatgaatgaatgtatcagcttcatttaacctaaatgtgtcctaagtcacaagtctacaaatgatatcttgggaaatgggatctaattcaatctgacccctaaagccccttggctgttttatggtatactgcactaaacagaaacgaacaccaattaatagctttcaactctccctcatatagaatatgctaaacttgatcagttacccactcctttcgatctcaacattttctaggccatttctgtagcccaaagccaaattaatggaatttggttttccccacagttctatatcattgactttgttgccccacaattaattaactaagtgttcacaatagaatttatcacaattcttacagagggaggaaatggaggactcttctggcattcttggagagtctgacagactgttggcattttttttcatccttcaatacaaatgtgaggccaagtgtttaattattctgtttttactgtaatgcatccacttttatctcttcaccagcaatggatggagactataaagaatgttctttcaaaggtctccctggcacacaaatgagtcgcctgaaagcagtgcctcatcaagttctctgaaggtgctgatgagaggattccttactccagggctgttcactgtgggcctgtagcactgaaagggctccccatttatgcctcaaatactctgttatgaaagcgttaagagacagctggctcagtcgccatcttccctcctgcctcctgcctcctgcctcctgcctcctgcctctgaggtggctcagcagataaaaggacggccctgtggttggggctgccttctgatattctgactacgggagttgaatgtcccacacaatggacaaaagtgacagaacagctacaggtgtgatgttccattttaaattctttgtctccattgggcaacaaagccaataaatagctctttcaatttttgaatccacatatttccagttcaaaggagactaactcagaaataaatttggaaaaaaaaaaaacctgaaaggctgaaatgcagttcatcttttaaaattttttataggttctttgtgtctaggtatttttctaaggtttaatcacagcaaaccctgcttcactttgtatattgataatttttttaactactgtagttttcacaatgaaattagttttaaatcctttagctcgtctatttaaaatgaacacaaagtaaatctgtctaagtggaagctttatatgtggttaagtaaagaagccacactgatgccttattttaaactcttctgttcagagggttcctcaaacatgcatggaaccaggtccagaagaggagaagctgaaaaggaggggtgccgctcgaagcgaaacagagactgggaagagtggacaacattggtcccaacacattttcccagggagctctgtctgtcctggaaagtgtcacaagtttggggctagatgagagcttcctgggcccccacttgagtttctgacctaaaataggaaaaaatgaggatacagaggaagacagatcaaactattccctgagaaagggaggtagttcttttggagggaagaggtgagccaccatcagacgccagacagctggagagggtaacactagctactaaccctggcgaggctgcagatcaagcccacggttttccacatccagacccaccatgaaaagagagacttaagtgataagtcaaaatgtcaaagagtgatcacctctggatggttgactcacttttttagattttctacaaaagtactatttttatgattaggagaaatcaaaccaagaaagtatttcttcttagagatgaatagtagtcaaattatatttatcactttttttaaaatactcttttggctaggtggccattctactgtcttaacttagttttttatagaaaaagttaattataatataatttaatacatctgaaatacacctaactattcatcctacattaacgtaactggatgccactatttagcaaatggagcaaatcagtgaagaattaaggtctgcagaggatgaaactcagaccacttggagcaggagcatccggagtgcccgaaaaaaacatgttaagtgcaggtgtacagaatctccacagcacacatgcctgggttccacgtccaccaattcaaacagtgtctctgatggaaggctccaggcacaggtcatttttaaaagctactgtaggattctaaaatgcagcctggaatgagagtggtgagatcgcattatctgcacttttaataagcacacaggtgattcttccacaaactaaagtttgccaaccactggcccctctccacctcaaagctactgaatagctgcatttgaagacagaaatgacaagtagaaaacaaaagaccattccctagtcaaggctatcaattcgtgcatattttgattactatgacaaagttggtacagcaattttaatgctttctgtgtttcatagatggatatgccattttgtttttctggtttatttggaaggtatatgctgactacactcttgaattttaagatcttaaggttaataagatgcactactcatttcaagctatatttcacaatggagatatttttccatctcagtcatgctcaatctctcttgagaagaatattaggtaatcatatgtggtaaggatattctccacctatattagtaatgattattgctgaaaacatcttatttcctcttctttccaaagaagtgcctccctttaattggaataggcttgccattgaggagaataggagagaaaaagagagaagcctgcacaggaaagggggaacaatagaactttgctaatgataattcccagctaccttcagtttcagccttagtgacaactccaatctggacacctatccagaccttacccaggactttcagttcaactccacaaaaccttgctgaacactcaccctgagttggggtcttggtcatctaacagattttttttttaattttttccccaggtaatttctagaacctgagaaattttattttagatcaaatctcttatatactcaatcctgaatgtcaagaaaatctgtccaattatcttctcataatatcttcactgtattcttttcttttcacccagacagccctgttgagcttttcagagtcacacaggagtgggaccggcagtgagtccaaagggatttcaagggccattcaccaaattcagtctatgatatactttagcacaactagggactaggaacccagcatttttacagcttgagaaacactggttggaaaaagagtataaaagagtaaccaaatagggccacagatgagcatctgctctattgttttctactggcattcctctccagctgggtcctggcagctgtggaatcgacaagctatttctttctaagaaatgaagtattttcagttgtcccccatcactgacttctccttcatacaacagtaaaggcaaccacaggtgtcctccgctactcctgattcccaagcctcatcttcatcctcaccacacgagcttcaacagtcatgaatgacccaatgacctgcagtgctccaggtgctgagtgagcttctaagtctccagtgcccttgaacgtgctgtgctgcttctgtgtttagaagcccccagtccacccatttccccaagcactccttaaccctatacttcaaagctcgctccaacaccaccttcactcagcagtcttgcccaagttccctctgccccatgaaacggtctcctccatccagtgcaggcatatgtatccctatgaccatgcatctgtcattctgccaccagacctaagagtcttaaggacaagtgcgggattttcttttctgttgactaaaagtctacatcaaacctatgatgtccaaaagtgaacacttgaagtttctccccaaaccagggcatccctgagtcttccagaacagtcaatcaatccatcctcccagagtctgacgccaaagaaaatacaaaccaacaaaaacatcaagaagtaacttttcctcatgcaccacatggtccttcagcaaatcctgtggctctaccttcagaatatctccagaatgtgatcatctcatcacctccacgctttcgcctctgtcccccttcaccagacctccacctaaacccctgcctccccacacctacatctcctcctctgccctccacaccttcatctccacccctaccctccacactttcacctccacccctaccctccacaccttcagctcttaccctccccaccataccttcacctccacccctactctccacaccttcacctccacctctatggtccacaccttcacctccacccctaccatccacaccttcacctccacccctactctccactccttcacctccaccccttccctccacaccttcacctccacccctaccatccacaccttcacctccaccccttccctccacaccttcacctccaccccttccctccacaccttcacctccaccccttccctctacaccttcacctccaccccttccctccacaccttcacctccacccctaccttccacaccttcacctccacccctaccctccacaccttcacctccatccccaccctccacaccttcacctcttaccctccctaccataccttcatctccaccccttctctgcataccttcacttccaacactactagccgtaacttcacctccacccctccctgccacaccctcacctctgccccagcctaccccgccacattacttccaccactagccatcacgccttctcctcgcctaccacctcaccatccagtaactgcttgcccagttactccagtgtacctcccaactggtctccctacctctgcactctctgtactgtgtttttcacacaacagccaggttgatccttttacaatataaataaaaacatgtcacgtcttggctcaaaatcctccaatgactctgcatttcccttagagtaagctccactgtctggatacgctggcctgaaagagcgctactccaacgccctcatcatctacttctgttcccttctcagcgtcctccccaccactcctcccacccgaggcctctacatttgctattcttgcctggaacatatgtcttccttggcttattcacccactgtgttcaagtctttgctcagattctccttctcagcgaggccttccctgtctacccctcctggctctgtccccgtttcctgcccccttttctccctaatacccatcactagtccaatacgctacctacttcagctgcttactttggtttttactgtctcctcccatcagaggctctaagccccaggaagtgggggatttttagttatcatatcccctctgttgtatcccaggcatctagaatagtgcatggcatgtagtgggtgctcaaagagtatctgctgaatgtatgaactcagctttgggattccaggcccttaaatcctaagtgtcaggcacttagcaggtcctcattagattatgtttgctgaatgagggcacccaactgctatatccttaaaaagatagttttaagttgtgctttgtattataggtaatttctgggcaaaatgacactatgataaacaaacttactgaaattattagaatcattttttataaggacagtccaacctagtgaaaagtgcatagtcactgatgtcagacagacatgggctagaattctagccctactacctattaagtgtgcgtgtaaaatgaaacaggcaaacatgtctttattattcagaaaagcactttggagaatgacccatccatcctaaatcctgaccctaatgttccttattttatcttccttatgaatgagggtctgctataggcagacttctgcttgtcttaaaactaaagagaacacattaaaacacacacacaaacacaaacacacacacatacagagcaatcaatcgatatttaaaacacggatgttatatccaggaagcataatataaactacctagtttataattagcagtaagcaacttgatatgagccttgtctttttcaaaaaggattaacaataaaagccaaaaacacattaagatattcagacattaataaatgccatttattaatcactgttgccaattggtatcagtcaccaatctcctacaaaagtgatgacatctaacagattatgttcagagttagctgtgtcccctaccaactgtgtgaatttgagtaagttacgtaaactctctaaaaatcaatttgtttcagttgaaaaatgtagataaaatacctaaccttaacattgttgactacatagcattaatatagcacaacacacattggagacattcaataaatgggccatcttttttaaaccagtagagctattccttttgatactatctcctggctagaatttattccagtattaaaaaaagaaaatgaacagcttgttaaaatcaaatgatgatttggaccaagttccttaaaacttatgaaatattacctcctcctttagagctttctaggccttaagatcacgagtgctaataaaatcataatgaataaaccaaattaaggaacaggttgaactctctccttgccactctgtcagaaaaataacagtagcatctatcacttttgtgcacttgtcatttccagtaacgtgcttacatgaactccactgaaaatctgagcttgggagataattacttaccccaggactttctcaggagggagataagggacaaggagttcagacaaaggttatgggggacagtgatgcccttggttagccagaaagacaatgaaaataaattttctgggcatcaaggaactacaagtataaaataataattaccagagcaacttcttatctgatactataaatactttgtcttcttcatttagcttctaaacggcatgataaaacaataacaaaaaatcttctttactttccaagctgtgttttcccctggtgatggggacaaaagggaatgatttactattagtataatttttatattaacactgtacaacccaaaagaagacatattttccactgaactatctctgtctaatgccaaaacttttgcaaagtattcctgtcctattttccaaacacatttactcattccttatcaccatgtatctgcttcttatgtataagaatctagtaagaggctggacacggtggttcatgcctgtaattccagtgctttgggaggccgaggtgggtggatcacaaggtcaggagatcgagaccatcctggccaacatggtgaaaccccgtctctactaaaaatacaaaaaattagccgggcatggaggcaggcatctgtaatcccagctactcaggaggctgaggcaggagaatcacttgaacctgggaggtggaggttgcagtgagccgagatagcaccactgcactccagcctgggcaagagagcgagactccatctcaaaaaaaaaaaaaaaaaaaaaagaatctagtaagaataccagctatttgatgtgtccattacttaagtctggtagcaacacccaggccagttaagcacagattatacataaacattttaaaaggcagcaaactctgcttaattgtgagaacaaagacaatctttagagatttctaatcaatgccatctgcctgggagtgctgagcagtctctcatggaagtgttacaagaccaacgcagcagaggccagcttcagaggccagtagggaaaacacccttgaaggtaataaagccaacagttttcatcatcggacactggcataatgctgagaaattgttcataaacattcaaactggtttggtcttgcctaagaagatgtttttaacagaaaagagctcctttcaggatttctgagaagagaaaataaaccaaagaacacaaggtggccagcccccatggcagaggagggctcaggacctcacctggcccaaacaacaccctctcaaccttggaggtgagtattcattttcttgagttggagaattgcatcttaaaggaccacactaaggtgtccattcctggggaacaccaactagctcatcagaggtgtcagcggctgcctatgggtagcaaggtcctgagagaatagagttaaacgtggtaggaagaataaaaggtttgcaatttaaatgggagtaaaaacattaatcttcctatttcacggtttggtactttagaatcacactaatctaaaaggaatcgaaggagatcaaaaggtaagtcagctagccccaaactgcatctgctcaaaccaaaggcactggcttcacacaaagaaaccgtgaaatcagagtcaaattgttctgcttacctttgccaaatcaccttaagtaaattcctaccaatagggtatatgttgtttttgctaccattctgctttgtttgggtgtataattttctttataatcattcactcattgaatctatcattcagtagtatgcatatactatgtgctaggtcccaaggataggaaaataggagactttgttatcttgtttgcaattttactacttttgatctttaccactgaacaagttacacatgacaatcattaaaatagctaaacacatgcaaatgagtgacttacaactaaccaccaaactagagccaggttgggaagaacccatactcctagaacacacactcaccccatattacagatgcagtaatttaatatggagatcagggaaagctggtattgcagaattagtttaacacttgagggctcgtacctctgagaaagagcttttcatttgaagaaagatgttaatgggatatgactttgtacgtactgtgattttgttataaaactagtatcaatgactcaggcaacacctgcatctgaaggatttctggtctgctaataggcccatgacatgtagtccagggagggacacagtttgactcactacacttagtaatgggaagtctgcatgatgagtgagccaggaagtcccaactttcttccctaaggaccctggtatagcatcatcccttacataaaaccaagccccatccccaggcagctgtagatccccaatctgggctggagtatggtaggtggagccacgtaacatttacctaatagccctatgatctcagctgagataaaaaaacaaacgtgtaggagactgacaggcagggctgggtaattgttttcaaaatcatttagcatcctgaatgcacaatctgaaaaatcagaacaaaccagtagttcagcagtgaaggtcagtggggtatgtatgggaaccacaaatgtgtggctttatttctggactatcagttccattccagtggtctatatattatcctgcgccgcattcttggaacgtctgcggcactgtgtagccactgcccagcctgaccatgggctcttcctcagcagagagcagcagtttttagctttctatcctaatgcctagcacatagttcgcatatttcttcagcatatattcaatgaataatctagttgttttattttaaagtataccccatcaccctcaaattttatctggtaaaatcattaagtctacatcaatatttttaccttaaaagctagctctatctgcctacttatttaggagaggaataaaggaggaataaaaattcattgtaggcaatcagttaaaaaaacaaaagaggagactttgaaataactacacggtacctgtgtactgtccctttattcaagtgggaaataactgagctcctcaaccagtgggtattccagaaactctggaatacctgttatgcagtgaaagagcaaagaacaaagtcatttgtttgacctaagaccttcattctcaattaaccagaggcagacaacagattatcatccacaggcctcccacttcttcctgcctgcagtgaaattctggtcagtttgatctgcctgagacttccagcaccgagacaggaggaaaaaacaaagtacatgaaattaaagtgaattaatttgatttctctccaatatctcccttgaaaaattgacttgaagaagcaagcagagatggttaaaggtcccaagtctcaccctttctttaatagctgtggaggtattttggtttttttttttttttttttttttttttttttgtatgtagacccaattttcccttaagggcaaaggatcaaaacttgggttctcccttctttggcccagattggttttttcataataagtctaacaaaatcaacatgatttttggtcaaatattgaatccatatttcacaataccaaactgaagctttttagggtctcttattttttacatttaccatataaaatgttaatttaagagtaattttcagagaggtgatccccagtgcttagttcctcaatactgcaaccttccagacgcatacagacagagaggtgatccccagtgcttagttcctcaatactgcaaccttccagacgcatacagacagagaggtgatccccagtgcttagttcctcaatactgcaaccttccagacgcatacagacagagatgtgtgccagagacagggatgaaaacaaaattcagagaaccacctggatggagattaagaatgcacaaaaattaagctggtacagattcgcagtttcaaaaggcttccagagtaaagtaatatttgagaataactacttcaaaatcgctttcaataagacaaggagatcaggtagcattagaattttctttctggtcaagttcagcaatgtaagaaaacaggtatggatttggaagaagaatcagaggacaattagactggatcagaccacccagctgcttgttcctgtaatgaacacagcacagtatgctaatgctggggacataatgatgaacaaaaaagacatggatataaattcccatcctcaaaaaccttataatttagagaaaacacacccaagtaaacagttctaagacagctgagaaatgccattaaaaaggcctggatgctacaggacatagagaactggatgctagaagacatagagaatgggcactcaaccttgactggggagatcagggtttccttccaagagaaagtgaaatctgatatccaaagaatacagcaaggtgaagaaagagtgtctttgtttgggtgggggctggtgatggtaagacaggaggctcaagaggtcacgagcgatctgaccgcaaagggaactcatcaatgcacattaggagcaatggagaacgagttcaagattttcagggtgagcacaataaaggtagattggtgtttcagacacaccacactggctagagaatggagaatggattagggaacagacctgaggtcaaaagtaaataaaggaggaccattgaggaatgcgttttgatgacccagcagaaagaagatgaggggttgaataattataatatcctagaaatggagaggagttttggaaggcagggaggatggggagctttagccctccccagtagctccattagttccagctcctaccataaggtaccctaaaatcatcattatcatcgtcaaaatttcaagtggctggctctgcaaacgtagacttaggataaatcctctagttccctacttcccaacagcctacctagctaagccctgcctatatgtaaatgctggatccaccactaaagaagcatcagtaagcagtttctgcagagattagaatccatagaatatagcaggatgaggaaaacagcatgcatgagggtgcttgggcatctggtggatggtatgttcgatccctgtggttagggaatgcagctgcagtcgtttgtcattctctctcccaagtttttctgattctcctctttccaggcacatagtaggatcacacttccttatcagcctgggtccctccattattcctatgagtaaaagcttcttgccaaacaacagtgcacacatagctcatgcaagaagtgaatttgctctttgaagcctcagagatttgagcgttgctacagcagcgtaacctaacctacgctaatcaactgagctggagaggaccacaaatctactatgtagagaaaagagaaagccagttatgtttgtgccaaatttgaagtacctagaaaaaaggaaagggtaggatagcaaggttaaagagaaggtgacagtgcagaaaatggaaagacttttctctcatttacacactcatggagcatctcctctgtgactaggccaggaaactgtgcacactgtccattggtcttcgcctattatagagacacagtaaaacctagagggtaagagtctatctcctacagtcacactacttgggctcaactgactccacaatgaattagctgggtaactttgggtaagtaacttaacttttctgagccttggcttagttaagtggtgatattaatcatatcagcaaaatggggatagttaacattcctttctcaccagcttatgaggatttagtaagaaaattcacataatttatacaggatctggcatatcttaagtactcagacattagcccctacttatttatatttcagattacaaaacccaggatatacagaatattgtctcttatagtcattatggctcatccaggacagaaaatcaagataattttaatgtatgtcctaccagaagtctgatgataaaatatgatatagcaaagccaaagctgcattctaaaacttgaagtccatgtcaattaaaaaagtaataatgactttggtcatgttactacagaggccaaagcataattataaggttacaaaagtggaagaaaatgaggattttccccagtatgtcttgtgtattaaattacaactgtgaacagcaacatagctgacatcaacccttatgcagtgattacttcagtatgaaacacttgttcctccttcctgccctaacttaattgaaacagaacactagagcagctgttaatatagcatagtcctcaccactgattatagtgcaaagttcatcttcccttcacaggataaagcaatgcaaaacgttaagttcatatatgtttttatatgtgatgccaatcacaaatggcacaaaatgttctccaacattttatatgtaatttaaaaccataaccaaaataagacatcacattgcataagtggtaaaaatacaggttatatgactggattgctcttggaatatactttcttcctctatttgtacataaatattataatccaccagcaaataattatttccaaagtagttttctcctttttacaagacaagtccacaaacaccaccttacgcacattggatactaaatgtgtgtatctgctttatttttatcaagaaatgtcaaaacattaatgaaagttacagagaaacaatatattttcaaatgaacctcttatgaaaaatgctaagtctcagaaatgtattcacttagaggaatcattatcgcttccttggtattacttggatgctggaggtttaaaaaaaatagacgaaatgtttctcactccatatgtttctgacaagaaggtgggatttccttggccctagaatccattagtgctgacagggtacagctgcacccataatattctctttttccaaattacaggtatataatgtttatttcccaagctatctttaaatcaacatatgctgaatagtcaaatatttttaaaacacaattctgacctataaaataaatgtgtgttctcccttgcagagctttttgagccaacactgtatcagtgactggccatctatctattattactaacagtaagtggggtgcttttcacaagtgtctaaaaccaacatatgctggagaggacattttatttttattctatatgcactttggctccttggtgcccacagcaaacagctgtcacttaccgcaagcctttcctaacactttctgtaattcctaaggggcttcccagtctataattagactctccagctgccaccatgtacactgcggggtgctactgagagtttttttgctttgtagcattccctaaaaagtcttcttcaagatggtgttgctgaaataacattgtttggtattcagcttgggtagcaaatatgaattcttcaaccatttgctatgaacaagtctgttccacaagtaaggtttgctttgaaatgaactctgcatcagtcatatgggaaaggaattgagtctaagcataaaaaacagggaagtagaaagcaatactagaaacttcctgattcagaattgcagagaacatcagtattgaaccagttacaacaactctcttggtcttttacataattcttcttcccaggcaccatcaccaggattaactgaaatagcacagcaaaaaggaagtaagaaagaacaggcaaaaatctccccctcctgtctcaaaatccttaaggtcaacaatgccagaaaagatagcgtgaaagtgaaacacagttgtaagtcaaaaaataagaggaagcagcaagctttaaattggagtaactctttaaaacaaaatgaagtctgatttttagaaaatgaaaacattttcaaaacacagagcactatccaccacccctctcattccagcctaggtgttcacaggaagcaaatgcacagaaataggtttttctcaatagaggaggacctgctgcaatgggagagggaagcctgtgcacacagatcctcctcactcaacctcaggaagtcatcatttccctgactataaaagctgctaatataatgaaccaaacgcaagtaagtgcccatagaaagttagacatgctaacagctgatagccgatgtggagtccttagggtagaaagatagttttaccaacaaaagcccaggtgccgcagatgcccttgatccaagcaccacatccagagccccaagtccaggggcagatactcccgaaactcacacctcatttccactacggatgtgctcctcctgggtggttgacacctggccattactaggaactttccaagggctcatctaattggcaggatttaaaaatgcccagcttagacaaaagcaaggggacgctcattatttatctcgattatagggattcttgttctccttacgtgctatttcccagtgagaggatttcttaacccagaaaccaaatggttaaggagagagtaatactcatactggttcctgacattatcagttgttctccaagtgaatttcccagtaagctgaagtctgttccttccagtagaaaaaggggctttaaaaccatctttaatggacagtgtttgtaacactatcacgtccgctgaaggcaaaaatgttaaccactgtgaacttccagcatttcctttttccacagccacagctatatgactgtcgtggatatcagctggtatgaatacagggaatgtaaattcattgcaggattggcctaagcaaaataattaacaagacagacttggtttttttaacccagcagttaaaatatatacatttagcccactatatatttgtattagcagagatcactaacagttgataactgcacacaaaatctgctgatcagaacagttaaaaccagagtatggaaaggcctcaatttgccagttaattatattccaaaacattacttgtaaaatggttgcatgccaaaaattccattttccacagaaattgtattataaatcacagttaagtttcaaagattgtctataaagtcttaagccagattgcaagtcaacaatatcttagtcgagtctcacagatgcatgtgaatgttcttcctaaacccagcagggattagctgtcagggaggaggactaggtgctgctctgagggcagagcaacatcgtcttgtcggttctgttcatgcgtctatcactgaacgtttcaagcagtctctggcacataggaggcactcaatatttgtcaatggatgaatgaacaaatcagaggatgcagcaaccgcaaacctgagagtctgacagggtgagggatcagaagggtcccattaaagttaattctgattgttagactgaaaaggtctcccgcttacgttcctggagcctgccccaggacacctccacagaagaaacaatgtcaagttttctgggtatctccccagaaatgttctaatcatattccagcacaaatatgtatacaacccctccccttaaaaaataaataaaaaggacatttattatgtttttttctttttgagatggagtctcactctgttacccaggctggaatgcagtggcatgatcttggctcacggcaacctctgccttccaggttcaagcgattctccacctcagctttccgagtagctgggactacaggcatgaaccagtgcacctggctaacctttttgtatttatagtagagacagggtttcaccacgttggccaggctagtctcgaactcctgacctcaagcaatcttcctccctcgacctcccaaagtgttgagattataggtgtgagccactgcacctggccaggaagcatcttatccacagagttccacttgatgttttcccatcagcagcatgtggccgggtcatccctccctccccgccaccaccagacgcttttctcccttaggattccagcaccagctcctggctttcctcctcccccactgaccaccactctggtctgtggacactggaggaccacagggcttggtccttggaactcttctatacctatgctcagtctttgaagagcttaactggcgtcctggctctagatattgtcaccagcatcccttagctagatgacataatgggctcctaaggggtctccctgctccgtctcctctctccatccccacaaggtctatttattccttactcatcctatagagctcctctcttaatttaaggtcaggtcaggggatgcacacatcaggccccctcagggagaccatggcctttcaagggtccacacggccctgccacccatggccccgtttcttctggatcctcgccacctccaaccctccctctctctgctccaaccacactggcttccctgccactcccaccctagagcctcgcactgtaatattcttcctcagaccgccacccacctcccaccccgtgtactccctcacacgcccttcaggacagtgttcaaatgcacctctctccaaagcttgccctaactactccctaaaatcctctcacccttcctgatccttgccccacttcattctgccccataactcctgtctgatctcctctgtgctgtattcacgtcttgattattttctgtttctcgcctgtgcaatagaagctccagaacagcaggggtttgtatctgcttgcttctcttccatcttcagtcctagaagaatgcctgggacttaaccacaggcaatcagaaagtctttgttgaataaacaaatgaaagaataatgtattttatactatttcttaacagtttactagatggctaaaatgacctccttgtattcagcacaggactgggtgtccaccgtgggatgtagagattggtgaggtcagtcccctcctgacaggcacacagggcccccagactctcgctgcttaagaatgggaccgcaatgaacatccttttacatggacaagtatttgcagataaaaaggagtacgcaaattaaaagatttgggctttttcttttgatacaaatctctcaaacgtaacaggagtaaacaggagctcactaaaaagtgtctgaatccgtctgtttggcaaattaacagtcaatctgctcggcaaagacgtcatctcagatcgtgtgtcaagtgacatcccagggtgaattattatgatgaaattacaggactgataagacagaaaaactgcagggaaaatgactcatcctaagctttcaggagaagaaaacgacgagtgaaacaacaacaaatcttcaatagctgttttttgtgaaggcgtgcatcacacttgtagcaaaaactgtccttgttgccgggtactgcatgtatccctgttcatgggtacagagaagacgcccctgcgtgtgctcaggaaggctgtcaaactgctaatcttacaggagagtatgggaaacccatcgcgactatactccttgtccttcagtgctgtccctctacacatcttggacctcagttactccccagtctatccggattgcttcctatttttctccttgtccaaaattctcaaagaaaatagtcactcagttatcaccaagacccaagaatcactctaccacaaccagtcaagtgccaaagatctgtttagagcagaagttggtgcctttcaaactgctgaactcctttttcaaaagaggatgcaaatccattggctgtgtaccccagcccaggagtccctaaggggcactgcagagctacatgtggagggatgcctcttctggcattttctcaccgagtgactacagagcctctgccagaggggaccgggacaaatcttgctttcaaccgctacataatcactgatccacccagcgtgcaggacagtctttgtttttccttagaaaggatatatttctctttcctacatttgcggatttagctgagtagttactgataacttttcctctagtagttatcccacagatttacactgttcagttttcaaggaaatcactagaatgacgaatatccttatctgcacagcactgtacaaatgttggctaggacaactcaaacctaaaatgtctgcaggcattaaagcagcaactgattctcaggaatggaactgttttgctttttgacgcaacccaaggagcttgtccatggttctctgctacacttccagggacttcgtaataaaagcaatatacagtaatcgacaacaatttcgagtttcaaagatgtcaaatgagagatgccccaaaaagaaatatgcttcaaatcaaggagaaaataatcaaggccaaataaactaggtcaccagatttatttctgagctgtataagttggacatgtttctgagtcatagtgtattaatctagaagagacaatcaagctgcctgcttcattttagagaagggaccagagctagggtagttaagcacctcccctgtgatttaaaatgttctggctagaaaataacaaagtataataatatattttccatatgaggatctaataataaaacaagtagcaaaaccttgaaccagcttttcactatgttacacagagtaacactcttagtaacaatctattatttgggagaacacaaatagaaaatgctgcactaattaattttggtctttttccttccaagttgtatcacccatgctcgcctcccctactttcccaaaataaaaaaaaaaaaaaaaaaggatgaggctagggcttctattcaggacttacaaaaggcagacaatgaaaacaaaacataaaaataaaaaggggcaaccacaaaaaaattaaaacatgtcataaactcctgctatcatgaggggatcattaaatcagcagaacagaggcactgccagggagacctcaactcccacccacaaggcccatggccttaggcaggcctctggtcaccctgaacttccattttattacttgtaaatggaagcactgaataagataacttccaaagggcctttcagttttaatacaagaaacctttaagaatgcataatttgccttctgagtaaatatttgccaaaacataaactcagtataggtggcataaaaaacaaacgcagaaagagatgtgctccataacccacacaccactccttaggcagaagataaaatattatgaataattatcaatattaactgaaatccttgtccctggtcaaaacaatgcataaaatggttcctaaatgcttcaggattttaactacacagagaaccatctgtaagccacagtcccattttattattcaaacagaagcattttcaataactagtctggtatagaaactacatgacaatgatttgctttgtaagcattttatctacattgttagctaactctgaatatacgtcattaaggcactcacctgagcacacacaaaaaaaggatcctatctaggattcacttcagtttttcttgggtgaatggcgcatgcctagtaatgtccactggaagattacagttcaggtccagagtaggctaacattcagctcatcaagttaacccccaacattatctagcttagtaccaaatgccaggaatttgtcagggtcacgtgtgtcactgatactcaatcatttattaaagaaacagcaccacgatgagcatggctggctaaacagtgaggatatcataagaaatgcttgaaatttagaatgagtacagtatttgtattgacaaaatggctttggaatgagacagtctcaggttcaaattccaacctgcatttactctccatatgttgttggacaaatcatttaactcctcaaactttagttccctcctctataaactgaggagacaatatctacctaacacagatgttacaggcttagagataacaaaagatcccactagaatataagttctacatgggcagggattttctgggatttttgctcactgctagatagaaaagtgcctggcatataataggtgttcaagaaacatttgatgaataagtgaataaatgtaaaatgactaactcagtgggcacttgaaatattattgaaattcacttggtcataaaatattgataatctcaacactagccataataaaaaccttaattatacagttaaaattttaacttgtagcaataatgcaattaaaaactatcaacacacctcaaaacgatgtttacaacaagcaaaagggttatctttagaacagacatgtattttcttccaatgccaaatcgttatttatttatttatttatttattttttagagctggagtctcactctgttgcccaggttggagtgcagtgatgcaatctcggttcactgcaacctccgcctcccaggttcaagcaattcttctgcctcagcctcccgagtagctgggattacaggcacccgccaccatgctcagctaaatttttttgtttgtttgtttgttttgtatttttagtagagatggagtttcaccatgctggccaggctggtctcaagctcctgacctcaagtgatctgcctgtctcggcctcccaaagtactgggattacagatgtgagccgctaagcctggccgccaaatctatttttaaacttccatgatagtcatcataataaagtcaatctgtatctatagaataaattgtgatctaaatgaaaaatgttatttgtcatataaggcatcccaatagagtatctcttacagcctgtagaaatttcatctttttctactcagcttaaaaatatacaaatacaggcattagtcttcatgccataaaatttcatgagagttgaaagccttcagagaacacactgaatgtttttgaccaatgtctacatttaaggagttgaaaaaaatgaataactgaagttgctcttggaagccattctggttgagggcaaatcttaaacaatgaaaaatgataaaccaaagcaacagatacaaaataacagacaagtttttaattgtactacaatgcagcttactgctaggtagaaaagtgcctggcatatgataggtgctcaagaaatatttgatgaataagtgaataaacggaaaatgatattacttttattgctaaaattttttttttgcaacatggctgcaatactagttaaaagtgactgagctggtattatatgtagagagtacataaaaaatattttagcaatgaaaataattcaaggacctagtatcaaacgcatcacaagtttagcaaacagggatatgcaaaatgactaattcccattaaaatctcccattagaacagacatacatgcagtaagcatcacacaagggccacaaagtccctgaaaacagtgatttccagatttcacagattggtaggacagaattattgaacatcaaatgatgctagacatggctactcaaatcatccataatggtttctgaatagaagcttttcaagagtgggccccttccaattcttttgtttccccaagtcttcctttgtttcttttcttcttcaaactagcttaaattgggcttctgtcaattgaaacaataaaccaacactccaaattagaaacattaatactataaatctgatataaaaatttacatacaatcttgttgaaaaataaaatttaatttttcctcatttgaagttttaaaatatacccaacttaaaaaattttaatatctattggtctggtatggtggctcacgcctgttatcccaggactttgggaaaccaaagcgggcggatcacctgaggtcaggagtgatcaacatggagaaaccccatctctactaaaaatacaaaattagccaggcatggtggcacatacctgtaatcccagctacctgggaggctgaggcaggagaatcacttgaaccatagagacggaggatgtggtgaaccgagattgcaccactgcactccagcctgggcaataagagtaaaactctgtttaaaaaaaaaattaacacctactggtatacacttgtttttgagaactgtccaagatcatgtcctttctacttgttttaaaaaccttttttaaaaaaaaattccaaaagtaatagatctctatatataatgctctacaagtagatatttaaatgactatatatatatgatttctatgaatatttctatgtatgtgtttatatatacatatatatgtgtgtgtatatatgtgtgtgttaggggtgccctacaaataataattcatttaattctcacaacaaacctttgacgtgggtactattattattcccaactgaataaatagaggcacagagatgttatttaacttttctctggtcatacagagtaactggccggactcttttcatttttttttttgttgttgttgttttttgttttttgttttcctgagatggagtttcactctgttgtccaggctggagtgcagcggcgcaatctcggcttcctgcaacctccgcctcccgggtttaaccaagtctcccgccgcagcctcccaagtagctgggattacaggcacctgccaccacgcctggctaattttttgtatttttagtagagacagggtttcaccatgttggccaggctggtctcgaactcctgacctcaaatgatccacccatctcggcctcccaaagtgctgggattacaggcgtgagccattgcacctggtctggactcttaactactatagtacacagctaacagttgctttcctactataatataaacagaaaatccttttggccatttccattggtcatctgcaggaaataaggctgtgccagagatctcaagggattccacttcgctaaaacgtaattcaatctctcttcttggcatcttgctctccgggccaagcaagaaggccaaattcttctatcttaaccactcaaaaagttagggccaccttttctccatccatggggaatgtttctagtggagaatgtgtggagctagcgtggatcacatgcaaaagggaatgcagcagtgcactggccaggtctgggtcacctgcctatcatttagccagggaacagatggctccttgtgttgacagccccaagtcatccccacaaaggagtgaggagcagttctccaaagcaagtgggggaggggctggtctgaaatgaaagatgcacacaataaaagctcccactgtgagctcaaacctcttgattgaacttatttcagttcttcatttctaatcattcattcgtggcagaaaacccagttttaacacagacatgccatatttcaatttattcaatctaaaacgacaggcaaaagtgagagaagctaagtgacaaaagtcccctctaccctgatccctgatgacctttcttacatttgctccaagctggacccaagtagagcaggcccctgacagcccagcagccacccgctctgagctggtcagtgtggtgcccagacagccaaagcaaccaggagttatccaagaggcgtgccatggccctaggaaagcgctcacagacgccagcactgggattttgaaacaaactctacaaagaatagtaatattaataacacacagtaacacaatgaggccagctttcctacaattcccattttctatatgcactaatatgcacataaacatcacataaatccaatgaggctagtattactatgcacactttacaggggatgacactgacattaagtgatactaaagaacttgcctatggctgcaatattagtaagttactgagctgggattatatgtagagattatataaatttataatgataacactgcatatcccaaatctgatctaaaacttccacaatgattataacacatatgattattatagacatattataatacatatgcatagttattatgtaatatatgaaatgagaattaacaaatatcttctcagaacttggagttatgaagaaaatgatattagagaatgcattctctttccattgttagtgaatatctaaattgatattgagatattcttctccaccattcaaacaacttgttttatcaggcagatgcataaaaataattgcaggaacccttgtacttccatctgagaagatgtcttctattggagaaacaaccaatgcaaatttagtgcttataaggatggtaatgatgctggtatttctactgagaaatttgccacctcagtctctttgcagtatcagataaaaggccaccaagaaacgagacagctctatcaggcaattccattttacagaaaaccataaaaacaattatctatgtcattagagactctttaaaaagagcttcaaaacatccaatttgctgttccaggcctgagacataatcctgactgtccatgctaaagagtaataacatccaattgagaacagttattatcagacatcctaaaatcagtgaaatcaaatacagatggagccaaagaggagaagcgcctgtatttcttggtcaaacttaattcacgtggatcatcactgaggtagttcacaagaaatgatgatggagggtccagatgtccccacaccttcacttattagaaaatatctaagttgacatcttctttaccactcaatcaacttccctttatcaacgagacacattcaaatcattgcactgatccgagtgcctcctccaagaacaagtttccactgacatcaggaagaaaggactgtaactgaatataaatttaaaaatgaagagagaccattcgatttcaccaatacctactgagtacctggagctaaagaaaaatctctgccctcctaacatgtagacagattctccccagatctctgccctaccaaaatgcatacagattctctgactggagaaaaattcaattttcaattaaaaaaatagaaataagccagcaatggaagctttcttgtgaatgagaaattcttcaaaactaagttataaatgatgttgccaatagaaaaccaccaatatctatctttatacttcagaataatttcctacagtggtccaaatgaaaaattatcattcgtgtttctttaattagcatgcacacctaatcaaactctcgcttatctacttggtgcttaactgaagagctcagaattaaaaaccaactgcactttgattttcccagcactgaatagagacagtgaaaatgagaggagtacgaattattttccaaattacaagacaatagaatattcattggttaaaaaaaaaaaaaaaactgtttaccttagactgtgctaaaattgaaagggaacaaaggggcaggccagatggtatatcagggaaagtattaacaacgtggaagtgttcattcttaagggggagaaattatcccaaaaagcataaagaatcccaagtccaagttaattgaaaatgaccaaaacacaaccatcaccctgagcagcatgactctcattgctcggtggggtaaggtcttagtccagcacacactgattctctcgtatcccaagaagctcctgcagtcagcacaggcaagctcttctcatcacggagtctcacattttgaagttatatttacaatttaaagttaaatcaatcttaataaaaccatacctgctaaataaaatgttaaagactgagctgcaattttccctcataaattcgtgggattttttcacattatattttaaacgactctttcatttgaggatttactgagcacctacagaagtgctgagcagtgttctaaaagttgggtctatggcagtgaacaaaatggataaaaatcctgttgccatgaagctgatattctggttgagggagaaacacgaaaacataaaatgtgtagtgatatgaagaaaagtaatcagggaagaggagcaggttttgtaggatgttgtgggggttgggaggaggtctgtgcaaggctacactaagcggcaaaggatgaagaaaggcatgggagccagctgtgaaaacgcagaggaagaatgttccaggccgagggctcggcaagtccaatgcctctgagggagaagggagaagcatgactcagttcaaggttcagtgaggaagccacaaaccttgcataaagcgtccagtcttcaactaataagaaacacaccatagaatactacagatatcaacatacacggatctcaatctgactgttagacaacaacaaaaagctacagaaggatgtgcacagtatactattttaaaaaatataaacattaaaaacaataccacaaatagtttagtaatgctagaaatagtgatgtgggaaggaagaaagacacgtatggttatgagaaacacaaatccagaagagtcgcctcttctaagagggagagaggtgcacatgcagagaatgcaggggatttagcaatttagggttgtttttattttatttatttgagacaggatcttgctctgtcacccaagcgtggagtgcagtggtgcaatcatagctcactgcagccttgacttcccaggctcaaggaatcctcccacctcagcctccccagtagtagctggaactacaggcacacaccaccacgcctggctaatttttttaaaaaatttttgtagaggtggggtctcactattttgctcaagctggtctcaaactcctgagctcaagtgatcctcctgccttggcctcccaaagtgctgggattacagaccctgagcccagctggggtcacattttgtgcaggctgtgtatataggtcatcatcttttcaatcaacccttttgtgtatcagaaatatttcataatatttttgtaaaataattttcaaccccattcctgcatccactagcttcttttctttgttttttgttttgagacagtctcactctgtcacccaggctggagtagagtggtgtgatctcagcccaccgcagcctaggcctcccaggctcaagtgattcccatgcctcagcctcccaagtagctgggattacaggtacccaccatcacgtctggctaatttttgtatttttagtagagatggggtttcaccatgttggccaggctggtcttgaactcctgacctcaagtgatccacccgccttggcttcccaaagtgctgggattacagacatgagctaccgcacctggcccatcctctagtttcttaattaaccattggattgaactgaagcttactgcttacctttgagtaatggtcaatacagctgcactatttctgctcatctgtgatcaagaatatgctaccactggtggaatcatttccatgatcatgagaagaaagagagcatattaagggaattaaacagctgtcatcactgccctggcactgctccgaaacgacacattagagccttttatgatctacagaaaagggctgcataaaagaaaatactgcaaatctatgtttagtgctttaagctgagctgcctgtcacaattttaaatacagcccctcagctacataggaggtaaacatttccaacaatgtcacctttgcctctcaatatacttctttaaaaaataaaacacggtggataaaaattacatcaaatacatacatatatatatatatatcttacctaacctacagtggcaaagacatctgtgctttggtttcttcctgagcaccaggtcccccctctgtgcgcaccgccctcctctcagccctagcccactgcagcctggcttccaccctcagaacacagggggttgaagatgaaagggaagcagaggtgaaagaatcagtgcacaagcttggaaaactggtactcctcctccaagctcctcatggcgaactcaccaacatcagcgtggctaaatgcaaagggagcattgcagctctcgtgtcatttaaatgttcaagaaccacagtgaacactacctctttccaaatcacattgccccagctccatagaccttttcctcttctacttctcccttgcagattctctttactctgccctctctctagtgacctcagcttctatggctttcattaccttcctatctggaggattctgagtcttgatctttgagctggacctctctggcttgctggctgatacatgaaggctactagacatgggttctgaaatgtcccacaggaacttcaggacaaactcctgaccatgccatcaccaaccccaccatcaactcatatatgtgtgtgtgtgtgtgtgtgtgtgtgtgtgtgtatctcagggaacagcaagtggggccattcccctctccctcacctcccaccatacccaacatgtcactaagtctcaaaattctacctcctaaacatttttcaaagtattcatttttctccatctcttctaccacttccttagttcagatcatcctcaattcttccctggatagtaacattagcaccatttattgggtacttatgtgcaaagtacttatatttggggttgctgtatagattgatatattgtgatattaactgtgacttttattttatagaaaaaaagtgaagtttctaagtttaaacatgtgtcctataagcataaagctagactgctatggtgccagaaactgttaaggagttcactgagtcattcatgtattccttcaaaaaacactcatttttaccataatgatatattgtccttcaaaaaagtaaactccctagattactaaaaaagccatattaaaagtacatctgaccacgtcttccaacaaggtaacacccctcactggctctgcctcaccctcaggatgacatggtgcacagggccctgaactctgaccccagctgcccctaagactcatctctcccactgccctcggagcccatcttactcgtcagccacacgaatgtctccctctttcctcctggcctctgtacacgctggtcagtcacctccgacaccctcctgtccagccgactccagactctatccagctctcccccttctccaccgcatggctcctggtcatctttaggtctcaggttggacaccactccctctccgtccaaagccacacacccacagctggtaggtgagcttcctttgtgtgcctttcatgccccaattccccatcacagcacttgggaggcaacaattaattatgtctgtgctcagggtgacaggaagccccgcaaaaatgggcggtgacattcattttgctgggtgcctgggtagtgctggaaatatgtatgtactcaagatatactccactgttaggcagacggacggaggcacaggctgcagagcagagcattaaggaaatcagacattccttcccctgaatgctttccagctctactccctgacaacagtgtccattattttctcatgcatcttacagtttgaaaagtgctttcacatcaattacaccatttgatcttcacaatagttctgaaaaaagaagagatggctgttctgcacatttgtagatgagtgtatgtttctgagaggttcactgatgtgttttagtcaaatcacaaattcaagcctttggatgtgtttctcatgtgtgaccatgagatacttcaaaagaggaggagttgtcacagccaaattctggattttggttagccagaattgcagtcaaaattcagaaaaggggcagtttaacatgggttaggatcagagatagatccaggttttttaagtgccaaagctcttgcaattgggaaacctttaagaaaaaagactataggttgggcacagtggttcacacctgggatcccagcattttgggaggatgaggtgggcagatcacttgaggccaggagttcaagaccagcctggccaacatggtaaaaccctgtctctactaaaaatacaaaaattagccaggtgtggtggtgcatgcctgtaatcccagctactcaggaggctgaggcacgagaatcacttgaacctgggaggtggaggtagaggttgcggtgagccaagatcatgccgccactgcactccagcctatacaacagaacaagaccctgtctcaaaaaaaaaaaaaaaaaaaaaggaagaaagaaaaaggttataaaagtcaaactttggtgcaaactttggaacatgattctgtaaggaagaagtcctgaagtttcagcttcattagcttgaggtgagtccacatgtcagtggagcagtagaagaaactgagcttagaaaagaaagaagagaatgtgtattttaagtcaaaacactattacaaggaaaggcaaggtacaagaaaaaagagtggtaagagtaagaactatctgtttagcagttaactagggcctgccgtgtgtgaggcactgtaccaggctcaaagacacaaagatgattagacatggtccctgcctggttccacttacaatctagaattgacaccacacttgcagagaaggggtgcaaacaaaaagaaagacttggtaaaatgttaaacatcccctaaatgatagtatctacaggagcattccacatgccaagtctctgggctctgattatgctcagtgttcactggtatttgaaatcttgtttactactcatccccttgtttaaaatacagtttccaggggagtaaaacctgattgttcaccactgtaaccccagcactgagcacggtgccaggttcataacaagcattccgtaagtatttgtggaaaaaacaaacagataaaagaacagagaaaggaacaaaactttacaaaggctcaaagagtcacattttggcacatgccatcagtctcgtcttttcactttcagtgtgtatctcagtactttgatgagtcttttaactatcactggtgccaaatgagtatcctgcctggacaaatcttaatttcaaagacatgcgtttgacaaccaagcagctgggaagaaacactggcagtaagcttaaggaggaaaccaggtcaaaagatgggttggtttaattttgcttggttctttatgctgggagatgcttgaactagaatatttggagaagagatcattcagaagctggtttgagtagagaagacctggattcatcttgggggtcaataaagcattcactgagataaggcgcctaggggattgtccttgatctgagcagcacgaaggcccttacacactctaatatgaccgaataaaatgctttacagttctagtcaggagaagactcagacaaggagatcaagctggaatccaactcttaaataagagcatggagaaataagaggtatgatggtaagtcaataaagccattaaatgttttagaggaacattttactggacactgggcaaaaaaaaagaaatgaaatttaatttattaatatatgtatattcaccctttgtcaaagatcttttcacatgtcttgtcttaatgtgaaaaccctctcagaggtaactccaaaatcgcaatttttgatgacaactgggggaggttcaatgagggggaaaaaagccaacgtctgaaaatggttacacaatttgtcgggcttgctgcctctttgcgccaagacacggccatgctgtcagaaaagcttaagaccttgaggctgaatggcaactacagctccaaagactgaagttccttcttgaatttatctccggagtctaagaaactgatgcaattcaaatgtgatatacagtgacttttgttttgttgtccccctatgtggattatgtgagtgtgtgtgtccttctcggatatgagcataggaaaaaatgctaataaattataatgtagtctgaccatttaccattgatatgaatgtcactaaacatagcaacatttgtaaagaaagcttttaatcatctcaagtttcacatatataagtgaagaacttcataatatcttaaaagtatctgtaagacccacatagctcagtatgattttgaccagcaggatcacatttactcatagaagcatctcttcttcaaggccattttactctattaccgatcacaaagcaagaaaattaaccccaactgaagacatattaagagctacgtactttcacttagattcttactcaaccattctgaccattatgctacataattatcattatccctatttaatagataagaaaactaaccttttatcctacttccttaaccttttaaattttacataatttcctagggccacagaagttatggaccagccataaagaaacccaaggccgggcgccgtggctgacgcctgtaatcccagcactttgggaggctgagatgggcagatcgcaaagtcaggagatcgagaccagcctggctaacacagtgaaaccccgtctccactaaaatacaaaaaattagcaaggcgtggtggcgggcgcctgtagtcccagctccttgggagtctgaggcaggagaatggcatgaacctgggaggcggagctggcagtgagccgagatctcgccactgcactccagcctgggtgacagagcgagactccgtctcaaaaaaaagaaaaaagaaagaaaaaaagaaacccaagcattctgagtccaaggccaggtttctttgctctatgctaaacattttcttcaaccttagtactatttatttatattatatcttctttccaggttaaacgctcatttgacaatagtgaagaagctggaaagtcattaagacaaaagtcgttaagacagtgtgtctcaaaatgtggtcctgggaccacctggatcagatttcaccaaagtacttgtcgggacataaggaggtctggatccaactgcagatctattagatgataatccgtggattggtccccaaaaattcctttttaataaactcatcaggtaattctgttgtataaccactgtgtctcattctttgcaaacctctactgttatctggagtttcatactcaaaaaattctgcattctcatagagggccatcttttggattacgggttttgtggtggaatgtcacaaaattctacactcatcctgagggtcatctttggatcttacaattactaagacatgtccctaaaaacaagcaaagaggacaacagcatatactactgaaatgagaaaacatgtactatgtgtatactctcattagactggttctagatgtcttcaaacacagatctcatttcaacctggaggtaggcagcatcgtcatctgttcactctggggaaccttgcctagagaaatagagtactcctcccacagttacctagctcaaggttagcagatgtttccatctgtatcttctctagctctttgtattttctttattctgcaacaaggattccccaccactgggccaaggacagtggtggtgagcggtgggtgagtcagcattaccacctgatctccgcctcctgtcagatcagaagtggcatttgattcacattcttgagtgagaatgtgagaatgtgaaccgcacacgtgagggatctaggttgtgcattccttctgagaatctgatgatgtgaagtggaacagtttcttcctgaaaccatcccccacaacccccgtccatggaaaaactgtcttccatgaaaccccaacctctgtgccaaggacagggccacacagcaggaggtaagcaaaatggaggtccttggtgctaaaaaggttggggacccctgttctacaatataactccccccaatgaattactgctctcatttcaagaattcagaggaaaagttttccagacttcttgagcagacaacctagtcaatctctattttccaagtcttatacttagccagtaagcatattccttctaaagttaataaaagttgtcactgagtagcacaaaatggtataaaacaccaaaattcatcaagaataattctctgtaatgaaactacccaaaactccctatatctctgggatgttagtaactctaggaaaaaattacgtagaaatatgcaactgtccgggccagcctgagacctctagatgccccgatggcatcatctcacagaagcctgggtgcaccattccagctagcaccaccttcaggatcataaagctattctccccaaattggtgaatgaagactggattccaagtaaatccaagatcagtcaaaatcatgggattgtgaataacataacagagcagcccacatccctgacgaggtggcataaaatctgtgaatggaatatgacatttgttaccattctgttgttgaggacgaaggaagggttgggaactcagagagagatcaaaggaagcttaatattttccatctctgggagcccagtgaccccgtacacctactaaactatcccagaccctggatattttgattctggagagtctagttcaggtccagactgctgcatctgctgtccctcgaggcatgccaagaggcacatgggagaatgatgggcacccaggaactcaggttaggctttgctggatgagctcgcccctctataaagagatgacattaaaatctaaatttaaaaaagtcaggaaatctatggtgaaaatttgcttgttttagtttgttagaactcaatattcacacacaacattgagatatacataataatcatcagagattttaatttttttaaatatcctgttttaccacaagcctcctgatgtgtatattagaagagagtcatgaagtgtaggcagcaagcagaaggaggcagaggggctggacaacaaggcttcacatcaacaccatcattaaggtaatgatcctttatcaatattgcacaagaccaaaagaaaatatttatttaccattaaaaataatgatgtgggtatagatttgcatgcatgaaaaagctcctccgagacatactgttacatttaaaaaaaaaaaaaatttggcctggtgcggtggctcacacctgtaatcccagcactttgggaggccaaggcgggcagatcatttgaggtcaggatcattcgagaccagccttgccaacgtggtaaaaccccatgtctactaaaaattcaaaaaaaaaaaaaatagctgggcagggtggcggttgcctataatcccagctacttgggaggctgaggcaggagactcgcttgaacctgggaggctcacttgaacccgggaggcagaggttgctgtgagctgatatcgtgccactgcactccagcctgggcaacagagtgagactctgttctcaaaaaacaaacaaacgaaacaaacaaacaaaaaatggttacatagaagtatttaagacagaagtctattcatgtaaaatattatgtaatctacatatgagtctgtatatgtacaaaatgatgctactgctatttatgaagcacttgtgatataccagatactgtgctcagtgtttgcatgtattacatcatttaatcctcatatccttcagatataagcattatgcccattttataaacgagcaaacaggctctaggaagttaaaagaaccatgccacatagttattaaatagcaaggccgagagcccaacccaggtgtgtcctattccactctgatacgtaatacattcagaaaggtagataatgacattgccttttttggtttttctgtattgttagactatattttaaagtgagaatgtattatttttaatatctcaaataactgagatacattcattgaaaggataaggaaaatcttcccatatttcgtatatctcattttctaccttaaacaatccaaaagtagtatttaatcctcagttaaatactcccacaaaaagatggaatgaattgccaaaatatcaatcattgagagaaaaaaacatcacattcaatttctgcaaaattttggataactccattaactaaagaccatctgtctccagattcctattcttccaactcatcctacacttatcaccagaaaaaatattcttcttccctactcaaccactttcaataactccccactacctagcaaagccccaaatatcccttagtctcatatccaaaaaccttccacaatcaggcctcacactccctacttagatgcacctcccattactccccagcatacaggctatattccagctaaaggcaggtctcttgacttctggaatgtcctatctggaatgtcttctcaatgactaattgagagtctctatcaaaatccagtcatcttcccaaggccaaaatggaaagtcaaaatgggaaatgaagaattttcaatagattttccctataaaaggatccttttataggaaacaatcaataatacatagaaaaacaatcactgatacacagaatggacagtgtaaaataagcattacatattataaagtacatttcaaaaaattgcatagccaaatgataaaccatatttcataagattcatgacactgattataagagataacatcatgttgtatagcactctgccaattaagctatgactcacacatttttagaaactggaattttcattttcttcttatctaaagaactctgattgagttattcaacgcataaagaaaatataaacaaaatagattggccaaggtgttcccaaaaattcttacatattcagaatccaactctaccaaattgcacgtcaactaagagttactgctgtctatgcttttccacacaatatcaacttgggtcaccacgagcactagaaatgtatcacttaagagtgctccattactgtctccaggattttctccaatccactaacatccaatgtccaatttttgatgcatattcacaaacaatgaattaagttgccagctttttctctgcaacatggctgagagccatgtaagacatatcccaatttcagagatgttaaatgtgaaaaaataactttcttttagaaatgatgaaatttggggcttgaatcaaatacaaagaaactcgctatttgaggatgtaaacacaggcatgtacaaaaatgaccaaagaagagagagctaaaacagaaaatagttttcctctctttagttgaatgctaggagatcaatatcatctcccagcactaatccttttcagcttttgtcaccctaccatttgatccctcccctcttcagaggacaccctccacactgatgtcctccatgacaccaattagagctggcaggaaaggaaaccgactccctgcagttcttccctcaaagaaaccattcttcttttctcttggtacctgcagaattctcttccctgatatggcaaaacctctaggatctaccaatttgagctacagacagaggtaacaaccttgttatgaagaggaccacgccattaaaaataatgactacatacatgagtctggtaattctcatttttaaataaagcagcagtgctttttaagctttctccaagatttttttttttttttttttttttggtagtaaagcgtaagttacaaatggccccattttttatacaatttcgtaagtatttactgaatgctttaagtgtctagacctttacttggtttgggaaagaaacctgaagagaaataactccctatcctcatcaagcacccacccaatataactggagagaaaaatatatactcaaggcaggttaaatattacatttgttttctaggtctaatatagacctttctgctttctctctctctctctctctctctctgtttttagtttgtaaggcagggttataagaacaatgtatcaaaatgtcagcaatctaaaaattaagttgtcagctttttctctgtactgcaaattacaaaagaattggtgctaatagaagcttacaattccaaagtatgcaatttaaccaatcatcgcaaggactaaaaatgcaacaccaaagacatttcaaccaagtaatctgcagttctggcatctaatttcaacttgtcttcttgtgccattcttcccaatttgtttcttctttatgctttgaaactgtgctctggaattgctacatagttaagaaagaactgcccagagctcctacatacataatacactcacatgaaaaatgtcagtcatggaaaagacaaggaacatctgcagccattctgtggttcttcattttttatgctgatattactataaattcagaaaggaaaacatgaaatatactttattgcttccgaatttcagtcttatcatttattcaacactaatttgggtgaaatatgtctctgatcatctctgcactagaattctaaattaggattaaaatgctaaattataaaataattagtacataaaacaaaaatggaaatggaaatcaattactccaaatcactgcagatatcttctacttatgaaacacctttttccattttttcctattgccaactgcaatcacatcacttaaaaataaatgagaacattgcctacccaataagtaaattgcatctttagagagaccacatactttttttaaaagacattactaataacctaaatcaagaatttaaaaagaatgctgttttagtacaaagaacagtaagaaatatgttgcctcaatatataaataaaaatatactcatttttcttgttctttaattttgtaaatggcccttctaaaaaattacagttttctctacaaaaggaatattcagtgctttctactatttcacaaaaaacaaacaaacaaaaaacgtctccttccttactcttggagacacattttcccatgcagtcttatattcatttacacctttcaattctccaaacaatacctcgcaatgcagttcaacttgagaaaggagtctcattgattgatcaggcaaagttttaaagccagcaagatgcttcagatggtctggttttgcctgccccacccttgtttcctttgagccatagtgatgtcacaacaccaggcaggacaatgacttcactgctccagtccttgcttctgagcacagaattccccacagccaaggcaaatcaaataacagcagaaccctcccgggctgagtgcctgatgaattcccaacaaatcagcagctagctagccgtttgaaagaaatagatgcagcgattgcacgattaaggatctctctaactgaagtggtgctaaagataaatttgattcataggtttcaatggtgagtctatatttcacggaaaactgatggggtacttaggggagactatgggaattaaagacggccagggtagattactcaagaaccctctctccgccgggcgcggtggctcacgcctgtaatcccagcactttgggaggccgagacgggtggatcacgaggtcaggagatcgagaccatcctggctaacacagtgaaaccccttctctaccaaaaatacaaaaaaattagccgggcgtggtggcgggcgcctgtagtcccagctactcgggaggctgaggcaggagaatggcgtgaacccgggaggcggagcttgcagtgagccgagatcgcaccactgcactccagcctgggcgacagagcgagactccgtctcaaaaaaaaaaaaaaaaaagctagcagggtgtggtggtggtcgcctataatcccagctactcgggaggttgaggcaaaagaattgcttgaacccaggagtcggaggttgcagtgagcggagaccgtgccattgcactccagcctgggtgacacagaaggactccatctcaaaaaaaaaaaaaaaaaaaaaaaaagtctctctcttcattatatatactcaaattctcacagaaaggaaacatttattcttcagtctactcttggagttctattttactggagtggacatgaattctaatttgtgaattttagggaaagcactaacttaaaagatgaatgcacatcatacaacacggaagaaaatacttttacagcaagttcctgccacacttaatctaatatactatataagtccagaaaagattcacaagataacagcatcacatctctcagtacatggatagttgcctctcttctacctaggtggccctttaatacatttgaccaaccagtttttaaaaaacaattataaataaaattgcatccgatcaagttaaaaaaaatcctgatcttttatttcaacacaaagttgtccaaagtccaagcagtgtacatgaactgataaaaaattgcttttaacctaaatcgcattcatgcagaagaaatgtcttaaaaattaaacgcaaatatttcattgagacactgacatttgacctacagctcctgaatccttcagctaaaagcggtttacaaattaaagtggctactcttcttgttatggatgaattattcacaaaacatgttctgttttgaaaaacttattttggctaaagtgtattaactaaataaacttgatgcagtaagttgtgcatctgatattttgcttttctaaaccaccagaaaaccataatgcaaatgagacagtattcagcattcagctatcaatgccttgcaaattaacaaattgaagtcacgcttctccaatttagtatttattccctctcacattaattttgttactccaactaaagtttttaaagtttgataccaaaattaacatgcattttttaaacactcactctgagccaagacagaaatcacctctcagtccccagagttcactggagcttgatgtgctgctctcttttcttaatagggcttttctgcttaatttgctgtaattgggactacgtccatggctcacagacataagcagaattttatcatttttgtttccttgagactttaaaaatcaaggtaaatttcaaaaacaatgtttttaagcacttggtgtgacgcttcctgtactatagaagttaatgctaccaagacaaactccagcacacctggccacctcaggcagcctaaaattctcactgtgccccactccccaccccccctcaacaaaaaggacaggcagggtatctgcaaaagcaattccgcgagactaatgtaaaaaagctgaaacaacttaaacacgcaatggaagcactgcattagcaggactgcccggccctctcaggacctcccagcccaacctccacaagtaattaacaccacatgtttcctttatcattctatttgttctgttccgcaacaatctctaccaactttaaccctgggctgcaactaacggaaaaaccctagaaaacttcagatccgtaatataaaaagaaaattgaaaagaatactctcattgcaagggaccacagttacaatttactaggtaaccacacccaccgcattgcagaagccatgaacttggcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccccggcaggtgcccaggcccagggcaaccccgcttggacgctccctcctcctcccccaccggccgggggccgctgccccagtttggggaacgaggcaagttatataaaagcggccggcccccctgcccagcggggatgctttgtgcggagcgcaccttatcggccccgcgctgcgcccgcccgcgcctgcacccgggacgagcccgctgccgccgcgcgctgagcgcagggcccctcccgcggcccgccagccgccacccgcccgggcggcgccgcagtgtcgccccctgtcccccgcacctccccgggggaggggccggcccgcgctcgcccccagcccgaggggcaacttaaaacatggcgccccgggcgggggatttgtgcaaattggcggagaagggacgcggggaccgagtcgccccttcggccagggatcccagggaggcccccaggccggaggccggggctcaggctctgcgcgccggcccagccactactgcgccgcggcgggcggagcgggcggggggcgcggcgcgcaggctcggcccggtgggggtcccggcgagcgggagggcggttggggaccccggccgcgccgggcgcggggctcgggattcgggagaccgcgcggcgccgaagccacgcgtcagccccactgtcccgcgcgcctcgccccaggcctcgggctcttcctccgcacctcgtaaagccgagaccccctcgcagtcccccactccgagaggcggaaaagttacctgggatcagcagggagcccgggcgcgccgcggcgtggggactaggctcgggcgcgcgtcctcggcggcggtgcgcaggagactcgggcgtggggaggaagccgcagcccagggctgctcgccgctgttccccccgccccctgttgcaggagacaccgaggctccgcggagctgcggcgggggcccacgcccagagaccgtgcgaggaaagccaacctcgtcctgcctgccctcccagccgcgggggagggggccaccgcagtacttcaggacagttacatgggcacagcctcctccgtcctggcgcagggtcaggctccgcggacgacgcctggagacagctgccaatgccaatagctttagccctttattcccacttagatgatggcctggcctctccagacccctctcccctcccagacatcccctgtgagaaaggagggagagggtgttcctgaccttcaggtgagttatttattggctagggactgcagtattttttttttctttttggaaagaaaataaaatcaagttggtggtgtcttcaagtcatgttaatagagaagatctgaattaatgcttgataagagaagtcgcccatttttcagcaactcagctactccgtcctctccagtatctataaagctttccaccgaaatttaccttgattttaaagagcggaggtggctcactgacttgtaagtgaaagaagtaactcctggtcatctcacaatatcttaagatctaaccgactaaccaagatatttaagaaatatttttatgggcacaaaaagaatagagtgaataagacatagcatctgatagcacaacagggtgactatagtcaaaataatttgattgtacattttaaaataaagtataattgaattgtaacaccaatgataatgcttgaaggatagatttcctgttttccatgatgtgattattacacattgcatgcctgtatcaaaacatctcatgtaccccataaacatatatacatactatgtacccacaaaaattgaaaataaaatattaaatttttttaatttttaaaataaattgtatgtatatttaaggcatacaacataagatacatatatagtaaaatggttattatagtggaacacattagcatatctatcaactcacatagttatgcatttcccccaacacccctctacttgtggcaagagtagctataatatactcatttagcaaaatcctgaatacaagacacttcttagctctagtcctcgtgttgtacatcagatccctttcatgttgtacgttattaatttttttaaaatagagccttctccaaatcatccggttgcccctccaggagctcagggactcattaaaagagggaaaaaaatggattcacaaaaatattgcatttgctactgggtgccaaagacaagatacagaacacgtgcctctgggaaagattagtgggcctgatctgtcagtgaggcccggagacgtggggagacttggcgcaggtttctagaatagggaagactttggtaggaaaggaggatggtatttgatttccttggctggagtggaagggttttttcatgttgaagagggagaaggttggaaaattatagttactatgttgctatggagtttatgggactatattctatagatgtgtagctttgggaaattttgagcaagaaagtgtgacttaagtaatgttttaagaaaactaatcttatggctctgcaaagactagaacagatgggcaaataccaggttggtgttcggaggagactatggtattaagacagttaccagaggtaatgagggcctgaattgtctttcaggtgacagataaaggtgacagttccaatagtggatgtttgggaattaactgcatttcctgtcagaaagtgttgcgtatgagtattagagacatatatgcacatatcacatacgcacctgtatgactctgtgtgtgtgtgtgtgtgtgtgtgtgtgtgtgtgtgtgtgtgtgtagcacataaggtctgtgaatgaagaaagaattcattttccttttttgcatgtacactaaagcactccattgaaagtggacttgaataaattgtattgtttacaataaacactcatttggcattatcattcaagacacagatggctccatattttcattcattttgttgcagtatttttgctattctttaaaattgaaagcaaactttttcttatgactcatgaatcttaatctttgtggtgatgaaaatcagcaatagtgtctgaatggcaattttcttgggagaaaaatgttagacaactaagtatttttttaattagaaatacctatctaagccaggcgcagtggctcatgcctgtaatcccagcactttgggaggctgaggccggtggatcacgaggtcaggagttcaagaccagcctggccaagatggtgaaaccccgtctctactaaaaacacaaaaattagctgggcatagtggtgggcgcctgtaatcccagctactcaggaggctgaggcagagaattgcttgaacctgagaggtagaggttgcagtgagccgagatctcaccactgcactctagcctgggcaacagagagagactcgtctcaaaaaactacaacaacaaacaaacaaacaaaaccctaattatggtaatattccacgaattgaaaatttggagtaaaaaccatactgctgcatagtttgataggaaatcttggaagcaattactttggaatcctctggatttaaccaagtctctcctctattatttttttccccctagcacagacagggagaaaaagaaacgtcaaattcatgaggggtgcatagctgcatagctccctcagcaacttgcctgcatcttgataatagcgatctcttcattctttcttgtgaatcccatgcaggatcctctcttagtcctctctgtctccccacagtgcctcactgggcacattgcaagccaagcacttcacatttttgctaactgaatgaatggacattgaataatgaactaagctgtcacttttcttcagggattcggcttcctcatgtataaaagggactgattccaaaattctgtatggttcaataatattaggggcctataaaactaaaagatgtatcacctcttactaagtaaaagcaataatgaaaaccctactatttagctctcatcaggaaataatgagctcttccacacagaaaggagaaggaacataaagtagaaagcaaggtgaagatacaattatgattgaatttgcttgctttcttagaatactaacttctctccttttccctctcactaccaaaaataaagccactatagccccagagaattctttattcttgtcaatgtaaccccccttgtggtgctgtttcaataagttatagaaaagtagttcttgggtccagtaaatgccgtttacacagtcctagaattagtgccaatttggcatgagaactcagttcttcagattcttaatttactatgtccacacagtactaaagagagtgttatgcaaatactgaaacaatccatggaaagtcaggaaagattccatgactctagcctaggtcttaggatgcccattctgatctccactaccttaacttgggctttctctacgctaatcttatttatggacttcctgaaattactctatataatttatatcactgaaggtcaccagctatcaagaattctagccagagaaaaggtgcagagaaaagggtgcagcttacttcaggtaagatatgtgtgtaaattcatcccaagctgaagagattggatcccccatgaacctctattccaccacaaatgtcaatagagtactgacttcttgagtgaatgagtaactggtattctgctacctgaacagcaatgataattccaacctgatagccaagacaaggacagaatttgcagttgtattgacagccatgttgtcagccttatggatgagactccagaaagaaataatagagaatcagtctggttaaacttatctgaactttgctctcaaacatgaaaattgaagaaatattgacgcttgagcaaaccctacaaatgccaccctaatagacattcacactcatttggcctcatttattcaacctgatctgctgccttagtgaaatgttgacaacactggcaataactagttgaggtttattttatgctcagaataatgtcaggcacctgaattgcatatcaagttcttgaaatcaggatataaagtcttcagccacagcgttactggggaccataaataagagaaatacagggatgaatgcataattcaaaagcaacaagcttattcttctgaaataaaaattcattgaagagtttctaggttctaagaatagctttaagtttacagctcattaaggcttccagatgctctcttcatattgagtttgtataccccatttcaggggtctgtctacatgcaaggcacagatgcaaaacgaaataaagtattgataagtataaatgtagcacaaaatgtatgaaaagtatacataagatggagcaagtttaggcatgctaacaccatttaaaatcattcctattcatcagaattccatatttgccttttttatctttgtattcttatataaagaatagacttaaaggtggacccatacatagtatgtaagttttattgtattaaaacatatccttattgatttttttactttctccatttccagtaaattttagaaataagtctcagtacttttaaacgataaaattgtaagggttattctagtgatcaattcttcattaaatgtaaatgctcaatgattctgttcttaagtaaaaataaaaaatccactgagaatgttttctatttaggattttagtataaatatggaatggtaaaatatgaatgctagaatataaagaatggaagttgttaatctgtaatattaaattcagctctcaaccacatgatcactattgaattatatgctaagacacttaacattttaatcacttttcccccaaaagacaaaataaatgccagcaagcctgtccatcccctgtaaagctgtaagtaatcctaatcagctattatgtttcaccccagaagctatcaacaaaaattaacagaggaagaaataatagatagtaagacacattcagaagtcgggcttattaacttgttaatgctatctcctctttaggaaaatgtgtgatggttaactttataaactaataaacatacagcaataactactctaaggaaaaagcattagctttgtttcttaatttaattcctgttttccagcatgttttttttcccctttccaactgtctcactggcttgcagatttcaacagtgagggtacaacctgaaaatgtcattccactgtagtccacagcttccagaatgctctgggaatcactgagaacatcatctagaatatctttgtcccttaaaataaatttgttcaataggtcaaagccatttgaaagaaagccttggctactaacactttcctatgcaagatgtttattagggatttgtctgatatccaaggctgactcatttgtaaatgatacaaatctgaggataccagagtttctcaaactggcttatttgtgaacagttttctaagttttacatttctgtgtcaataaaaatcttaaaaagaataaaactaccagatgcacaccattgatatcagaatcattcaaagtacttgtgaatgatgcaaattttggggtccagccttaactgagtcggaagctctggggtggggtccagggagcagccatttttaacaagttccccaggtgattataaatcacaccaaatcttgagaaccattgatctaggcgaccagtccataccaaaaatcccacaggtgacaaagtgcgttcagatagatgtttcatagaagttggaaccgaaaacgggtggaaaaacagcccactcagacatatacgagagctgaactgaagataatctacactacacgattcacagtttgcaggagttattgcttggatcctgtcattgcatgcatcagtctgcagcagcagttcattagcagtaagtatagtaataaataacaataaaggattgtcctgttcccaattccagcaataattggattagatgcctatttattaaagattgcagtaacactgcaactctgaccttaatttccaagtttttacaaagttgccaagggatgtctcattaaaatgggaaattgaggactaattgccggcagttttagttaactttgagatctgactatcttaaaccctgcaaatagagaatttcaatacattttggtataccatacttaggcaaacaagcattccctgggctgcttagtaaaacttagtgaaccaaattaaataaggaaactgaccagaggctccatccttctaaagcacaacatgaggaattttatttcagaaaaacaatatcatttatcgttttaaattagtgtgttgttaattttagtgttcaggccttgcatttctcctatcaatttattaaggttattttggttttatacttgatgagccctataaacttaaatctggttttacatccatatatgtttagaaatattttctttcattaaaggatgagatttcagctcaataaaagaggaccatcattctaatatgggccaggctgttttataaacagtgagtttccagttagaatgtttaaggagataccagatgacatctgttagtaatgccccagaaggcttcttctatcaggagggcacttgggcaaaatcagctataaattcctgtccaactgggagatgaaattgtgttccaaatgtttgccactctggaaccagggcttgcctaccctgtttgaggtagcaactcaagcactgacttcatgaaggaacactcatgtacatatgtacatggtctttgaatccccaacaacttctcaattataggttgagattaatttgtcactggttccctgctttttctccataaatctcatgacagtttccaccacctcttcccctcccacgtcttctcagatccatcaactctaatctgcttagatttatacaagtcctcaacctctctaatcaaacctttctttacctctgagccaagctttggtgaattaacataagtagctgggcatgatattgcttttggagtcaaggtataaatactctgaatgggaaatcattaagtctattttggaatttttcctgggtgtctcaatgcctattcccaaattatcccactgtttaacagaatcaaacaggcgtgcagtgagtacatgccatcctcctgaatgccattatagcttgatgaacagagcaccaagtaatatctgaaaatcgttgtataaccttcagcaaatttccacttctcttgatgtgatatcaatattcattgaaatattccctccattttctgttttactagcacagacgggtggttctcaaccacagctgcacattagcagaatcacgtggggggattttttaaaaaacatccgctgaaggctgggcacggtggctcgctcctgtaatcccagcactttgggaggccgaggcgggtggatcacttgagcccaggagtttgagtccagcttgggcaatatattgagaccccaacaaaaaattttacaattagcctggcgtagtggagcatgcctgtggtcccaggtactcaggaggctaaggtgggaggatcacttgagcctgggagattgaggctgcagtgagttgtgatagtgccactgtactccagcctgggcaacagagcaagaccctatctcaacaaaacaaaatttttaaggcactgaagtgaattatcacagctgggtgataggtacatgtggacttatacaattctctctgtttcgtgtacatttgaaaggtttcataattgaaagtttatatttaaaaaattttaaatattgatgcttaagctgtatcccaaaccaattagataagaacctctggagagtgggacccaggcagcagtatctttcagcattccccaagtgacttttaggagtaaatggagttgagaaacaggtaaaagaagactaaagcacatacttaaattgaatgttaagaattcctcaaaagagagaggctataaaaataaacattgataacaagcacttatttatatctttaaaaaattacctgaagtccttgtagaagccactggatgacatgtgcatgtgcccattctctacgaagtgagtcaattttgaacaggctgggtttgcttggcagtgcctgccatcagatttgttgattctcacaacctaggggaaacctattactgtagctggctacccagttcatagtaatgtgtcaataaaatgctggcatatttcacaacaggcataaagaactcatcacacgttaaatatcgtgactagaatttcaacaactcttcaaacacccaaaagaaaaaaatatcatttgtggttttattccaagtttctgtgtaatgtgtagaagttacacacgcgtacttgtggttatctcagatgatgaataatagaaggttccagcaggtactttttgatgaaacagataaaaatatttgaaaaattagaggagccagtaggaaattgtgtctaagtgactataacctgacgttttatgaattggatctagcgattttccccaggtgtgttcaggcattgggatactggtacatcacgatgcctggcccagggatctgttttcactaagagctaaaatttactgagcatttatcttgtatgaggaactgttttacaagctattgttccagttaaataactttcaccatcaccagaaccctccaaggtagaatctattattacccttattttcaaaagaggtcaatgaggcagaagctgtttcaataaggtgcccgacgttacacaggttttactatcagagccaggacacaagctcgggtagtctgacttctgagctagtcctctaaagcctctaagtagacagtcaaataaatacatacacacagatattcagttaaatcatatgaaattgccaatattcaacagttttgactttcagagcagtaactttagagtacaataatatactccaatgagaacacattgcattggctacaaagaagagaaacagagttaagaaaagactatttctactactatggacacattaaagaacagaaaaagtcttccaaaaagtcactaatttagaaagaatatgcaggttgtttatagtctaagaagctactaaaagactgtaaggcaaccgctaataaaattataattattattgttaacttgtatttacctctgctgtgtgccacacagtgttttaaggggtttctgtgcacattatctctttgttcctcacaattctatgaggtaggaactataattatccatattttacaagtgattaaaaaaactgaggcaaatgagaggttgagtagcttgtctcaggcctcatatttggtgagtagtagaaccaggcaattttattgtagagtccatgctcttaaccatgatgctaaactgcccctacacaattacataaggttcccttggaatttcctctacagaaaagggaaattaatttcaaaaagctgtgcccaaaatggggtcattgtataaacatgtatccatttgaccaagaagagcagtctacaagttaagagtttgagaaaaagggcaaaggcgaatgctctcatccatcagtagatcccgctggctctaccttcaggacatacccagaatcagccacttctcactgcacctgcctctggcaccctggtgcaaaccatcaccatctcctgtctgggttcctgcaacacctcagcacatctgtctctgctgccaccctgagacccctatagtgattctccaaacagaagatactgtcagcctggtaaaacataagccagatcacgtcactcttgttcaaagcctctgggggccgtgttatctgccctcaccccaaccagccccaccgttctgaacatatctgccagccacactccccgtcccactccaggcactctgtgcttgctgttcctcacacaacca

SEQ ID NO: 270 - DNA, 47885 bp, Homo sapiens
agaaacactgatttttctcaaacaatagaaaaagtgttttttgtgtgtgttttttttttttttttaaaaaaacccaaaaaacaaaaccactgtcttagaagaagaaaacaagtctcttcagcaagcatgtggccaattcagatgggaggaaccagtgaagttagaagttacacacaggaagtgagttcagatttatccacaaatgtcttctggtctagttctgtaaggctccaaatgggccatctcagcttaaaactggcaacaccctctcaaagctctcaggatcccatctggtttgaacctggggcctcattctccaggaggctgcatctgtttacagaactcatcaaactgctgctgctccagttctgtcatgactctgttgagggcatagatctgaatgagagaaagagatacatctgttagcaatggaagcagctgcacaaagcatcttctgacataacaggtggtgccttctgaaaataccagaatttcaccagtagtggtaatgcagggacagtgctctgggaataggaaagttagatattagttccatctggagaatcaagacagcagcagtgatgcaggtggcttgatttggtctttaagggattagtaggatcccttaagaagaaaacaagtctcttcagcaagcatgtggccaattgagattgaggaaccagtgaagtagaagttacatacaggaagatcagatttatccacaaataatcttctggtctagttctgtaaggctgcaaattggccatctcagcttaaaatctatcatgggacatgacaggtggtgggggaggctttatgtgtaaataaatgtaatggaaaagtatagagtctgttctggaaacttcaagcatgccaatataaaggatattatagagtaggggttggggagctggagaaagcaagaaaattatgttggggtcttaaatgtcatgccaaggaatctggattttatctggcagattctggagagccagcaaagataagtgtgcaggggagcaatgtgaatatagtgtgtgtgtgtgtgtatatatatatatatatatatatatatatacatactatgtatagtatatatagcttatataagttataagtagagtgcatatatgttataatatataagctatatatactatagcttatatatactaatatatatacactatacttgcaaacctctgacatgacagatcctccgcctcagcctcccaaagtgtatacatatatataataatggtatatatactatatagtatatataggctatatatagtatataagctatatatactgtatacagtatatatataagctatatacactatatagcttatatatactaatagtgtatatatactatatatagtatatggtatacttgcaacctctgacatgacagatcttcccaccttggcctcccaaagtatatactattaatagtatatatactatatagtatatatgtagtatatatagcctatatatataacctataatataagcctatatatgtatgtatatatagctcatatatataagctatatatgtatgtatatatcgcatatatatatgagctatatatatatttcagacagagtcttgctgtgttgtccaggctggattgcagtggcatgatctcagctcactgcaacctctgcctcccaagttcaagcatttctcctgcatcagcctcccaagtagctgagattacaggtgcccgccaccaaacccggctaagttttgtatttttagtagagacaaggtttcaccatgttggccagactggtctccaactcctggcctcatgtgatcctcccgcctcggcctcccaaagtgctgggattacaggcgtgagccactgtgcccagccataagcaacgttgattctttctgtgctttaggaggcatctgttacaacagtccagacaggaggtcgtgggaatatcgtctacagcaggcagtggtgatggaaagaagatggcaagagacatcctcaggtgaaaggcagggtaactacaccttattcctcatcatctttctttattcttaattaatccacccactaagaacagaaacagatcacaaaacttcctaatttgtagaagaaaaaaatgaaagacagagtgtgtgtgtgtgtagaggagctataacttgattaattgaaaagacaaggaagggggaaaaaatgaaacttagaagtgggacaaatagaaaatacaaaataaagagcagaaacgaatgaaaaagcaaccaaacctacaatagagaggatcaccaagactgccagatggttccttgaaaatactaaaaaaaaccttgcaaacctctgacatgacagatcaacataaaagggagtgggcacaaataaacattattaggaactagaaagaagacttaactactgacataacagaaatgaaaatgaaacattatgaactccgtgccaacacatttgacaacctaaatgaaacaagttcctaggaaaagtaaaatgatccaaactgactagaaagcttgaatattcctgtcatctttaagaaaaatggaattctacacagtgatgaaaatagttactaacactaccgcaaatgattcttgaaacacagaatgcggctgatgaaactagtaaattttatgtatattttaccataataaaaataaataaacttgaatggttaaaaaaaggctgagtgaagacagccagtcacggtaacatatataaaaggtcagaaacattcaaaacaatatattgttacacaacaaaatatttagaggtacacagacagtaaattaacgtagaacagcaagaatgattagcataaaatacagcaaagagggtactgctggtgggaagggtgaggtacatgaccaggaaaggagtacacaaagcttcccagttactggtcacgttctatagttgggtgttttattcttaagccacatacacacattatataaatatacttttaacacacacacacacacacacatacatacatacacacacacacacacacacacacacacatatattttttttgtgagcagagtcttgctctgtcaccaggctggagtgcagtgacccgatctcagctcactgcaacctccgcctcctggttcaagcaattcccttgcctcagcctcctgagtagctgggactacaggcgtgcaccaccgtgcctggctaattttttgtattttagtagagacgggatttcaccatgttggccaggatggtcttgatctcctgacctcgtgatctgcccaccttggcctcccaaagtgctgggattacaggtgtgagccactgtgcccgggcccacatatatacatatatatttgaaaacctctgcttgcttcattcactaagtatttactgagcatttttaatctgcacattactgtactagggactgagatgcaaattaaatagcttctcagagacctccagatcaaggaggcaagatggtaggagaaagaggagactcacaatgggtcagggtgtccaggccaaagaatgactctcagtcaagaaggaaacggaccctagcagtgtcaaacggtgcttccactgccaatgtgccttccgttcccattcacctcccacatctctccttcacatctaactttctggaatctggcgtctgcagaattgaatagaaactgtctcttcctccccacaaagggtcttgttgcattacattccaggcaataaagattaaaaacaaacaggataggcgcggcggctcacatatgtaatcccagcactttgggaggccgaggtgtgcggatcacttgaggtcaggagttcgagaccagcctgaccaacatggtgaaagtccatctctactaaaaatacaaaattagccaggcatggtggcgggtgcctgtaatcccagctactcaggaggctgatacaggagaattgcttgaacctgggaggtggaggttgcactgagtcgagatcgtgccactgcactccagcctgggtgacagagcgagactccgtctcaaaacaaaacaaaaacaccaaccaaccaaacagaaaaaaaaacagcaaggcagctgtagggggcaaggcaaaaaacaacagacaaaagtcagaagatgtttagaccacaggcctgcccctctttaactacaggactctactcacatccctttgaagtgaggataatactgcctacctcacaaggccatatattttacatatcggattaaccaaggttaaatgggagtcacaataactcctgctttggagccctggtgtgaggactacatgtggctatgcatgtgtaggcttggctcggtcctggcacatctcaagagctgcacggggccagctgctgcttgagtgcagcaacgttgcatttcagcaggtcaacaggaactcagcagttgttcaatttagggtccacacaataagagcaggctgcctgcttggaaacacaagattattcctgatcataatcactgctagttatcaaatgcttcctctgccaagtactgcgctatgggctttacacgtggtatttctattccttttaatggtcttctgaggtagatgttatcctcattttaccaaggaggaactgatgaactgggggttcagagaggttaagtatcttgtccaacgtcacatggaagaactgggatttatggaggagctgagatttgaagtcagacaaataaatttaacctatagaactttacagaagggtgtcaataagggcatgaacaatgtcctcaacatctatccttacaatatgcacagaggacagtttcatagggctgttttttttaaaaacggattttaacataattactatgtgtacatagacaattaagaatagggaaaaaccccaaattaatgttttaacaagttacaagctgttactaaagacaatatccttggatttaaaaaaaaaaaaaagagtacaatagaggaagtctctcattcaaccgagcagtttaaccaatctcttttaataaatccagcacattacagtggtataaatttatcttttttaacactccacataaaaacatgtgtcctctcttacatttaatcattagtagtctctaaaatggtaaaataaattgaatttacattagcaaatgaaagtgcaaatttgtacagctaggctcagcagcaaaagtgaagaataagaatgaaaggtgaaaagctggtggatgccatgcagagcgaggacttccataaaggtctgtgccctgcggccaaacacagtcaacacaccaccattttcttgttgctcttaaatgagcaaaaccaaatttcttttttatttaatgaaatattaaatctttatttccccctaacataatttgtgatcaagtaggacagaggtaagtcccaccatcactggggacagtagcaacacacagacttcagaaacagccttgaatcatcagtaacatcctcccctggtaacgttagaaggaatgcatctaatgacaaatttgcaatgttgtcacattgttctaatttatttgattagtttatctggaaaaactttacacattattgaagacaacagtaaattattttcttgctctgaaaaaataatgttttttcacattttaaaaccttttagtatgcttttgcaaaagtagttgcaagaatatgacagctgggtttgcagaatgtccatgtacaagtttgtatttataagaaactggtaatctgcctataatttgcctctacaaatagagctctttaaaataatatttttaaaaaaacaggcttaaacttttccctattcattctacttgtagcaaagaggtacttacttttcaagtattacatggtaaaaggcacaagttttttttgccaattttaagctgttaagctttaagaccaaactatgtgaaaaaaaatcatgcctagtcaatcctagtcaatcattttatagccaaatcctcttgtcttttaaataacgcagaaaaatactaatttgctaagaaggagcacactggaaaaagccatttgaaagtactgaagaatgaggagtattttttttctactgatgaaaattattaggaaagctatcctgtctgttgtctttagctagtttaaataaatcttttcaaaatgatggtcaagaaatctttagaaaactggaagaggggatgctcttttatagcatgaaaggaattccattaattatagaaattctcgttaaattttgacgttggttcttcagaaaaaatacgcatttaacttctgcagtctgttgtgtttgaacaccatctacctgagccaggggcccaagcgttccttcatcatcaaaggccaaaactggattcaaaggaacttctgggctcttactgttagtgacatctaatctggatggtttcgatccaatgggtaaatttataatttcttcaaaattttcattctgaacagagatactccattttcatttggttttccaaattgggggtgctctccacagtcacttttgattggtgtgaggtaaccacatatgggctggcaactggttctccatttcccagagcatttgttgtacacggaagtatagatagctctgttcctccagtgagagctcccttggctatatcaccatttctctgatcaatggttttcttatctgtagcttctgttctcctgcttcagggctgtttcttatagcaaccctcatattgttcaccaaagcacaatgcagtcatatcatctgaggacccggatccaggtgggaatgggaaggtaaaggaccacagctctcagggggtctgccttaacccaaaggtagatttcagtttacagattaacttcaaatgcactagtaagtttacttattatgtttactgcctccccttgctggaatgcaagatccatgaaggcagggattcttttctgctttgtcatcatgtgactcaaattcctcgaacagtgcctggcacatactagcagttctttttcttttttttttgtttttgagacagagtctagctctgtcgcccaggctagagtgcagtggcacaatctcggcaacctccgtctcctgggttcaagcaattctcctgcctcagcctcccgagtagctgggactacagggagcaccaccacgcccagctaattttttttttagtagagacagggtttcaccatgttggccaggatggtctcaatctcttgatctcatgatccgcctgcctcggactcccaaagtgctgggattacaggtgtgagccactgtgcctggccaatatttaatgaatgaatcaggttaacaaaaattaaaagttgacaatatcggccgggtgcagtggctcacacctataatcccagcactttgggaggccaaggcagtggtgcacgcctgtaatcccagctactctggaggccgaggcaggagaattgcttgcacccgggaggcagaggttgcagtgagcagagatcacgccactgcactccagcctgggtgacagagcaagactccgtctcaaaaaaaaaagagactcaccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattatggaagacaatgtggtgattcctcaaggatctagaactagaaataccatttgacccagccatcccattactgggtatatacccaaaggattataaaccatgctgctataaagacacatgcacacgtatgtttattatggcactattcacaatagcaaagacttggaaccaacccaagtgtccatcaatgatagactggattaagaaaatgtggcacatatacaccatggaatactatgcagccataaaaagggatgagttcatgtcctttgtagggacatggatgaagctggaaaccatcattctcagcaaactatcgtaagaacaaaaaaccaaacaccgcatgttctcactcataggtgggaactgaacaatgagaacacttggacacaggaaggggaacatcacacaccagggcctgttgtggggtggggggaggggggagggaaagcattaggagatatacctaatgtaaatgacgagttaatgggtgcagcacaccaacatggcacatgtatacatatgtaacaaacctgcatgttgtgcacaggtaccctagaacttaaagtataataataaaaaataaaaaataaaaagagactccatctcaaaaaaaaaaagcaatgtggcaatgtctagtaaaattgagaatgtacccagtaatttttctagttaaataacctacagaaattctaaggcaggtgccaaaggagacacctaaaagcttttcactacagcaatgtttgtaatagcaaaaaatactataaataatttaaatgtgcatctctgtaagaatgaataaatatactaagtaaaatggatgcataaaatagactattataaaaattaatgagaataaactaaattcttatattggcatgaatagttctaaaaaacaatgtaagcaaaatgcaaaataaaatgcaggaattttattaatgtaaaaatttaaaatactactgtatattgttcaaggatatctattaatatatttgaatgtaaaagtataaaaaaaagtagttgtccatggagaagtaaaaggatgtaagacaggaaatgaacaaagcagacagataaacaaaacaaagagggaaaaagagaccagcaagattttccctgacattaaatactaaaataaaatacttatgtctgtatgtggctcaatattggcagggtaaagtttaaagctttttattctcaagttgattgtaatcgttgagagaacaaaggaacacactggtgagtttaaagcttgggcctctacctggcatgagtagctgctttccgcaccaaatccagaacatctgtactgggggtgtctgacacttgcgtgctctctctcattctgaccccttctttccccttacatatcattttttttcctttcttccttcccttgggtctcttaccacaaaagctccgcaccagactggggttctgacactaacttggcatgtgattctgggctgccacctcaccattctgaacctcagtgttgtcccctctaaacctgggagaacacccatcctgcctggaggcaagtatggctcgctgtcagttctcctttctgctgtttctctattccagcatcatctccagcagactacaggcatacagagcctccgccttaatctcacctctgctctttgtctctgcttcagctcctgctgggctgatttctgtttggccttctcaactctgctgacagattctttaactttggttttttctttacgtgcaggtggatccatggcttgacttctggatatttcttaggaggctctgatctgggtggtacagaaagaggcagatcttcaaaacaaaacaaaacaaaaaataccctgccagttactcctctaatcctttagctccgccccatcctttgccaggtgaggcagagtggtctggtggcaagggcgctggatgtgggggagtaggaaccgagtcccaaggccacaacctcgctgggtgtccctgggcaagtctcctccccactttgagccttagttttctgtctgcaaaatgggttaagtgttttcctggcctccctccaggagctgctgtgtgcgggtgaaatgcaaagacccctgtgaaagcgttgcccactgtgcggcgtgcggcacccagcgcggaaccgtcctaatgggacgctgagacccagagggcgcccagggttttcccactgcggccggcctaactccgccgcagcagccgctcctggggccagggggccgggccccatagccagccgggcccgccccccaccgcccggccccccgaccccgccccggcccgcccggccccaggggacggcccccgcctcctgccctcttccctctcctggaggaaaatggcggtcgctggagccgccgaccaagaggcttgggagtctgtacctttcccgaccgggccactggaagttggagcctccgccgagtcgcagacaacgcctccgggagggtaatcctcgccttcccccgaccactggacccagcgctgcctgcccaccgcccctcgtcctgggcggggccgcgcgccggggggaggggcgcagggccgagcgccaggaggcttccgcccgcaggagcggccgcgcgtgcgcagagaggatggctggaaacccgcgtagagggcggggcggggcaagccggtgccggggcggggcaggggcggagccacaccggggtgggtggtggttacggctaaccaaagctttttcccgttatattttctgcaacagctactaggttttagagggtgagatccgaatcctggaattggaattgctcagaattcgaattccgaggctcaatttcttaattcgaaaagtggggattgatgattgccaccttcttcattcatgagtttattgggaggatcaagtgagatcccgtttgccacagtgctttgaaaaaggaaatcttgacagaagtaccaatagccagtataaatacagagaacattcacgttcaactgattaccgaggagatgtaaattaaaatagctggctgtaattttccaggtattacattagcaaggattgacaaaaatgataatagctaccttacatttgggcttactatattccaggcactgttcttacagcttcacatttattaactaattcctcataataagtgtgtataatgtatacgtgtatattattatccccatttacacataagggaacagaagcattgaaaagttaagtgagttgtcccgggtcacacagcttctaagtgctggagcaaatatttcagccaggattcataggacaatggccttatccaaagtaaaaccctgtttgggtccactatttgttcctctatcaaactggcaagaattgaaacaactgatagatgctaagcaagcaatgaactcagcccagatggacacacgcttccagtcaaactgtaaatcgttaacagcctttctggaggtcagtttagtactaggtatcaaaagccttaaaagtgagcacaatgccccaaaaagacaaatactgcatgtttccattcatatgaagtatctaaagcaatcaaagtctaagaaacagaaagtagaatggtgactgccagtggctaggagagagggaaaagaggaattgtttaaagggtatagaattttaggtttgtaaggtgaaaaagttctagagatctactgcacaatgtttattttttatttatttaatttttaaaaaatagatggggtcttgctctgtcacccaggctggagtgcagtggtgtgatcataactcactgtaacctgggctcaagcaatcctcccacctcagcctccaaagtatctgggactacaggcacacaccatcatgcctggctaattttttaaaatttttttgtagagatggagtctcactgtgtttcccagggtgatctggaaatcctgggctcaagtgatcctcctgcctcagtctcccagagtgctgggattacagatgtgagcaattgcgcccagcttttccaaaatttctacagtaaacgtttatactttagcaatcagaggaaagtacattaaatgtctttttaaaaaccctatacaaatgctgattcgattattattaataaaagtaaccaagtcagagtctatttcagaaatcttgatgtagtactggtattttacatttgtgtcacatggtatggtttataacgttcatataagctatgaactagattacagctgaagacacggcaggacctttagaagccagctaaaaacaaaccagctatagggaatggaggagtggaaaagccacatggaagactggaaaagtagtggtgccactgagccactgttgaaagtggagaaggtgtgatgagttggtttgggaaacggtgaggaagaggataagttaggagcgtgtgtgtgtgtgtgtgtgtgtgtgtgtgtgtgtgtgcgcgcgcgcaagagagggaccgagagagagaaagagctagattacgcttcaagtggcaataggcaagaagaattgtccagtgagcaattagaagatttcagaaaagaacggaactggagataccagtttgggattctacattctttattgggaaggtgaaggttggagccaggagggagtgaatgttgaggctgaacactgtcaaagtcccctctctattctttccatgagtttatgctttgtctgtctcttttgtgtctaccagtggactcttggccaggctgcagaatttcctggtttgttgaatgactagcaagagtttatagtaatataactagaatatttttacagttgaggtatatactacactaagattatattcactttattgaataatattttttctagagtcaaaaaattatctatttttatttgcttaatgatctatgcatcccttgtttattttttattttcagaggtgggctcaagtgatcctcccgcttcagcccctcagtggctggtactacagatgtgaaccaggtcatttaccagtgtcttttttttttttcttggcagcatccctccttagactcatcctctctttgctccaaactcctctgcttagccttgcttcacagctcttgtcctaggattagggacctaaccacattctggggattctcttcttgtttctcctgtgccaaatcccctgctctctggatcttatgtttttccattcttggtttattctctcattttggaggagtatgttctccactaactccccagaaggggttcatggaagctaaatttttgagtccttgcttgtctaaaaatggctttattttctttcatccttgagtgacagatttccacattggaaattattttccctcagaagtttaacggcattgattcattgtcatctagcttctcatgtggctactcttgaggagactgatttattctgacttgtgttacttcccatatattttgtttgttaatttgttaatttgtttaggatatttttctcctttatccttgatgttctgaacgttcataacaaactgtcctttaagtatttttcattcattatgctaagcactcggtggcccctttcaattgggaaacaaagtcttcaattctgggaaacgttctctgtgatcagtttctctttttttttttttttttttaacaaatagagacagggtctccctatgttggccaggctagtcttgaactcctggcttcaagtgatcctcctgcctcagcctcccaaagtactcagattacaggcatgagctgctgcacccagccagtttccctgtttttaaatttttcttcatgttccatttcctggttttgtttattctaatttacaagagattttcctgagctgtatcccctggttcttctattgaattttttcatttctgctacaaaaatgttaatttccaagagtttttgtttgatccccgactttcctttttggtagcctcttgctcttatgttgtggattcaggatcttctcttatttcatatttctgaggattccagttgtaattttctgctgttttcttctgcttcctagattgtctctgttgtttattttggtctctggctttcaagttggagcttatcctcagacaataacagctaccattgagtatcagcccctattttaagtattttgcatgttttagctaatttaatccttacaacaaccccgggaggtagagccaggccctggtccctcccatcccaagcctggaaggttctcagttgagaatcagctttcttcttgctgatgtcaagggttgatgtcaggaaccctttatctgatgtttcccccaatcctgcctccctctgcaggcacctgggttagagttcagtttttcctagctctattactagtgagccctctgctttccttcattaaagaaatgtattgacatctctattgcacagttacttactgtcctgttctctttgtccttataggcttttccttttgcactccaagattgtcattttagatcattttgggaggtaacagagataagcatttgtgttcaatgagacatgtttatttaactggaaatctagagctccctctttttaagtcaggaagcatatagaccaaaaaaattacagtgattattactggattctgagattacgattatgagtgatatctttatctatgtctgtatctgtttttctcactcatagagttagaagtctaaaaagaacatttcagataagaaactcattttatgatgtgatttagactatctgataaaatgcttctggagaaagcagtaaaaatattaattatgacaagttataaattggtacaattactttggaaaacaatttagtatcatctataacctggcaatactacttctaggtatatattctgagaaacgctttacatttaaaaattattgaggacctcagggagcttcagtttatatgagttatattttttgaaattttccatattaaaaattaaaactgactgggtgtggtggttcatgcctgtaatccagcattttgggaggccaaggtgcgaggatcactttaggccaggagtttgagaccagcctgggcaacgtagtaagaccccatctctacaaaaaaatttttaaaaatagctgggcttggtggcatgcacctgtagtcctagctactagggagactgaggcaagaggatcacttgagcctaggagttcaaggctgcagtgagctatgattgtgcctttgcactccagcctgggcaacagagctagaccctagctctaaaaaaaaaaaaaaagaaaactaagaaaaattaaatataattactacttttaaaaataaaaataataaattatataacaacaaaacatatatttatgaaaagcaacttttttgaaacaaaaatattactgagtagcactgctttatatttatataaatcctttttaaaaaattaatttttttttttttaagatggagtctcactctctcgcccaggctggagtgtggtggtgtgatctcagctcactgcaacctccacctcccagcttcaagcaattcttgtgcctcagcctcctgagtagctgggattataagcgtgtgccaccacgcctgggtaatttttgtatttttagtagagacaggatttcgcaatgttggccaggatggtcttgaactcctgaactcaggtgacccgcctggctcagcctcccaaagtgctgggattacaggcgtgagccactgcacccagccctaattaatttttaattgacacatatggtacatatttatggggtacagagtaatattttgatacatacaatgtgtagtgatcagatcagggtaattggcatattcatctcaaacatttatcatttctgtgttttggggacattcagtatcctttcttctttatttgaaactacataatatattattgttaactatggtcatcctacagtgctataaaacagtagaagttgttcctcctacctagctgtaattttgtgttattgaacaaatctctccctatcctccccttccctctccagcctctagtaacctctgttctgcttttcacttctatgagattaactttttctttttttttaacatctaactatgagtgagaacatgtggtgtttaactttctgtgcctgacttatttcatataacgtaatgttttctagttccatccatgtcactttgaatgatgggattttattctttttaatggctataaatattttagatgtctggcttaatagaagacagctgtattctcaagccagctatatctttcaatctgctgcagtatgttttgtggttgaagtgtatgcaattggaaaaggagcatttcagtagctttttcagataatcgtggatattctttgataagacaccaaaactcagcaagtggtagttttttaaagcttagttgtgacatgaaatctgaaaccatagcaatgacctttttatactctattacagcaacactcacagttttttcttgcattttaaatgaatgttttacccatgcagggttttgtcaacacacccattggtcatttggaaattgctgagtcactgagttttacagatcttctaaatgttgacacatttcattatacaacatcaaaaaatcacatttattaatatcaatgccaatctcatcagaaaagtcttttgctattgtgagggtatcaagcagcagataaaaattttccaaaattctaatttttgctcaaaagattgaatgttctcattgacaacaaacactgtcagttgcttttcctgaagtgacaggtgcactttattcattttggagaaaatgcctgccaaatacccaagtctgaataattatactttgtctttcagctgtactttcaggtaagaatggtgctccatgagtcaagcgattacttcagctcacaactcaatcacttaaggttttttcctcgataaagtcatcatactttgatatgcagcgtaactgtttatgcatccttcccattttgtcacacaaactattaaaaagatgtgtatctaagagttgaaatttaataaaatttgtaacttctactacagtttggtgccacttcctgatttgtgctagctgttttacccactattgcttttgcagtgtccttgaaaatgtcaataccgtgaaaaaggcaaataacgtctttattatgatgaatgtagttttaacctggatgatagggcctcagggacttcaagtgtttgtggaccacacattaagaactggtgctctagagaaattcttgcacatgtgagcaggaaatacctatcaagaatgttcagggcacgaggccgggcgcggtggctcacgcctgtaatcccagcactttgggaggccgaggcgggcggatcacaaggtcaggagatcaagaccatcctggctaacacggtgaaaccccgtctctactaaaaatacaaaaaaaaaaatagctgggcgtggtggcgggcgtctgtagtcccagctactccggaggctgaggcaggagaatggcatgagcccaggaggcggagcttgcagtgagccgagatcgtaccactgcactccagcctgggcgacggagcgagactctgtctcaaaaaaaaaaaaagaatgttcaggacagtattatttataaaagctaaagcccagaaacaacccacatttctatcattaagggacgagagaaactgttggtagatttatataatggtctactatatagcagtgaatgaatatcctagtgctctgtgaaacaacctggattaatttcagtgtcttaatttgtacacccccagaacagagtgtgaggtgtgagacaagtacttcagttcaagagtgtatttaggaggtaatcccaggaagcagaaatgggaatgagcaaaaaaggaagaaaagtcaataaaaggtgcagtacggagctacttaccactatgaaccaccgtgctcactcccattgggaacactcagaggaatcatgtcgaatacagctcagagctgaaggtgcaagcctggagcattttgtcttgactcctctcactgttgtttatgtctccgaggtgttagctttggtgaacttctgggctgcacagccttccaaggctttgtagaaagccccaagacaggcaagcagaaaaatgccatggcctatgaggtgacatgctagcagcttgcctgcaagtctcagctacaccaaaattgggtgggctgaggggacatggtgtgggccaccacagatgtctgctagactcagaagctaatgttgaataaaaaaagggaataattgggaattatgtacaatgggctccatctttataaagttcaaaggacataaaaatgtgtaatgtattgttaatgatataattatggagattatgaacatacagctaaggatattatgaaagcaagacaggcgggaagcgtttatcacatgttggaaaacagcaagcttgcttatcagaaggcacatgtcagggtgtagctggagataaagatagtgagttaaagaaggtggttaattggtggatgtctttgaaaccaatcttccaatttactctgatttgaaaagtaaagggggaaggttttcagaaagaatgtgataggatcaaaacgcatcagagggaattactattggcagcattggaggaaaagggagtggaggggcaaacgtgcctcctacccggtcagtcatactcagtggttccctcatttttgggagcctcctctttgctctgttcttttatcaggggcatacagacagggtgtggcttgctggtttacagggacagcgagaagggagttctgtgggggcagagagagccctggcctctcatatttcataaaatatgaacttttcccggcccacatccctaggccttcctgatgcgcttgcctgctccctggtctctctgcatggggaaggagtgttcccagcttgcaaactccagctttgcctgtgagaggaacaagcgtccctgatccagaaggtggtgagtcctcctctctctcttcatgctttttagtcctttaactttctcaggatcctcaggtttagtagagaaataatcccctttctccttacgcacaagaacattttcaagggtgaaatggggcagttgttagctatcactaaagaaacacaaaaggagacaagtgacaagattgctggatgggttttgttgaagtactcttatttaagtagtattgtcatcattattaaattaaagccaacatttatttagctcttactatttgctggacgctgtgctgtgtgcttttagactgatcaattgcagatttgcagggtcatattaaactgcttgggactgtcaagagaacatctgttacaatcttttttctgatttagaagttttaaaaattaaactgtttcaaacttaaaatgtaaataactgccatgtttccaacatgtgtagtggaaaaaaatggttagtatatgcagaattttgcaaaccattaagaaataaatgtcccaatagataaacgagcaaattacatagacaggtaattgacaaagtccaaataaccagtgagtaatcaaagaaatacaaattgaaatgaatcaccatcaaacaaaaaaaaagggatggcattttgttactcatgaaattggcaaatttttttttaaatgataatatccagtgatggtaaggttgtgggaaaacaagaaatttcataggatactttggtaagttgatatgactttctggagggcaatttgtcagtgcagatgaaaagtcttcccattttaaagatgggaaacttaaggcctaagaatctaagtgacttgcttaaagttacaaagtcatggctgggcgcagtggctcacacctgtaatcccaacactttggggggccgaggagggcagatcatgaggtcaggagttcgagaccatcctggccaacatggtgaaactccgtctctactaaaaatacaaaaattagctgggcatggtggtgtgcgcctgtagtcccaggtactcaggaggctgaggcaggagaattgcttgaacctgggaggcagaggttgcagtgatctgagatcatgccactgcactccagcttggcggcagagtgaaactctgtctcaaaaaaaaaaaaaaaagttacaaaatcacagagcagtaagggaccaagccaagactaggactaagccatctgattctagccctcaatccactgtcacttatagcaatgtttataatagcgatgtattggaaaacaacctaaatgtcctcaatatagaattattttaaagcttttacatcttatatcctaacttctaaaattctatgtccatgatggaatcctaaagtcatgtaaagaagatttgattgccttgggaaatgcacataatgtagcacttggtgaaaatatcaggtatcaaaacagtatataaagtatttatttacttatttatttaagacagggtcttgctctgtcatccagactggagtgcaggggcgtgatcatggctcactgcagccttaacctcctgggctcaggtaatcctcctacctcagcctcccaagtagctgggaccacaggcacataccaccacagccagttgatttatttttatatttttttgtagcaacagggatttgccatgttgcccaggctggtctcaaactcctgggctcaagcaatcttcccacctctacctcaaagtgctgggattacaggcgtgagccactgtgcccagtcatggtttttgtttgtttgttttacaaaaagttatgtacatgcatagaaagaatatttatagaaacattatctttgggtggaggaattacagatgatttgacatttttgtccttgttttggatcatttccagattttcctacaataagtaagacagaaaaagccccaaactgtggcatatacattgaactttaggaagtgaaatcatattttatatttgttggggaaaatttctttgtaaaggagttccatgataatcactcagtaaagtgtggtggtcatttgctcattttataactcatgatacagggctatataggcatgcattcattcatctgtttatccatgttttacattctatctgcttccagaaaggatcccggcaattcacttgcatggtaccctgaagtgtgtatgattgcctttcctgttctaagtgtaaaagagaataatacctacttttcagagatgttgtcagtactgaagacaatatatatggagaaacaacaaatgcaataaataagaactattattgatttagagcaatatcataattagaaacatatttatgatttagtgttacttcacagccattaataggatgttgactactataatattgatatgttacatgttagaagagatggaggaaggggccatcctggcaaactagattagaagaataaatcctggaggtcagtatggtgaccagatggttcttacatctgtgtaagaaaatatgaaaaaaaggacctggtagcacttcttacatggagtgacaatctaacagaaggacttcatttgctttttatttccagcatctggtgcaaatcattttacatgtattttctttgatccttactataaccctatctatgaggtaggtactattattaacttcatttcatgtgtgagcaagaggaggtttggagaagtaaactaacctgtctaaggccaccagttaggaaatggcagagccaggacttgaacccaggctgactctagagctcattctttttttaaaaaaatttttttttttttttgagacaaggtcttgctttgttacccaggttggagtgcagtggtgcaatcacagttcactgcagcctcaacctcccaggctcaagaaatcctcccacctcaacctcctgagtagctaggactacaggtgcgtgccaccatgccaagctaattttcttttattttttgtagagatggagtctcactatgttgcccaggctagtctctaactcctgagctcaagtgatcctcctgccttggcctcccgaaagtgcagggttataggcatgagctaccatgcccagcctagagctcaccctcttaaccacttcatagattgtctgaatcttggaatatgggtccatagaggtctccttctatttgatttcaggcagccttgggttagcttggagctctgggtcactctgagcatgtctacccagggtgtgcttcagagtcactagaaagttgaggggttttgggattagggataacgccagggaatcctgggccctacttccaccttcaaccataattgataaaatagagagcttttctcatttacttaacttctcttgtccagtttttgagtagctagtaacctataggaaagtgggtgggacagtcacaaaaaaatgtgtcctaatgtgatcctaacctcactatgacctagtgctatgttgtcatttgcttagaggggtatgttgtataaaatatgatttaaagaaaaacaagaacaaccctaaaccagtgtgctttttgccatgagaaaacagaattgggtgtttaaaatgagaatgtgttcaacgctagcttcatcttcagtttcccagtctccctttgacaccccctccgtgtgtcatgaccttttccatgaccttcagggactgggccttctgacttatacaaaagcctcctctttggaaaggatttgaaccttggagagaatttaagagatgagttgccttttcctagagcatttacattttaaactttatgctcacttgtggcatgagagattctgtttcctgctaaagcaatttcaggcagtagcaaataggtggggaaagagctttacaggaggaaatcctttagggtctccctgtgattcatgcacacggtcatctggacctgctagggataattttcctcacttggttagtaataataacaacaactacacacttatgagcagttgttctgccaggcatttgtggccagtgcttggcaggcagtatctttttgaaccctcacactcatctgtgaggacagtttcccttcatagattaagaacccgaggtccagagatgttatgcaaccttcctagggacacagagctagtaataggtagagctaagatttgaacccaggtctttccagcgccagaccctgaatttgtaggattagtgccttcaggatgacatggagggacctcactgccttgatctgttatttatcaagagtcaaactggaaaaggctgtcagggaaacctccaggctgcatcttgggcaaagattggcttgaaacaggcatttcccaagcctggccttggacaccaactgtaaaaaaaaggccattactggtgtttccttggttagttctgggtataagttctggatcctcactcatctcatctgcactgacatcctcactcacggcatttagagacttaacacgccagcctctgtgtgagcatttacctctttcaaccctcaccataatcccacaaggaggcacagttcttttacccattttgaagatgaagaaacacagtctcagagaagttcggtcacagtatcacaaggaggtaagtagcagagctgggattggagccccggcctttgtgatcccagagcaccagcaataccgtctcggcctcggctcctgggttataccctctgtcacgccaagcccatcagcccgcttgtgctgtctccctctgtctgtcctagttcggatggagatggcgagttctgctggctcctggctctctggctgcctcatccctctcgtcttcctccggctgtctgtgcatgtgtcaggtaggagtttctgatcctctttccctgcctggtacatgtgatattggcgtccccagaataaggaagcttggctggaaacattatgtcttttggggttctgttcccccggccctggcaatcctttccagagtccttcctgggctctgtccgtccccgggatatcctcttcctcatcccttcccaagctttctcctgccgtccctcccagttggccttgtctctttttttgtccaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcaggttagaatgggtttgaggtgcccagggtcatttgtggcaattggacaagcttaatcaggacctactttgtctctccatgtctagacttttctttcatctgcagtgtagtttttacttgccaggatggctcagccttacccagccatgtccattgatctcagctgaggctgtgaagctggcctaggcatttctgataaggaaggaactcagactttggaaaacactgtacaatgcaggtcctggttaaatagggcttggaggctcagataatagcttttcctccctgggtcatctttctatgctccattatcaaggaactcattacatggctgtaaagaaatgtcttcaagggacagatcccctgctgtgacaggatttacttaatgggtcctctcctggggttcctgagaaagtaaagggttaggaagggagagatagtgtttttttttttttttttctctttttttttttttttttttttgttttgagatagggccttgctctgttgcccaggctggagtgcagtagtgcaatcatagctcactgtagccttgaccacctgggctcaagtaatcctgccacctcagcctcccaagtagctgggactacacatacactaccatgtctggttaatttttttttttacttttagtagagacagggtctccctatgtttcctagactggtttccaatccagcaatcctccccgcttggcctcccaaagtattggcattacaggtgtgagccactgcacccagttgagagtgttctcaaactagcttcaatatttaaaaaaaacagtttactgaaaatcagtccacaaaaatcagtctactaatattttaaaaaatcagtctaccaaaccaaacccaactcaacccaacccaaaccatgtctttgcatttgcttgaatgacactggcttcacatggtcacatgctgattatcttttggtcataatttgaagtcacacaccatgaagtggggatgaatcaattactttaaaacactcagtagttggtagacagactttccaaattggagtcctttggggtgaaaattaatttttttttttttttttttttttttttttgagatggagtgttgctcttgttgcccaggctggagtgcattggtgcaatcttggctcactgcaacttcgcctcctgggttcaggtgattctcctgcctcagcctcctgagttagctgggattactggtgcccgccaccatggccaactaatttttttttcttttttcttttttttggagatggagtttcactcttgttgcccaggctggagtgcaatgatgctatctgggctcaccacaacctccgcctcccaggttcaagtgattctcctgcctcagcctcccgagtagctggattacaggcatgtgccaccacgcccggctaatttttgtatttttagtagagacggggtttcttcatgttggtcaggctgatctcaatctcccgacctcaggtgatcctcccacctcagcctcccaaagtgctggaattacaggcatgagccaccatgcccagctgaaaagtaatttttaaaaggggaccgaggtgcccacaggaatctgaatcatgtgatacagttattgctatgggtgaatttttaaatgtctgagaataaagctagagactggcttatcccattaggaggagcgtggggagagagtggagagaggacaagttccattaacagctgcccctgttcatcacaggaggctatgggggaagagggccatggccaggaccataccctggcagaggccctgctggtgtgcagataggtgggatggttcccagagccctgggccaagtggagagaacctcaaggcagggtacttccatccctgtcagaggcccactctctggaaaaagctgggctcttccaaatagcagtgtctagcagagtcagggacagcacactggggaatgtgtcctgaaccatccacaacatggcccttggccaagagaagaccacagctgtggtcataacaagtaaaagctggggtggaaacaggtttgaaggcgctggtggttcctgaggaaattcctaccctagcaggaactttttgaggaattttcaatttttttaaattctaagaataaagcatatatattgtagaaaatttgaaaaaaatccaaaatatttaaaggaaactgaaaaatggcctataatagcttaaattagagagaactgctgctaacatttttgtatctttcttgcaagacttttttgtatatatgtatctctgagcatgtatgtttacacatgtgtattcttgtgcccaggatatttttccacttatgatatcatgagcatttgttttctttgcccatgtccctaagtaatatgattttaagggctgcatagtattttgccatgtggctatagaataataaaattaatcaaagccctgtttctgggcatctggatgctttccaaattttcctcatattataatgaagggtgcaatgaacatctttgaacgtattttggaaagtgattttgattttttttttaataatgtacttctggcagtagaattaatgggtccaagggttcaaaccttttacttattttttcttttttatttataataaagatgagctctcaccatgctgcccaggctggtctgaaactcctgagctgtagtgatactcctgcttcagcctcccaaagtgctaggattacaggtgtgagtcaccacacctggcctgaaccttttaatgatccttgaaacgaactggagaccagcctggccaacatggcaaaaccttgtctctaccaaaaaaatacaaaaactagccaggcatggtggcatgtgcctgtaatcccggctacttaggagactgaatgctttatatgactgacctctttaaatctctccaaacctcaaagagataaggagtcctgtcatgcacacattttacagatgagggacaatgggctgggaggtgctcagtctcctgctttgggtcacacagcattgagcaaggacatactcccagcttaggctcttaactacttctacccatagcccgcttctgctcgtttcctctcctctatttcctctttcttttcccctttctctcctgcctaggcttcaggcctactgctgcggcatcatagaaattgctttgcccccgtggacagtgctcagggcaaagaggttgctgcctgctcttctagagcagagtgaggattgacaggggtaaacaggcaggtgctcctgggaagactggaggtgtgtagtgaggagagtgccttcagtcctctgaagtcccgggcttatttttccattgaattatagggcaggatgagattgtggtcaagaagtttgtttaagtcatcatcttgaggcaggaccatccaaaccattcccgagagaggaacatctcagtttttgtttgtttgtttgtttgtttgtttttgagatggagtttcactcttgtcacccaggctggagtacaatggtgtgaccttggctcactgcaacctctgcctcccgggttcaagggattctcctgcctcagcctcctgaagagctgggattacaggtgcccgccaccacacctggctaatttttgtatttttagtagacacggagtttccccacattggccagctggtcttgaactcctgatctcagatgatcctcctgcctctgcctcccaaagtgctggtattacaggcgtgagccaccgttcccagcctcagttatctttaatgctatccagggcttgagttatcagagaagcaaagagcctcttggccggagctctctccctagaggtgatggagagtgttgggatgtgctggagccgcctgccatctgaggcatgccagaagctcttagacatctccctgaggtcagtcgttggtggtttctgtttcagccccatctgtggggagtctctccccctcagcagtggctctggctgtgatcctgcctgtcctggtacttctcatcatggtgtgcctttgccttatctggaagcaaagaagagcaaaaggtaattaaatggtaagggagctcaggctggtgggaagtgggactatgactgctctgggaaagggccagacggaagtagatgtagacctgacacttctccataggttggggacactgcaagttggctgggagaaaactggtagagccatgccctggggacacacattgcaaagggagttcaataaactgcagaaaggcccctgggcagagctgtaaattctcatcctttgaaaaataagaaaataaccgactatgccagccttctaattaactaagaaatgaattacagccctttaataaagaaatccaattatatccattggataagactctcataaaaaatggtcacatttcacaggatctcagggctgcaagggactttgaaagtcacagtcatgtaatccaacactcctgcccttatctgatggtttgaagactctctaatcctttcaaatgcccgcttacctgtagtgacaaggagtcagtcctactcaggcagctgggggcatcttgggacacttgtgcctgttagaaaaagcccttcctaagctgagctggcatttctctctcccttttagaaaagcttctctatgaacatgtgacggaggtgggtaagtgttcttggctggggggcaggggagatgtttcttttgttgttaatttctgtgccccccatacccactaacctggattctgttcctgaaaattccattatctgctatccttggtgatggtggcaatgtctaaatccgttgcttccagtttttactgcctcttacttgtaatagctttgccttcctgtatgtttaatgatttttgcctgtgagctcattgcttgatcttattctatgggagtcgagtagcttgaacatgggggaagcttttatttgttcaacaaatacttgataattatctacaaaatgccctggacaatactagattctggggatgcaatagtgagtaaaagcagacacagtttttgccctcctggaactttcagtgtagtcagggaaatgagatgaattaaatagttaacacaaataaatgtgtacaaaagctacacaagaaagctcctggttctgtgaaggctatgaccagaatgaaccaaccaagcttgagggttgagggtatgaagtttgtcctgaaggactagaagtcatgagtgaagagggaatggaaaaccagccaccgcagaaagaacagcttcagagagaagcatggtcggggaaagcagcactcactggggagttgaggaggtgcaggagtgaggggaaaagtggcaggggtgaggctggggagtgaggcggagctgagcctcctgaggcctggtgggtcacattcaggattttagtcattctcgtaagagcagtggtaaagcaaggaatggggatatcagatgtaattgtgctttgaaaaacttggccgggcatggtggctcacgcctgtaatcctagcactttgggaggctgaagagggtggatcacctgaggtcgggagttcaagcccagcctgattaacatggcgaaaccctgtctctactaaaaatacaaaaattagtggagcatggtggtgcgtgcctgtaatcccagctactcaggagacagacaggagaattgcttgaaccccggagacagaggttgcagtgagtcaagatcgtgccactgcaatccagccagggtggcagatttttaaaaaaaatctgcagtgagtcaagatcatgccactgcaatccagccagggtggcagatttaaaaaaaaaaaaaaaactaaacaattctctcaggctgcagagtttagtagagaccagagggattaagacaggatgtgggagacaatttgggctgccatttctgttgtccaggtgagagttgattagagaccggatcagggaggtggaggtgaagatagaggtggacaggtccaagggcaggtaaaatcaataggaatcagggatcctcaaggcagtggcaaaaaatctcattatcttttcctttcttcctctagacaatcttctttcagaccatgctaaagaaaaaggtaatgatataaaagagtaaggggtagggaacaaaaaacacattctttatttttctatgtaaatgttgacagtcattattataagtctatttttataatactgtacacacatgcacacatatatcctccattgatattactggaatttagtgtgcaatgttaaggggctgtggagcttgtggcagtgggtaaggaggtgcccaggtcaaaattcacaggcctagattaccataaactcccttcattagcctttccgccaaccattttaaaaagaagtctacatattattgaaaagtatattaatgtggtcatatgggatatatgggaatttcaagaatccacacaacctttgcatagagagaggtggtatgatacaaaggaagggtcgcaggctctggggtcagtgacacctcagatcattggtctgccacttaggttttggtttcctcatcagcaaaatgcagataacttccccttacctgattgttttcagtgttaaaacaggcaaccttaaaaaaaaatctgtcacagtgcctggaactccttttccttattgccattttgtcttcattaatttgacatttactgtgggccactgagttggacaccttgttgaagtctatctgggaagacaagtcactggctcagatgactccagattcaatgatgtcagcgtctcctctcttccctccttacatttcctccaagctggtgcaagcgtggcgtgtatctggcagacactggctgttctgctcaagtgaagagggaacagtgtggggtaagggagagggcctctaactcaggagtcagacagacttagattgaatcctgcctccttggtcacttactagctggaagaccttgggcaaattttgtgtccctttgagcctcagaccacccccctataaaatggcaataataattctaggcatctcacattattgagaggattcagtgcctacttcagtataagcacagcagacagtaaatggaagctgttagtagtggagatggtaacaataaaccataagctccttaggagccgtgtcgtattcggctgcattgctccaatgcctaatgcctaacacatgcccggcccttagcacagggactggtggtggactcaggatgtgtaacttcaattgtctagcagggccaatgctgggtagggggaaatgtgggccacatggccctccagagaagctgcaagtactccccagaaacacatgtctcatacacatgtccccaaatcttctgggacctccaatttgtgaaatttataacctcaggggagttactgtagagaataatacagccatattaacaagttcatgctaggcctttagctagttttacaccttagataccataaacggtgggctataaaaggacagcagtgcatacactcatgtaccgcagttacaaacatatagaaacactcatgccgacagcagaaatgaaaccagacagatgaaaaggaggggaaggggaaggaggaaccaaagtcccgggcaggctgggtcactgggacagtgtcaccagcaccatcagatttctgggtctgaactctgggacacggagctggactagggacatagaagcgtcaccatcattttaatcttgtgggttggagtgatgaggctgccacagctctgaggaaaaagaggcaggatctgatcactcactcttctctctctttctggtttttaggaaaactccataaagctgtcagtaagttttgctcctcatccatggcacaagctccttctgctgacacttttgctttgggatgagcatctcagtttcacttcctggggcagaagggagggggtactggtaattcaagccatggggactggggctttcttggctctcaaaggcctcttttctcaagtattctctgctcctctttcctgcacaactattatttagtctttaaatgaaaaacgtttcaccaggaagagatagatgcatctcccataggtgaagccatctggaagtcccttttatcacccaggcatgacatttccttagatggggtccaggaggacaggatccttattaaactgaatatgctggagcagtacttctccatcatttcatgtgtgaggacctctttttaacattaaaaaaaaatctggccaggtgcagtggctcatgcctataatcccagcactttgggaggccaaggcaggtggatcacttgaggacaggagtttgtgaccagcctgacaacatggtgaaaccccgtctctattaaaaatacaaaattagctgggtgtggtggtgcacgcctgtaatcccagttacttgggaggctggggcaggagaatcgcttgaacctgggaggcggaggttgcagtgagccgagattgcactattgtactccagcctgggcaaaaagagcgaaactccatctcaaaataaaaataaaaataaatctgtagacatgtgacatatctatgcattaattattacattgagaaaatatacatgatcacaaagtccaatactcagtgatagttttaaatgaagtaatatttcctacaacatctacataatttatgttgtcattacctgtaggtgtgagatgtgttatttatttagcctgcagataaggtttggctcacataggaatttgctgatcctctgcagtatctctggggatactcccatggtccacagctgggatctactgctcttgcaaactcttctggggaagttccagggtatagctattgagtatctgtctgctcatggttgggatgggactgtagcattatgggagggcctctacatagaggccctccttctgatttgccaaattgttttcattctttagagaaactccggagtgaactgagtaagtttcccatgttcttgtaacttccgtaccaacttatctcctgttgccctaatatttgcagtgatagctcattccccttgtttcttctttcatagagttgaaaagagctgcagcaaactcaggtgagatgcactttctccacatttgaccaccaccctacaggagttcttgatgtctctggtactttaatgatccccttttctcatttttcaggctggagaagagcccggttgcattttggtaagttataccaatcaaataggtccatatctcagagcacttcctccttatggctttgtaaccttagattttgttccattcctctggaatgcaggtaatttaaaaatttttaaatcaaatctgtatatctgactatcaaattaaaaaaatctttgtgatcgatcttgaggtcatatttagatttagaaagtatcccctcttttagagcactgataatattaggtttggtcttcttaagggttttctgtggtttttgagatttttcctatgtttatcagttatttgtatttcttctttgtgtgacttgtctgttcctgttctatttgggcttttttttgatttgtgaagactctttctagataaagtatattagctctttgtcatatttgtcaccattacttttcatttgtacttccttatagtatttttctgatgcataagtgttttatttttacgtagtcaaattcattcatctttttctgtgtagtctcttccatgctttcaggtttgggaagtccttcctatcccacaaccagataaatagccactgcttccgcctctttctacacatttgctttttcttctttctctgcagaccaatttgcttaggggtggtgattgagattctcagagaagaagggaatgggttgagcagatgccccaacaatatacattatgaaaagatttgcacctctctttcaatgtattcctaaatagtttgcattttttgctgctgttcaaatgggacctgtttttttcactgctttgggatccttatcaattttctaggcttttatcctcctcctgttcacaccatcttccttcaggcagagtacaacaaattatgagttggccactcgagagaactccaggtcaccttggctggcattctgggaacttacaaacccttctgtctcacatttacagtctggcttattgccaccatctcaactgtgtatggtttatagacttaactctctaagaagaagctgtttcctgtatttggggaaggaaggagactcactgtgacactcataatccacaattttagggaagaatccttctctctatattaacatttaaaaataataatttcgtcctacgtacttgggaggctgcagtgggaggttcacctgaggccaggaattcaaggctgtagtgtgttatgactgcatgcccatgaatacctactgcattccatcctgggaaacatagtgagacccttcctcaaataaaataaaataaagcagataattataagtaataattttaggtgacagaatgaatatcatgcactcactgtaggaatgaggcactatatcattagttcatcaagtctgcacaatagctctacaacacaggttctgttactatttccattttacagatgaggaaactaaggttcagagatgagtaacaagcccaaggtcacataactagcatgtggcagagctgggattcaaacatgctatgtggctacaggatctaacaacaaaccctgtatttatcatcacacatttgattattttggaacatcaaagacaaatgtggtgtcttactctgttttctgttgctataacagaatacccgagactgggtaatttatcaaggaaaaaggtttatttagctcatggttcttggggctggatggtccaagattgggcgactgtatctggtgaagggcttgtgctacttcatagtatggtgatagttgcttctggaagaacagaagggcaagtgagtgcctccaaaagcagagaggagacaaagtgccctgacctgctttatcataacctgctctccagagaaataaacccagtgttgtgaaaactgcattcatctctttgtgaaggacccaaacacttcccactaagccctacctctgaacactgcagcaatgagggattaaggttccaacacgtgaacttttgagggacacacttaaatcataacaggtagttatttcctgaggattaaagcagtttcacagacagatgaagaagaactttttcttctattacttagtaatcgaccaggagacctattctttgaaagagaatattctttggttccagtacacatggtgggggcgggaatccatgaactaaaatgggctaatgacagtgatggcagacctaagattctttttccctccaaagccatccccaaatcccttaagacctatacttccaagcctcacctgtctgtgtctctttgcagtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtgttttggtatgctgttattttcattgtgaatgaggagttgtggggaaggtaagagattggtttccaaagagctttgagtcccccaaggcaaggtttagccaccgttcatactaaagccatagttttattcctgagtctgctctctagtattttattttatcaatttataaacaaatagtgttcataaggcacacatatttcactcaaccatattcagttccaaacatgcattcctgaatatcccaatcttaaaactaactcacattgtcagcttgtggaggcagaatacatgcatacatatacacatacatacatgaatatacatataatatacacacacatatgcatacatacacatatacacatgtatacatgtatgtgtatatacatatctgtactacataggtgtatatatatgtatatgtatttagcatgtatgcacgtgtatatgtatacacatatatacatatgtatgtataatacatattcacacatgtatgcatgtatatacacatgtatacattagtatatgtatatacacatgtatgtgtattatacatgtatatatgtacatacatatcagtctactgatttgaatattaatgtcatcaagaaataacctcaatatatgtatgtattataaccttacaactatataaaacatacatacatatatatgtatatatgtatacacatacacatgcatgagaatatatgtatgtatatataatatcctcacagtaattctgccagggattttatgggggagggagttggtactccaaatggctaggtggtagagccagagttttatacttggtttatctagctctgaaggcaatgctccttgttctttgcactgaaacattgtgcagatacgagaagcctgtagtttacgtatttcattagccttttattattttaaaaaataaaacctgaaaaaaaagacctagtcctggatactttggtgatcttgttgtgtctggattgacgaacacgtgtcaggcttaattagggatgcacgcggaacccgggaaaatccctgctcaggggggctggaagacctggaggttgatccttgaacagggtacttttagcttctccgataaggagattgggttattttatctttaaactcccttccagctctaccctcctttgattttaagttataaaccttgagtgaggtgccagactctaggcttcgttggacgtctacaggacggtcaaggattaccaactcaaagtaaagaaggaaatttgagtacttgcccccttggaggttgtgtaggttggctatacagattctacaacttcccagacgagtggccctgagacttggggctgaacgcgcgagcacggaaagaaatcccaccgtaggacggaacccagtctcttcagctccatcctaaacttcgcaagttttctctgagtctacgcgcttccttaggactacaactcccagcatgccacgccagcggtcaaagcttattggtggtcctgccaggtcgcttgcgttgtggcagtcatggtagccaatggaaataaagaattatcccaagaaaccaatcctggagtagtagggcggatccttcctgggttccggctccggctccagctccttccctcgcctacagaggcggcgctgtccctgatcgagcggcgggagcgaggtgggtccgggttgggcccgaggtcgcggggggaggcggacacgacttcgcgggaaactctgtacacggccacttccctctcaccgaggatctggatgctgctgctttgctccctggaccgagtgggaagccaaggggccttgtggtccctccgccgcgaccctcgccctggcccccggcccacgcagccaggtggctgtccccaacccattccccggcccttctgttgggtttgagtatacagccttcctgccgctgaccatacgtttaggatcagcccctcctcctctcccacctctctggccccaagcccgccggcaatctctgaaaccagctcttgtacccttggacctccgccattggcttctccccgccccgcaacacacaactcagctcttgggccctggcctgtgacacttctggcagcctttgcttcctcttccctgaccgtctcctgcgaccctctgacttccttggtcctcctgtatctctgacccgttatctagcttccctgtacaattaccctgttagcaccttgctcttggtctttcatagctcctctctcctcttcctccctgcagcccttgacttggccccaaagacctgtaacttcggacctccataccgcactatggcttggccccttgcctttaacctaggcgcttcaccttcatcatctgtgatcactagccccatcttcttggctcttaacttcttagacctggcccctcctccacttctcagccccttccaccgttgcttctctctgtgcagctgagccaccaggaagacaaagcccaatagaccccttttccccccagatctctgcagtgtgatatgaaagtgcctctgtacttcagctgcactgtcttctcagtaggtagttgcctctttatctctgcaagtcccagtcttacccatcctgcaaaccttaggtcaaatacctactcctccttgaaacttctcagccctgatttcatcagggagatacatctgtatcatgtgaacttcagtggtactgtttttatttccttccttcccgtcttctctccttttttccttcagtaatagtataatggttaaaagcactgactttgaagtgatgggcataggccccagttctgccacttacttgctgtgtgcccttgggcaagatacttaatttctctgagcctcagctttctcatctctaaaataaggatgatgtgaagtgaaattagatgattcatatatggtccttagtccacagcttagcacttgattcgagctttaaaaaaatgttaataatgtgccaggtgctgtgttagacactgaggagtgggtacaaaggtgactaaggcacagttcctgcccctgtcccctgaacttaaccttctgcattgtatgacaatttctggagttcacggtctgtttcagtacactgtatcacaaactgagtggtaatcataatcctaaatccttttgctcttacattgacctagcatccagccccgggtagagctggaacttggtaaattataggttctcagaatagcagtttcggaagtgagtggaggctgaatagctcattgcgtagagatactgtagctgtaggtcagatgggagcagggcagggggtgggggatgggatggtggcgtgaattaagatcacatcctgtcacttatacattcaaaagacatttgagcacccagctttatgctgcagaaggagattactaatatgacccagtccctttcctcaagttgcttataaactactaatagaaacagacatgttctactagtagttgcaaaccactataagccaagcacaagattctgtgactgcataaaggagaaagtaggcaggaatcaggagattgctgaggaaaagtgggtgagacagttcatggttacttgtgtcccatgaagacagagctggtgttttattcaactcattcaacaaatacttatgaaggatctactgtatatggctgccactactctaggagttttggttacattggtaaattaaaaaaaaaacaaaaaaacaacaaagacaccagctctcatggaacttatgttttagggaagcagacaataaataatagacataaagagaatgtcagaaggtaagatgtgctatggggcaggaggactgggagtgtgggagtgattttaattttttaaaggatggtcaggaaacagtgtctaagtatcaaggaatagtttctcatgtttacttgcatttttggaagtaaagcaaaccaattatttttcatattcttatctaaattcttcaaggaacactaacagggattggcaaaccacagctcacctcctgttgctttaaataaagttttattagagcacagccacacattcctttatgtcttgtctatggctgctttcatgattcatgatacagtggcagaattgaatagttacagcagatatcccatggccataaatatttactaaatattatctggccctttacagaaaaagcttgtcaacctctggttcttaaagagttgaggttctgtctgtatttcacattttagaaggttatatacagttttatgctatttttaagttaaaagttttttcttaatgagatcatttaaaagatctttttcttgtattcttcacagggcctggacgtagtgtcttcaacagttgtaacagcagctgccatttgctgaatgacagcatgtgtcacacactctgctgagtattacaggcatttttttctaatacaaagtcttgtagtgtgggtaggtatcacaattttagtgaagagggagtttaggctcagagtggttgaataatttgcagagagcgataaagatagtatgtgtcacagttgtaatccaaccctaaatgtagtcagtacccctttctttattctgtgtttcttttttccagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagaggtacttttccccccaactctttccctgtccttggctgtaggaacccaaaggagtctgtgcagcttagcacacattagtgatgtttgcacaaatcaggacctgtactgggcactcttatgtgtttagttttggggtggggtgtggggagtgtggtttgtgtgtctgtgtctgtgtttatctttgtgtgtacttggtatgtgagtgtgtgtctgtgtgtggtgtatgggtatatgtgtatagacatgtatgtagctatatatgtgtgtggctgtggtatgtggctatatgtggtatgagtgtgtatgtagtatgtatgtgtgtggtgtgataatgtatggctgtgtgtggtgtgtaggtgtatagctgttgtgtgtggtatgagaatgtgaccgagtatgtcaggtatgtgagtatgaccgtgttacgtgagaatatggctttgtgtatggtgtgactgtgtctgtgtgattctgcttgcttgtgtgcatgcatgcgtgtgtgggcggggggtgtgggtggggctttgtatggtgtttgagaatgtagtggagggcactgactgatcagaagaaacacagcccaggccccacagtaggtcctggaggtcccaggtattaacccagatgtttacttgctagattctggtgtgggctggagaggggtagagtggcagaaatctcaagaaaagccaaagctgggccttgtcacctaggaaagcctcaagatttagaggttttgttttgttcattttgaaagcaggcatataggtagatacttgtaaggaaggtttttcaaaaaggattaaacataaaaagagttacagttaacttacagttaggcagaaaaattgaacttatcccaaaatgaaagctcttttacttgcccatgaattatagtctggattgtcattgcttagtggtttcaagaagagtgacattattcaaatggcacaaatatcatctggtggtggtggacaaagccggtgccttctttttgctctggtgggtagctttaaatatctctgaaagtttgtcacttaaaaggtagcaagtaaaggtattctatccaagtattccagttgattgaggttatttctaatggatggtcccatggggaaggtgtatacccttcaaactgaacaaaagattccctgtgatctggcccaacccaaagaataaaggtgttggccatttgtgttcattctcagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaggacccgtgtacttatttggggaagtggggagctggggagattgtcccactgaacccactctggaagggatttgaattctaagaaagacagatgggtagatgctctgaaaagcaaaggaaagcagactgagtttctggggcctttgaggagaagggggaaaggaaaggaactaacattaattgagcatccactacatgcgattaattctgtcagtcacatttacattcattatctcatgtagttctcacagcaactctcaaaggaataagaagaggacatgaaagtgagggaagataaagtcacttgctgtgaagtcatacagcaagtacgttgtggagcagagttcaaacttgggcctccctgactgccagctgttgctcttttcactacatttaccttttggcttctgaaggaggagccacttaggagacttgcctggagttaggagccagtgtggcctcttcatatggccttgggccatttgctctatggcaagtcagtgccaagcatgagaacgttttcaactttattttattttgaggtcaactttattttattttgagacaggatcttgctctgtcgcccaggctggagtgcagtggtgtgatcacagctcactgcagccttgatctcctgggctcaagtaatcctcccacctcagtgtatggagtagctgggactgcaggtgcacaccaccacacctggcctcaatgttattgattgagcacttactctgtgccaaggaaaaacggcagtgacggggagtacagggtgaagggtgggataaggtgagagaaatcttaaaacccataatgagagtctttgcttttagtagcaatagtttagtcctcaaggctggaacagcttagcagggattatgtctggtttcctgtcctcctggtttaggcctggctccacatggcagatttcagtgttttctacatggaagtttagtgttcacccagttttcctctaacaaatacaaaagaacccttcctctaacaaatacaaaagacccctatctacctctcttgtgaatctggggccctactcttccagagtgaggggccctcttcatttgtagccagttggcagagtgtgattctggcaccgggcttggaactgacatcacccataaccttacctaacatggggaccctgccgttcaccagtaagagatgtgccaggaactttacactcattattgaattctcacagcaactaagagtgacttgcatttgccgtatgtagaaataggctgataaagaaagggacttgcccaaggttacagagcaagtaaatgcggggtgtaggacctgaactactgcccaaattcaagtcctgtattttatccaactataaaagacttcccaaatgattcatttatatttatagggtactttactgtttaccaagcacttttatttcatacacattttctgattccttgaaaatctccacacaatatattttaaacatagtcacccaaacttgtgtgtgtgagttggcacacaccctaataataaaaatcaccatcttttaaatacctactaagtgccaattattgtacaactcttatctctagtcttcatactatcctgtaaggtagtaatgtccccatgttcaaggcaagaaaattctgtgagattaaataaccagacctattggcagagtggagacttaattcaggtatgtctgatcccaaggtcaagctcttcattatacccactatcaagctaggtctacagatcccctctcagtctgggaagcttagtctgactccttcctgacttggagactttgtgacaaccactgtgatttttttttttttttttttttttttttgagacagagtttcattcttgttgcccaggatagaatgcaacggcgggatctcggctcactgcaacctccacctcccaggttcaaacgattctcctgcctcagcctcccgagtagctgggattacaggcatgtgccaccatgctcggctaattttgtatttttagtagagacggggtttctctatgttggacaggctggtctcaaactcccgacctcaggtgatccacccgtctcggccttccaaagtgctgggattacaggcgtgagccactgtgctgagccccactgtgacttttataattatgagtgtctgctgccagttgggcctacgaccaatgtaccaggctcctgctttgatcttggaacaaagctccccagccaatctcacttgtctctctctcttttttttttttttttttttgtgagatggagtctctgttgcccaggctggagtgcagtggcgcgatcttggctcacggcaacctctgcctcccgggttcaagcagttctcctacctcagcctcccgagtagctgggattacaggcatgtgccacaacgcccggctaatttttgtatttttactagagatggggttttgccatgttggccaggctggtcctgacctcaggtgatccgcttgcctcagcctcccaaagtgctgggat

SEQ ID NO: 271 - DNA, 57660 bp, Homo sapiens
aaatcaaggtgtcagcctgggctggattcttatctggaagcttggggtcatcttccaagctcaagtggttgttggcagaattctttgtcttgaagttgtacaactcgtgatgacttgcatcttcaaggtcagcagaagagagtctctatgattcagagaaggcctaagccctcttttaaagaatgtccaactgattaagtcaggcccaccctggataattttccatttgattccttaaagctgactgatttgggaccttaatcacatttgcaaaactccttcaattttgccataaaacctaacataatcagggagtgacatcgatcacctttgtcaaataacataaccgaagaatcatggtgtaacaccacagggctgagattataggcacctgttgagcaagacaagagtcagagaaatccagctttagatcttagctctcccactttctagccatgtaattgcacaagtgacttaacctctccatgcctcagtactttcaactgtaaactggagatcattctagcaacgtgctagcattctaacacctaccagtttgggctggctttggaattaagattatacttacaagaggtctaacagtgtgactgacaaatagcaagtggtcaataggcatcagatatttcattagatattcattttcatgcatacatatattttattcataaaacagaaaaataatatgaaccggaatacatgtcactgggtctccaagaaagcaagacaaaaaaggcgaaattagaatgcaaactgtctcatttcatattacttttgtggtaagaacaagctagttcaataagtggcactttaacacaaagtgagatactgtaaaagcatgtgcattcaataactctcagttgaatttaaatctggacagaagtacttgcttctaaattgttagtggattcattgacttattttcctaggctcaaatcatttatttaaccaaattattcctttccctttagtgttacccacagaagtattttcacataacaaacattagtttgcccaggcggcccctcccttcttccccactctaagataaagtctgttaatatgaaaccaataaagtcaacgtggaagtacacttgccaaagatcttgataaagtgctgtgtagcaaatggacaaatatgaataacaaatccaggacctgcagtttctgtactgaaaagtagttctgatccacctcctagtttcaagttaaaagcctgcactaagctcttcttctatgaaagggaggaggaaaaaacaaacacaaaccccccaaacaagaaatccctccccaaaacactgctctaaatttgctcatgtccttggaagtaaaaagaaacaatttcccctgattacagatttcctgatacgcagagaatgcacaaccccaagttgcctcgtgctcacaacaatggggcagacagaaatgcacacagagcaggcttttgtcctctcggttattgtcatcttattccccagaatggcttcttgcctggtgatgggcagagggcctgattgctgagaaactctcttcagagggactggtgtgtggctgtgggtggtgtttggggacactgggaaaggaaaattcctgggagcaggggctgtacagtagctgcagtaactcagttgccctggaattcctgaaaaggctggggctttgggctctcttctatttctatcagagtgaataaaagagctagttattctaaagctttatggaaaaggcaagataaagaggggggagagagggtgagagagagagaactgcatcaatatacagcaacattctgagtctcattgtcaagtattggcaaactatcctaagtgacatatccagatgtggctcaatttctcatagaaatttttttagagggcagtaggaaccaagagactatggggtaggtagatcatgtcttgccttgcctgaggatccctgtatataatctatttttatcattaaataataatagaaaatagaatcgtagaggcaaccatccagaagtttccaaacatccaagtgtttgacattatggaaatatatagatacagactttctgggctttacatgggcttgttatctatccttatttttatttatttgtttatttataggtatttacatggagagggtgggataggtgcatcatgaaccaacttaattcattcaacactcatttatgaagcatctattgtgtgtaggatactgtgaatgtcacacaaacgaaacacaggagccctctggctttatttgcaatcctatcccagagactataaagcttggaagaagcatcattcaaagccatattgacatccatccacatcactcagcttctggaaaagtgggtcaaaaatattcaatgagttacccaattctcgaagagaacaagagtgagatagaattcgttggtaattcaatagatttcgttaactcaatttccagtttaccaacagccaaaccaaaggcttctaaaaggagtaagtcagctctctgacctactctgatcatttctgtgtcttttggaggaaaaaacaaccagcccaactgctcttagtaaggaaaactgcaacccgccagtcagatgcagatttcacctctgaaccgagtgtttggtttcacctacacacttcctgccgggtgctttgctcattcaacgttcaacagctgtatctttcccaattcgattcatctcactttctttttggtcatcagtggcaaaacagtataaaatacctttattactatctgacgctcagcgttatacccaagatttatctttttaaaagccaagagaccattgcatttatcaaaaggagagtagtgggtgccactgggggctcatattgccagtggatattgtgaattacattaagaagatctgagaacaaatgtcttctgatatcaccttctcatatttgattaccactatttcatgagtgccttttattttccttctaaacatttgtggcattgtttttttttttaagcaacagccaacctaatatatattatttgtgccacgtgtggtattattgctaagacactctatgcgggttctggtgcaattttagtcttatatttctgagttgttagagccatttaagtagcttgcctatgggggaatccttaaaacagctctgaataccttagagaggtacattttaagtaaggctgcatcatcattttggctatgagagttcctgggatgtgggggaaaggatgttaaatcagaaccctcacattatttaaatgttttcatgaaggatataatcaagtgtgcctcttgattctatttgaagatgtgccaagcggcaggggccctcttgacaaaagcggccaggaagtgactttttactccccagcgacagcattttcaaattgctcttttctgctcaataaaggctaaaaaggaagtgaaaccttttgtcatattctgcaccactgattttttccagacgagcagaaatgcctgcctgtatatccttctaaggactggctaagaaagggtggaaaataacaggcaagaaatgtatctgtttgagtgtctgttctttggtttggctatgaagtaaaacccaaaaacgacattgaatttggcattggaaactgcagtgccattgttgctttgggactggcttaacaagcccacaatattctagaagcatgtgcccgtcccaggagccgactcagccatttctcaaacatgaagaggactgggccgtgcagtcctgtttcctcttcctgatctttgtagtagttacaagctgaacagaaacatgcaaataaaaatcgagaaccctaaagagtaagaaaatcatttccagaaagactgataataaatttcaagccatcagctcaaatatcactgatttaagtgcatttgttccagctcttttatagaatgtgaggttaaatacacaaacttgatattagagttgtccctgtactaattcccgcatgcgattcttttaaaaagaaaaataaaatagaatgatttttaaaaatctcatctagaatgagaaaacataaagtgcttttggctttcctttccctgattttgaagggcttttttttccgcttttcctttacttccctaccttaaagatgtttaaatttaagccaggtgtgagctctgagagagatcgaagctgcattttatttacctttgtagctcagacaaccagaaatggtagcgttagtatttgtggaatgagtcttcacctgacttatcctgaagggatgcatcttctacttaggataatgttagatttgaattttacaagatcctgagtcagtagtctgtcatccaggctgcagtgcagtggcacaatcatggctcactgcagcctggacctcccaggctcaagtgatcctcctacctcagcctcccaagtagctgggactatacgtgtgcaccaccatgctcggctaatttttacattttttgtagagaacaggtctcactacgttgctcagactgatctggaacccctggcttcaagtgaccctctcacctcagcctcccaaagcgctgggattacaggtatgagccactgcaccccaccattatcattattttagagtgtactcctacatatagatataaagttaagtgtaaaacagcctcacgcaggtccttcaggaggtatccagaagaaggcattgttatcataggagatgacagctccatgcctgttacttcccctgaggaccttccagtgggacaagctgtggaggtggaagacagtgagattgacaatcctgagcctgtgtaggcctaggctaatgtctgtgtttgtgtaaaaacacacacaaaaataaaataaaaagtttgaaaatagaaaaaagtttacagaataaggatataaagaaagaaaacatttctgtacagctgtacaatgtatattttaagctgttattacaaaagagtcaaaaagctaaaaaaattcgaaggtgtataaagtaaaaacgttacagtaagctaaggttaatttattattgaagaaagaaaaatattttaaacataaatttaatgtagcctaagtgtacagtgtttataaagtctactgtagtatacagtcatgccctgtgccttcacattcactcaccactcactgactcacccagagcaacttccagttttgcaagctccatttgtggtaagtgccctatacaggtgaaccattttttatcttttataccatatatttactatactttttctatgtttagatatacaaatactcaccattgtattacagttgcctacagtattcagtacaggaacatgctatacaggtttgtagactaggagcaataggttataccatctagactaggtgtgcaggaggctacaccaactaggtgtgtgtaagtacctctatgatcgaacaatgatgaaatcaccaaacgatgcattgctcagaacatagccccattgttaagtgatgtgtgactataattacactactgggattacatttgggagaagtaaggtcttcctttctctttttatgagttggaagatgtattgagaaaatctgccttcagctgctatagtggtgaggtggtggtagttctctcttgcttcctgttaatcatttacatttatatggcctattacaacaaaacatttcaaagaacctcataaacgtgaggattgattcaattaaactgtacttctggtctctgggatgaatatgacaatgttttgttcatctcagaactggaaaattaaggcccagaagttgtaaagatatttctcattccaaattctgcatatatatatattatatgaataaataattcaagagagtgaggaaaaatcatatttttttctcctttgagctggaaacaaaaaccctttgtacagattttgatgattcttacttcctccaaaccttagctttattcatatgttctgcaaactaaaccaccattatgaaaccaactgaaactgtgatcacaggaggccataaataaattagctaaagaattaaaatcctcctggtcagggattaagccttttatgatctttctcctctatgaaaataccttaatctctcctcctctgaattttccatttatattgcttatatcaacggttcttaattttaaaaacgtgacccctcttcttgcactctgaatttttatgtcctcgcaaaagatatcataattcttttttagaaattacaactgtatctaataggaaagctaaggaatggcattcatgtgatttttttttcttttcttttgaggcagagtcttgctctgttgcccaggctggaatacagtgttgcgatctcagctcactgcaatctccgtcccccgagttcaagcggttctcctgcctcagcctcctgagcagctgggattataggcacctgccaccacgcccagctgatttttgtatttttattagagacagggtttcaccatgatggacaggatggcctcgaactcttgatcttaagtgatccgcccgcctcggccgcccaaagtgctgggattacaggcgtgagccattgtgcctggccgggaaaaatacatttttgatatcgaatatctcagtcccttttataactctgtaagccccggggagtctgaaatgcacaagcaaaaatctctggctgatttcagtcagccatttgggggcttatttgctttgttttctaattgcttctcaacatttagtttgagaggatagaaattaggccatttttttcatctgttataggactggccacacagtagtgcttcagaaactagttgctcatttattgcttggtccattctcttgattttcttttgcctgggaggaaacactgcactgacctttcaaccaaatatttgggtgctgcaatttttttttttttttttttgagacggagtctcgctctattgcccaggctggagtgcagtggcgcgatcttggctcaccacaacctctgcctgctgggttcaagcaattctcctgcctcagcctcccgagtagctgggactacaggtatgtgccactatgcccgactaagtttttgtatttttagtagagacggggtttcaccatgctggccaggctggtcttgaactcctgaccttgtgatccacccgactcagcctcccaaagtgctgggattacaggcttgagccaccacgcccagccgcaggctgttgcaataattttttttttttttttttttttttttttgcgacggagtctcgctctgtcacccaggctggagtgcagtggcgcgatctcagctcactgcaaactccgcctcccaagttcaagcaattctcctgcctcagcctcctgagtagctgggattgcaggcgcccgccaccacgcccagctaatttttgtatttttagtagagacagggtttcaccatgttggtcaggctggtcttgaacccctgacctcgtgatccaccgacctcggcctcccaaagtgctgggattacaggcatgagctatcacgcccagctgcaatattttaaatatattttagtataaagtgaagggcctctgacgtccatctagtaagaatcgggccacatattcatagactgacagtttcaatctttgcagactttgtcctttgaagtttgctttgctttctcttttcacactttggtagcatctttcagttctctgctgctccagagaggaacattatggcctcttgattggatggataaagggtccagccctgacccattggctgctagaagggccaggggcaaaaagatgaccccattaaccaccttttccacctgtacttcagtcttacttgcaaattgttttttctcatgtcttttcatcatagtctatacaatcatcttgtcaacaagttatcgtaaaaattgttgaaaaggatctattaattctcagcccagaggctgtcctttggatttctttgtgactattgctttggtcttacatgtggctgatatcagcttgttttgaaaatccaaacactagtccacattttcacctagtaaagtcattgatgccttctttgtggccagttataaggagctttttcatctaattcatgatgacccaggaaccttacctccatgacaaaaatgttcctggaactcagcttcccaacgtcatctctacttcagttctttaggttgccagatgttgaagataaatcactttaactgtggttgcatagaattggttgggaatcacatgagtttcttcatgtaaaaactaccaagacctctgctttgggtctagatcctggtttatgctgccttcttcaaaactaaggggagatgctgggacttgctgttagctccatttttttttttaattgcatgattctctgactttgctgaggagttgtagatccaagttcaaacatacattggcaactacacccaaatgcagccaagatacaagggtctacatgtgatacagggtctaattagccatgtgactttggacaggtcattctctctggctttgattttctcatttgtaaaatgatgtattaaattggggcaaaagtaattgcagtttttgccattaaaagtaatgaattcggttcttcctaataattgaattaggttctttccaggcccttttctggttctttccatttctaaaggtctatgatgaataggccaaccatgtcatcatgggttccagcgcagcaccctagagccccacacctcattcctggcaggcacgcacatctccaaatagggctccttagtttttaaagaagggaaaacggataaggagaactgaaacccacatactttcagttctgactttgtgagttttgaatttaaatgctttctcatatgaaacagtgagtgggcagaagcattctacaagaagagagccctgaagttagatgagcaatgagcaatccctttctgttggtgattctcttttgaaacaaaacgcatcactgctcaaagctcaactgccaaaaaaaagaaagaaagaaagagggagagagagagagagagagaaagaaagaaagaaagaaagaaaagaaagaaagagagagaaagaaaagctaagagtaaggagaaaaaagaaaaagagagagagaacccaccaccctgtgcgaacagcacagctgaacaaagggaaatagaaggtagtggcatgtgaatccacgtggccctttgccaacccacttgcctctcacgctgccacacttgcatatatcagggtaatttctgggatggaggtttttactgagcacttgttggcagagagattttctcccagtctcatgacgttcacaaaaagctagtactgagaggaaaaaactgctgggacttacatgtaatagcatcttccaagcagctctataagatgactaacatttcagctggacacgagacaaaacttggcaccagaaatggtggatgatggtgcaccaccactgcttcatgcagcccactatcgaggcaagggggtctgagcacattgcctgcaaataatatgtttgcaacttttcaattcatttgagtcctgacttaaaaaaaagcgtgccaggcaaatgatcatctgcatgacttttcagaaggttttgccctgctagcccttaaatgatatgtgaaaacaaatcagggagttggggccatctgaaatgtagcttgagagggtaagagaagatggagagacatgctaagggtttaaataggaggaaccaatgaggaaaagcacatgacactattatagtggaattttgcctttttttggccattcctgtatttccatagttgtaaccatttgttacaagctattcctctgattttttttttttttgcatcttataaaagtgaggagtctataaaagacaacattttgtaggcctgcagcctttgcatctagtttttggaaataagttgttacttatctgcctatgaatgccttctcccagctttcctcgaattttttgagggatgaggaaaaattagtttccttttaaaatacggaacccctggagaacatttgtttctcagagaatgataaacaaggaaaggggatgtgatgcatacagcaaatttaaaaacattatcaggctggatgcagtggctcatgaagcttgcattttagtgcaaaaaaacaaataaatatataatgtggcaagtgtattgctaagcattttagagaaaagtgaaataggataaaaggattagagaagaaatgggagggtggagggtccatgctatgttgtaggtcatgattgtaaataccattaagtctagtttccattctccctctgtgcagatgaagaaactgaggcactaaaggaagacatgactgcccagggtctcccagctggctaggcacccactgggaatgaaacccagctctcctgacccaagacaagccctcttttctcccatctcgacacccgcacttggaaatgggttgctgcagtaggaatttgaagtctagcattttttccccttgcaatcaattgatactgattttcttatgagtacaaaatgaattgtccaacaccattcgcatatcagcttgtggcagcagtaatagtcactaacatttagaaaggggtggcatggaattcacctagagttgactccccactgtgtggtcagttcatgagcatctgccctgtgctcagcacctttcacactgatgtgacaaattcaggatgcatctccaactttaatatgtacatgagtcacctgggaatcttgttaaagtgcggattctgattcaagaggtctaggtgggacctgagactctaataagctcccaggtgatcctggggttgccagttcacagaccacattttgggtattgaaagtctaggtacctctgctagtttgctgaatgcaactgagaaagaaacctcagggttaatgcttgcatttttctgtcttcatttctccattgtcctactctcctcccttggaaggctccagcttagaaaaagaaaacattatgaaatagcagtgccaaacctgaattacaatgttaggcatgtaattatctgggcaaaagccagatgtctcagactagggtttagtacagcttgccagggctgggtaaagttcctagattgaagacacagttgagactacatgacatatgcaagagaaaaggggtacctgtgcctgaaactctgggaggtgagaagtggacaagggttactgctgcataagtaattgaggaagcttctccttccccaccagactgcaaactgagatgtttgcatattaatcttggccacaggggtgactcggtctgtgtctgcaaatgaaaggtttcatccttggctgtgaaataaaaatagcaaatagcatgtggcatgcaggggcttttcctctataaggggctgtcactgtccactgtttaaagcctctgcttgagccatcttcaaggaaggagggttgtgaatgagtgggggcagattgcagagccagttcgtagacagcagagatgctccagggaaaacctcccttctcttgctgtttacatttgcacatacttaccagtttgccagaacttcttggtgtcaacaactttgactgagactgcgccacgtgaatgtatctcctggggactcagaagatagctcaggaggtaaaggcaaggcccccgcactgtgatctgactgagcttaggagaattgggctcctcaaatctttttgcaaactcagtttcttctcagaggaaaatggtaacagtgacaataagaaaaaaataaaaccgtatctctaaagtggaaaaggctataacagttcccattactcttctggagggaaaaccagttccagtgggcctagggttccacagctatgtagggcttctttacaactgaagactttagaccatttggtttgtattcagtaggaccaggtggaagatgtgaggatgggatggtgaatgggaggtagatatctgactttagatttctaggcatttgccaaaatattcctcctccagtcaagacttgttgccatcggtgaaaatggttagtcaccttataacagttgtgatcttcctaaatgcgctcagcaaaggcaaatggaatgttctggattaccaaccaatggcccagaaggttgtacatcacactgggaattgttgctggtctcttttgttcgaagttgaactagagaggtggcaagcagaggtggaacactctcatcagttactagaaagatttcccaccacccagataagccataaaccatctgagggaaagaaagactaattccctcagccaatatcagctctagctcgataataattcccatcttggagatgggaatagggaaggcaaatgccctcttcttcaacaagtctcagagcttactgtagtgtctcaaggataaggctcctatgacccaagagctgctgggcaacctgtgtgtgtctcagcagagtcgagggtttggaggactgcctggggcaacccagctgtcactggctggcccagggtttctgtatgaggccatgatcttggcttggcaaacagcaagggagattccaggaaaacaaagaaaaaaaaatccttttcacttttaattcaagtggcccttcttgctgccactttgaatggctaagacatttgtacttttttttttctttttttttgagacggtgtctcactctgtcgcctaggctggagtccagtagcacattctcggctcactgcaagctccgcctcccgggttcacgccattctcctgcctcagcctccccagcagctgagactacaggcacccgccaccacgcctggctaatttttttgtatttttagtagagacagggtttcaccgtgttagccagggtggtctccatctcctgacctcgtgatctgcctgcctcagcctcccaaagtgctgggattcaggcgtgagccaccgcgccctgccggcaacatttgtactttttagtggcccccacttccagacgtggagtatacaagtggatgcccactgatggggccactctgtagctctccggagtgagtcaaccccaggatattggaggagcagggaggggcagagaaaagcttaattcatttttcttattgtacgactcatcttaaaacattgcaatttctttcaagcaaaatagcaagccttttttgtttgaataaacattttactttgggataattttaaatttgcagaaaagttgcaaagatagtacaaagaattgccatatacccagcttctgccaatggtaacgtcttacatttctaccgtacatttgtcaaaactaagaaactgacacaggtgcaatactattacctaaactccagacttaatttcagttttgccagtttgctatttaatgtgctttttctattccaagagacaatccaggggaccatattgcattgagtaacatgctcttttctaacaaatctctgcttgagctaatctagctgatcttttaaccaacctaactgagcacctgttctgtacagggccctggctaagccaagtgggagggataaataagtcctgacatagttcgctgtctacttggagaggctgatgcataaataacactgtaagatgcatgtaatcagagtggtttgcaaacagtgccccaagattgtggaggacaggcatagttctctccacctggggcctcactggggccacatttgctatgagtccaggagaatcagaagggcgttcctagatagggaagtgagctggagagggaaatctgggaaggtgatacagagttccacccaatttgactttgataggaaagggaaagtactgcagggtactgagctgactatttaagatgtggacgcttagaactaggaaatgtcctggtttctaaaaacaatgaagagaagtactctaatactgggaaaaatgtgtgagcatgttagttgggggggcttttcaactggggctcattaggaagaaaccccagcgatctttctttcattatgtggcagctagttgaactatttgattttacagcaaagaactcacaaaaagagggcctttgttcccaggttgaaagcacaagaaaataccaaaaacttgaatcataccagcatccaggtagaaaatcattcatatcatttgccagttgttaattttgttggtggcgatcatctatgctcttccctcaccctaggggtgctgaccctcatcttaggagaggctcgacttgtagagcgaggactcatttcccccacccaagccaaacaggtgcaggggaatggagcagtttgacaccagccgcagctctgtcctaggagaagatcatgatgtgacctggggataaagactgaaaacaaagctcaaagcagtgctctctaaaagcagggtgtcccttgatgtctgaagaaatgacaatgttgacctataggcttctaggtaaggttccaaaaatgtaccctcagggtccatcttccatactcaaagcttaacttcagttcccccacaaagatttgctttctcgacgcaaagaaggccaagatgtaggatccatgctcttctaatgtggtcttctacaaaattctcaatgggcccacactccccagcaatcccagacttatgagtccatattccagctgtttagctcaagggctcacaaggcaggtgggtttcacttaaaggcaaaagaagaggacaagagtcgtgggggtagctccccacaggtgagggctggcggttgagaaggcaggagaaagtgtcagtttcatggctgacgggaatccagtgtgacttcaatagctgaattgaggccgggcgcggtggctcgtgcctgtaaccccaaccctttgggaggccgaggcaagaggatcatttgagcccaggagttcaaaaccagcctgggtaatgtagtgagacttcgtctttacaaaaaataatgataataataataataacaacttgagtgagccttcatctttctgagcctcagattttccatctgtagatgagaatcttatcacctgccctgcctatcttgcaaggttccagtaagaattcgaaaaacaaatgaatgcagaatacattgcctggtataataatactcaataaagggcagctattgttcatattacttcatgtataataaaaaagttatttcttataattgaattcctagtaaatatgagagtctccctgcagtaaagaagagaacaaactttatgctactagaaaaaatatgtggctatttgcctattgtggtggagagaattatcactctccaattcaggacagggtccacgtcctgtacgtcacatgggaaaggggaatttaggtggcagatggaattaaggttgctaagcagatgactttaaaatagggtgactatcctgaagttttgggatggacttaatgtaatcacaagagtccttaaaagcaaaaaaggaagatgggactatgcaagggaggaccagcgggatggcagcctgagaaggacttggccgggcactgctggctttgaagatagagggagggagtcctaagccaaggaatgtagaaacctctagaagctggagaaggtgaggaaatggattctcaccaagagcctacagacaggaatgcagtcccgccgacaccttgctcttagtccagtaagattcatgtcagacttccgatctacaaaactgtaagataaaaagcatgtgtgggctgggcgcagtggctcacgcctgtaatctcagcactgtgggaggccaaggtgggcagatcatcagaggtcgggagttcaagaccagcctgaccaacatggtgaaaccccatctctactaaaaatgcaaaattagcctggcgtggtggcgcatccctgtagtcccagctacttgggaggctgaggcaggagaattgcttgaacccggaagttggaggttgcagtgagctgagatcacgccactgcactccagcctggacaacaagagcgaaactctgtctcaaaaaaaaacaacaaaaagaaacgtgtggccatggacacaaacaagggaacaatagacactggggcctattcgagagtggagggtgcgggggagtgaggattgaaaaactacctatggctactatgctgattacctgggtgacaaaataatctgcacaccaaacccctgcaacatgtagtttatctataggacaaacctgcacatgtatccctgaacctaaaataaaagtttaaaaaatgtgtgtgttgttttaagccacttcgtttgtgatcattggttacagcagcaatagaaaacggacacacctgtcaacagaaattctggagtaatggcacattcttggatgtaggaatgatatgttattagctgcacagttttttggaaactcctttactcctcttctcatgatgaattagtcacagatgaattagtatttttccccccatttatctggcatggattgtagttgctgaactaaggcagctatttacagcgctcttcttatacctccgactatgtttgcagaaacttacatacaaaatactgttgcctgattcaggctgcctggtttggttttgaacagggtgtgtcaaggtacattcaaagagaaactctgactcaagggcaaagtgatgttgatagagtccaactcaaaatatttagagaaaaagatgggtatagtcagacagtgggctttctcccttgtgttttcaaggttttcctgagaacaacagacatattgtggctttccccttagcttactattaacatgaagcgagaggtcaatgacactgtctggctcctcaaaggagctaagagaagggaagaaaaatccaaattcccaggtaaacatctgtaaaaggatttggaactaaggataaggaagttccgaggcttactgaaagggaagggaaggcagcattatttactggccatggatcgtacttcctgttgtgaagctcagcactgtttcataacagctgggggctgctgtctcttctgctgtaatgaggaagcagcgttcttggttcctccatattacacaagttaatgacctctactgcacggtgaaattggcatagggagaagaatgggacgcttgcccctgtaaatacaataaagctttttttaaaaaaattgtgggaatatcttttcatagataatgttattgagtatgtcacatgtcctttacccctctgtaggctcttgacttgtctggagattaaaacaggttaaagagataagtactcaccagggactgccccttagcatgcatttgttgtcactacacagccaggggctacaaaaaccagcatagtcctttaaaaaaggaattcggttcgtgtccttcttatcatataattttgctacaaaccccacaaaaactgtttttgcagcaaatttgcctggaaggtcggccagggaattgtgaaacaacatttttaccttgacaggagacatgataacttgcccttatccttctgcagataagtcatactgtggctaggttcacacatgtgagatacagtgaaaaactgaagagacttcttggatatctcattggataaatgctcaaaaatctagattttttttggcaaaaaggtctttcaggttagcagacagaggttggctttccttatcacaccgtgtgagttcaaattcagattgggctattaacaaactgtgtggccttgactaagttaattaacatctctgtgcttcagtgttctcaactttaacggagagagtagtaatacatatgccatattcttggtgtgagaattaagtaaggcaacatatgaagcccacagaacagtgcctgatactataaaatgctccatcaatgttagctattttaattagacagaatggatgtaaattcgtgattgaggaatagaaggtacagaaacagatgagtcatcaaagggaaggaatgcttgaaagcccaggaaacactgcccacccgcatgtatgctatcatttgcacccagcattcagggttctcctgactgaagaagcttctcttcctgccttcttctctcctttccttgtttcccatgacaatccttctggaagtgtctgcaccagccacacaggtctccagggctttcctatcttcttcccctcagtctcacacattcacaaggtttttgttttttttaaaaaaaattattttaagtgactttagatatcttgcttgtgttataactttaaaaaatcttgggctgggcgcagtggctcacgcctgtactcccagcactttgggaggccaaggcgggtgaatcacgaggtcaggagttcaagaccagcctagccaacatggtgaaaccccgtctctgctaaaaatacaaaaattagctgggtgtggaggtgcacacctgtaatcccagctactctggaggctgaggcaggagaatagcttgaacccgggaggcagaggttgcagtgagccaagatcgtgccattgcactctagcctgggcgacagggtgagactccatctcaaaaaaaaaaaaaaaaaaaaaaatctggaccagaaacattgcatggttttacaaacttattccattttgtacttaggaaatatagactaaatcccaggttttcaatttccttaccattgtgccatactaaatattggggattctactcttctagcagtgcaaatctgtgctactctattcattctccatcattgcttaagcttccaggtttggtttcttatctctccattagattctaagcattccagggcagggatcaaatgtaagctttgtattctcaaaggtatctcaagttcaaatctcaagtctgacactggtgagaatcttcagtaaatatctaatgacttttgcattgcttcagtgattaaatggctataaaaggcagattgtttccctcctactgaaggcactgtggataggtgcacccatatcgaatggcccctcactattgtgagtgctggctgttttcatcacagtgggtggcattctaggctctttccccaggcttggagtctctctcaatgccatgatcttagcattctgcccgttgaccacactggaagtgaaactacatgcttatttctcatggtgggacacagtgcacaaggaagtaaaaaaaaaaaaaaaaaagggaaaaagagaacagacctactttgttccccttaatctcaggattggtgaattactgagtttggggcaggctttagaggctggtaaatgacatgacattgcctcctttgtggctactgagttccttttgcggggggatggaagacagtttcaaagttttaactttgatcatcttacctgggaaatgtaagaaaggcaggaccctcacctgttatgatggagtgcagggcccaggcaggggacactgcagggacttgtggtggcaactagtgcattatcttcttgtgtcttcatttcttctggatgaagttcatgccgaagacttcttaggaaacccattcgttaaggggaaggtactccattgcctcacttagttacatattatcctggcctttcacagcctggattaaagtctgaggcctctctaatgcaagctcatggtaggatagaatatcactcttgtcaggccattcatattgactggtctttgacatactccggatactctgaaaatactgctctgcagttgtcagcattttaaagggggaaaaccatggttaaaacaaactaaatatggcctgagaagaactccatacttctatatttgagtccttgtggacaaactatagcctagcttaataggcagacaaaattgaaaacctaacttagtagtatgcacctgtaacaatagctaagtcttggccaatcccagtggccatacttcaaccattcatacaccgctgagtgttcaaactgtgttcaaataaggcatatgccgagctgtaaccagcccagtcgttctggacctcatttcccatttctgtacataatttccctttttttggtctataaatcttcttccatcacgtggctgcactgaagtctctgtgaatctgctgtgattctgggggccgcccgattcaggaattgttcattgctcaattaaatacctttacatttaatttggctaaagtttttcttttatcaccattgccaggcctccttggaacacctatctcccaccattcattgcctttcatggactaagtcaggtaccactttctgtttcagcctagaaaaagtatttcctcctcaaccttagagagaggaggctagacgagatggcaagtaccttccagtcccaacatcctaagcatctcctttctcttggtgtgaagtgatatagggaaaagaaagtaggagttggagtcagatttggattccaaaggcagtattcctgcttcctggctgtatagagttaagtgagtccatttcttcaaggctcaattttctcatctctaaaatgggaatgacgatactagtctcaaagtgctgttgggagcactactgacgtcctgcttgcaaagcatctagtacaatgcctggcccacagtaagcattgaatgcatttagctattattattattattattaatagaactgtgtaaataacattagtatcttttatgggactaaaaaacaaaacaaaaaaagaactggtcaggtgaatcctcacatgttatgttaaaactctagggaccaggccagatgtggtggcacatgcctgtaatcccagcactttgggaggccgaggtgggaggatcttttgagcccaagagtttaagaccagcctggtcaacatagcaaagccacatctccactaaaaaaaaaaaaaaaaaaaaaaaattctgcctggtgtggtggtgtacacctgtggtgccagctactcgggaggctgacgtgggaggatcgctcaagcctgagggggccaaggctgcagtgagccgtgatcatgctactgcactcagccggggttacagagtgagaccttgtctcaaaataaaataaacagacaaaaaacaaaattataggaaataataaatgccagtctttctccttcatttcagggcccaaatcacatcttgctgttgttgtatgactattttctttttggtcttctttctactatatttaacttttgcatgtattccagagtatctgacaaagtgcagtatgcatggtagtgtattacaaaacatctaagatatagaattgatcatctgtttcttagctggccagtctatcatggcaaataataatgaacttctaccattctgaccagtgctcagagtgatttgataaagcagagatggactggaattgttcacaaccacacattcagcgacatccaagtttttcattggccatgctgaggagcaaagctatttaggggctggtgggaattggacctggatgaggacagaggttgggcataaataaacaggtccttcactctgtcactcaggctagagtgcagtggcgtgatctcagctcactgcaacctccacctcccaggtttaagcgactctcgtgcctcagcctcccaagtagctgggattacaggcatgtgccaccatacccggctaatttttgcattcttggtagacacggggtttcaacatgttggccaggctagtctcgaactcctgagctcaagtgatccgcccgccttggcctcccgaagtgctgggaccacaggcgtgagccactgggcccagcctcggtccctcttattgaccagctacttcagactaacactggccacacactgtatctcataatcctttcagtcatctttaaaatagagatttttgtcttccattttacaaatgaggaaactgacagccagagagattaagtaagcttctcagagtggagcgaggacttgcaacttcacagccgtgtgcttctctgcagtattgcctggatttagcaaagtgggatttaaggattgcttcctttgtctttacctgtacttaggaagtaggcttagttctctgaataatccacttcttggaccatcagacaactattttcacacatactttcatctttccctagcctccctgagtaggttaggtagttattctttgcgtgttttccaaaatggtaaggcttcaggtagactttcaaattgtaagagtcatttcaacagaattaaaatgttccacctaaagccttatacagacagtgctttgaatacgtctccaaaaagtatctgactgaatctaattttttttaatgtgcttttgcttaacttacattcagtaagcccaccccgtctcagacatttttacttctgaagatcactggggccgagcgcagtggctcacccctgtaatcccagcactttgggaagccaaggcagggggatcgcttgaggctaggagtttgagaccagcctgagccacatagtgagacccccatctctacaaaaaaaaaaaaaattaaaattgactgcttgtggcgacacatgcttatagttccagctacatgggaggctgaggtgtgaggatgaattgagcccaggagttcaaggctgcagtgagccatgatcacaccattgcactccagcctgggccacagagctgtctctctaaaaaataataataataaaaataaaaaagagagagagagaaatcagaaatagctccttatagcaaatacattcagaatttccccataaacatagactcccatgacaaccaaacaaaaagagacaaggaaggagaaactcactctcttaaagccaccagctgtaaatcctttctgctaaaagctgtaggatagtatagattctgtttaaatttttatttttatgactgatgtaaagaatgatcctttgtttaaaagccctttctactactctctctatgttatatctaaactggtacagagatattggtataaaatatctctccaatggataaattgattaattgacttgataagtttgacttaacgtgtatatgtcaaaaatcattttgagtatttccacacactttgggcttccaacgatctgcatcctttccccccactgagattctctatgctggcatgtttttctatggcacagtgagggagcagttgacacagtataggccaaacgacccatctatttctgttttctcccttaatttacaatatcactgattacacctaataattccattctaaaatacatttttacactaattttgctactcacaggtcctagaaacaccatcaccagggtatactatggattcaattttggggacataaacatgttcaaacgtctatgatgaaaaagaaaggtttactattacttgtcatcctcagttccatttgtcttattagaaccttgctgggcacagtggctcaaacctctaatcccagcactttgaaaggccaagacgggaggattgcctgaggccaggagtttgagaccagcctggacaacatagtgacactccgtctctacaaaaaataataataaaaaaaattagtcaggcatggtggcatgcacctgttctcccaacaactctggaggctgaaaagagaggatcactttaacccaggagtttgagcttgcagtgagctatgatcacaccactacattccagcctaggcaacagaacaagactctgtctcaaaaaaaaagaaagaaagaaaaaaaaatagaatccaacaatccccccacccaacattacgtttcctttttctgtaccctgggcaaagaatatcagaattttcatacacagtaaattctctatatgtgcttgtcactggggtagtttaaaaaccagtgctgtggggtacaggtttctctccacaaatcaccaccgaatcagcttctgacagatctgcagctagaatgactcttggccaatcctaggatgattcctttattcattagtggctttcaatgccttggggctactctttctgttatttgaggacaccatgcagcatgcagcggttttttattaactcactaattgtgccatttctttcactcttcgggtgatgttgtatgtgttctaatataagatatacaactcttcatcatttttccctgttcagataatctattctgcacgaggactccctgtaagaatattcatagtattcaactgtagtaagagaaagtttgaaataaactgaatagccaagtgaaaggacattggtcagataagttatggtaaacaaaatggaatgctaaacatcgattaaaatcagatgtttgctactacatactcattaaaaattttttttaaatgagatgtttgactgggtgcagtggctcaagcctataatcccaaaactttgggaggtcaaggtgggcagatcacttgaggccaggagttcgagaccagcttggccaacatgacaaaaccccatctctactaaaaatacaaaaaaaaaaattaggtgggcatggtggcacatgactgtaattccagctacttgggaagctgaggcacaagaatcacttgacctgggaggtagaggttgcagtgagccgagatcgcagcactgcactccagcctgggtgacagagcaagactctgtctcaaaaaaaaaaaaaaaaaaaaaaaaaaagagagagagatgtttgaagggtattttaagttatggaatgtttgcaatgctacagtgaatatccttgtactgaatcatgtacactgatgcaagaaattctgtaggatatatttccaggaatggaattgctcactcagaaagcttaactattttgcattttatatatattggtgagaaaaacttcaaaaagattgtacaaacttataatcacaaagcagtaaccgattggatgagattttttttaagagaccatttttaatccatccagtttagtctagcaacaagctggaatgctctaaaagaaactctaaaacactaatttgtcttttcactcaaatatgtatctttttctgaaaaaatgtctagtgaactatatataaaaatcattctataaagcatttcttttatgttactaaattaatcagtagaaaggacatgtattataaaaatatactgttgaaaacatgttttctcaacatcctaaaagcttcaggctgtatagacacaacccaactttgtgtctaaatgctgtgtcgttcatatgttccagccttggtttccttattcttaaaatgaggagttggaatctaaggtcggtttcagatgtaacgactccatgattttacaatacctcttatcaactgattgtagtaaccaagagaacttccttctctctcctaataatgactttttaaaaaaaaaattggagacagggtctcactctgtcacccaggttggagagcaattataagatcctaattcactgcagccttgacctcctggactcaagtgattctcctgtctcagcctcccgagtagctgggaccctgggtgcgccactatgcccggataatcttttactttttgtagacacaggatcccagtatgttgcccaggctggtctcgaattcctggactcaagtgaccctcccacctcggcctcccaaagcgctaggattacaggcttgagcactgcacccagccagaatgacatcgtttgtcataggttgtgtttagtccgcacaaaagcactttgaggtctcagtatcattgtgcccatcttacagagaggaaactaaggcacggaaaggtcagtaacttttctgagaccacagagcaaggcaggggtggcagaggagcaaaactgcaatccccgggggctgggacaacagagccacattctttctcttttcctccctttcttccctattgttaacagatggaagcaaatctcaaagtgaaccctacaaaaattttgacattgcattccatagcttagatagacaatgtttgtttctgtgatccaagggagaagattcttaaattatgttcaattgaatgtacacatccaaacgtggcttagcttctttatgtcttatgctgtaagagtctttttatgatttgttttgatttttatgttttttaaatttttctaggatatgtgcttgatagtactgaaacaaaggcagaaaagaatcctggggtaggggggtgagtgggagggaagtctctttaaggtcaaattgagttactgtctcttgcagatgaagatgaatatgctctctctcaccagacagattcttgtggcccacggagaaatctgagctagttcccttttcttgctaatgaagggtcatcactgaggagactgaaggggaatttttcaaaccaggtgagactaagtgtgcagggtaggctctcaacagatgttggcagctgcctttccctcaaggtcccacctcccccaccccagacttccagacacaggcagctcaggacattttcgtactttgtgccaggcaagagatgctcttcaaatctgtgacacgttggaaagttttttttttctttcaaatcacttggatgttccacatctccaaatagcaaggaaaaatgcttgatcttgcattttaaactttctttcttgttggtcttaattttctttatgtatttatttattttttagagacaaggtctccctctgttacccaggctggagggcagtggtgtgatcatggcttactgcagcctcaaactcttgggctcaaaggatcttcctgcctcaccctccaagtagctgggaccacagaggtgcaccaccatgcccaagacaaagagtctcaggctgagaggcagcaagtgcaaaggccctggcagggtgggagactgctcactgtgtcgcagggaaggagaggagacctacagtgactgatgggcggtcatggcgtgtgagcaatgaagaaggctgatgaggccccacccattggccttatatcactgggatctttttctcatgcaatgggcagctaatggaaggtttagagcaagggaatgaagggctctgatgattcataataataatagcatagtgtgactattatgatcattttagaactatcactcttctagcaggattaggaaagaggccctacaccaaaaacatagacagggagacccagtccaggaacaggtggagatgatggattagcaagggagggcagggactgaagagccgtgggtactgagtgcaccaagggcactgagagaaggcctgggctgctgattccatgctcttgtgttgctttgctttagtgttactgctgtcctgccctttggccaagggaaaagataagagtaatttgaaaggaaatatccctgggagaataacagcttgtttacctgaaacggataattccttggaacaggacttgccagctttcaaggattctaaaattatgaggccaatctgcactttaacctggacatgatcaggatgtactaaactgagaccggggaaccagccctggagttaagactcctattttcagttttgctttcgaccttccataaactgttccaattctcactcatctcctgataccatattattttgggcatcacatttccatgacttgactccctacacaaattctgctttgaagctttttctatgctgaagccacaatggatcaattcagtccaataacagctcagcggaagggaagggaagtcagtcaaagcagggatttggtgtcaagtaaacacaataataggcttttaactgaatgagtctttccctttttattttcacttttttatttttttatttttattattattattattttttttgagacggagtctcgctctttcgcccaggctggagtacagtagcgcaatctcggctcactgcaagctccgcctcccgggttcacgccattctcctgcctcagcctcctcagcagctgggactacaggcacacgccgccacgcccggctaatttttgtatttttagtagagacggggtttcactgtgttagccaggacggtctcgatctcctgaccttgtgatccgcccgcctcccaaagtgctgggattacaggcatgagccaccgcgcctggcgcgtctttccctttttagccaattattttgttgtgtagacagagcctcaaccagccccggtaccatttgtctcttcccaacgactcctccctattctccttcctggtagttctgtgggctccttcatgctggtttccatgccacaacctatctggaatcttggaattgcagaacttcagaggaaagagaagtctggagtatatctgaagtcatgacaaacaacttcctttccccatagctgataaagaatgggcctgcaggtcccatatgaagggaaggtgtgaacaccctgcatgataggaaacagtttacaatgccctggaggtccctatgattcactgagcagtgctggacaactagacaaaagcaaatatatccacccggttcagggggcttagccagctgtttaccacgccagcagttttcctgtttcacaccccatatccttaatatagggcattctcttaagggacctatcatgtcccttccagtacactcattgtcagtctttccttttttctcctcccttcactctttccacatttcatccaaattgttctcttttcctccccctccaggggagaacaggaggatggcctgtgcctgtttccagtcttaccatgagcacagccagttggtgtttacacatgaaacggaactaactgatctcctatgcatgtacatcagagggaagtacctgttttcctttgaattcaataggcagctaatgagttttccattccttctgatctcaacctgctgtcacgtccactagtgggtgatcttctttctgttgcaaaagaagactttctgaactcctatgtgggtggtcatttatgaaggttgattggtgtttgaaaataatttagaactctgtatgttcatatgtgtatgtgtgtatgtgtaaaaataaaacttgattggcatgacatcatgggtgctgggagtgggtctggtaaccagaataaaaagtggtcttctctgtcccttgtctagccacaattaggagagagtatggattgtcaggaaatggagcttgttccaccctctcactgtggcttaagaattttcttctcaacaatgaaaagatgcacagatcatagtacaggagataataagagtcactcttgctatcttcagcagatcatagttgtacaccattctataaaaatatgagagagagagagagagagagagagagagagagagagagaaagatctttgtaggaataaacatagaaagccattttatctacaaagccaattcaacctggactgcagtacttacaatcataaagttctagttaggttattagttagtggttgacaaccataaagtaccagttaggttattagttagtgattggagggatgcaaaagctgacttgaatacatgacttcaatcacttggacacatgtttaatttcctgtaagaaagctgcagaaaatcaatgacctaaatatctgaacttgggtatttccaaggaaaccaccagacttccccattgtcttagattaaatacaattaataaaatgcctaacagaccccagagttcttctgtgtaattagatcaatagcagtacaacatctgagatttacttctctctccaacaagaccctttaggcttggtaacacatccaagtggaagaggaaagaaagaaagaaaaacccaaaaccaaaagcacaaataaaactaccgctgaaattaagaagttaggatcttcccaaaggcaagcaactaaactcattctaccagtgagactgagtggaaccctctgctcagccattcctcagcattggacatggcttattcttgatgtttgtataaaatatgggttggtccacaggaaagacattcattttaaaaataagataaaaaatatgagttagcatcaataaaattctacgttttaagaaatgcaggttggtattatcagccctgatttgcagatagaaaaactggctgtgagatcatcagcaatcctgacgtctagaagatttcaaggccgggactcaaacctacgactctatagtgtagagcttatgctgtctccttaaatagtcatggcttcgctaggctcactagagggagatgatttcacatacaatatttaaaaagtaaggatgtaggggcaatgaaaatgtggcccaactatatcttaaaaggaagatagttcactggcatatcaggtcatgaaacaaccacgagtgtgaactaggaaaccacaatgcatgtgagaatggcccaaacacaattgactgcaccatctggagaaaaggtgaagcctacacagaatgccaagtagaaaaatgagatgggtttatgtcaagcgaagattaacatttcatgtatcttctcactttaagcacttcgtcctgcttctggtatatcccttcaccctgagctgaagcgagttcattagttaggtggaaaacaagaggaaagccagtggaaactgacactctttttagattgtaacccctacttggggcaaacctacaggatctcaatgacagaggtttgctttcttagtaaacagccttggaaattccccctcatcttccttcatgggtctggtgttcttcatcattttaccagtgacttatatgttgggagagaaaacctgcttgctagatattaagcttattaagagaagaggataggagttggaagggtgggagttgagtacttagcatcttgcaagacagtatcagaatttgaaagagatcagaggaaattgaaaaataattcataaacataaagtacaataaatgcttgtagaataaataataaaacaatgcaaagcaattatcctagggaaaatagagatagagaagttggttataacgcaaaaggtctatggatcatggtgatggtacttttgcttctgaaataaaaacttaagatgtatcacaacaagcataaatgcacttcataacaccagttcattgagtgcctacttaattaattctgctgagatactgatgaggtacagaaaaggaaagcgagaatcaaaatagtttgactgcctgttgggcactcaaagggtagttcttgattgatgcattaaaatgtactgtttttgcagtcttcagctttattgaggcatcactgacaaacaataaactgcacctgtttaaaatgtgcaatatggtgagttttgatgtatacacacatctgtaaaactgtcgccacaatcaggatgatcaacttatctatcatccctaaaacttcctcatgcctcttggtaatccctccctctccgctcccagtacccgggcaactactgatctactttctgtgactatagattatattttatagactcaattttatataaatgaaatcacccagcagatcttttgagtctagcctctttcatgcagcataataattttaagagtcatcatgttgtcttaagtgtcaatatttcatttatttttattcctgagtagtggtgtttcatgtagcttattttttggtgctcagttattacttccctggagagattagtcagttgacacattcttatcctatttctttattctgtactttttgtttaactcacatcatagactcactaaatatttatatgaatttattcaaggatttggttcaaaaatgaacatctcttcgagaggattctattgggggtcattcattcatttgttcattaagtcattcagcaaatatcaattaagcccttactaggtcccaggcacggtgctaggcactggggatacaataataaagaaaagagacatgcatccctcacattctaatgagaggagacatgtggcaaacacaataaaagcaaaaattattagtatgttagaagccaacacatgtgatttagacataatagaacaggctgaagagccaacaggcatcatcctaacaatgcagcccggattccaaacagctcctgcaaattggactgagtgtagactttggcatggttttctcagtcacacttataaaagccccatggaaatcaacttccaacaggacttcaaagaaacggaggctgccatgaatggtcaggtattagggaatgaggtcatccttccactgaacactcccctacatcccctgcaggtgtgtatgtcttaagcttttgtgctcacctgcaggagaaaggccagaaagtggctgccacattcttctcccccaactgcaggagtgaggccacagaggtttacctgggaagaatactctccacaaacttaaatctcagcacattacactggtaaatgtcacattccagttccagatatcaatctggatccaggaatgtatgtgcttcactcattccaagcactcatttgtttggtttgggggaggagagacaaggctagagcaatctgaaagttcaatcaagccaaaataccttgctcaaaaactgataaaacagggcccccaatccataaccagagaatgttgggcactttcttctctgcagaaatgtttttgcatttaagtttaggtagatttaagagaggagtgtaaggagagagtttctgtaaccagaggaggggaggcttccccgcctgcctccggagcttctcctccagggtgatctggcagccattcaaggcagcctgaactttctgagagacttgatttcctgttcccactgcctcagccgactggaggactagggtgacccggggtggggagcaagggacactggttagtttaggatcagcgggtgggaactgtttatcccaacatgcttagaaattcttccagcagcaactgtaaaaataaaagtctgaactgtacaagaaacttaagttatttcaacagtgaacttcaatcatgagattcttgaatatcttttgggaagacaagttattttgtttgtttcattcatttaaaatataaaacaacagacttcttataatgcagaggggacctcactgtcacctagttcaactcacatattttacagatgatgcagagttcagaactattcattgacaatggctggggggatgggagcaagatccatgtttcctggctctgaactcagtgcaatttcctccatggattataaagaagtgcaattccaaatgccacgccttagggggaaatttactatatgtaaattatacctcacaacctgacttaaaaaaaaaagtatatgttatccctgcttcctcctgaacctgggtctgcctgacaccaaagccccggggctttccgctctctgcctctcagtagtcttattgtcattcctgtgaatccatggtcctttagtggtttatgtttgaggagggagctgtggactgaataaactatgcagcacaaaggcattaaccatggattaatgggaaagaaaagcttgctgagttctgagtctgacgggtcaagagcttctgatggtgtcatgcaaatttcacttcccaatgaaatcagtcactcttcgtgtagaggggccatcatatcttagccagttcctgcttggggttcagaagagaaaacaaaacagtttgccccatggtgggaaagggacatttggtattctccttggcttcctagctaattacaaagtgttaatgacattcaaaggaaacttgcctccttcagggctttacaaataaggaagggcgggggaaggtgagccaaagaacagacaggggctccagtgaaacacagggcacaaccagtcagctcccagagcgggaggcagccttaatttacaaaggaaatagacaccccagcacaggctgaaattgggtgggaccaagagttcttaaactaatcacagctggtttccaaacctcaaagatttgttattgcaaaaacattctcaagcagtagatgaatagattgaatggcgacagaacaaagaaaagatggagacattttccccacagcggcttcaagacaggttcagagaggtatgaactagcaaagtaacacatttatccaatcaacattttttacccatctcctacactgggtctgaggacacagctatcacataacatttgacctcctctagtatcctacagaaaaacaactaaagcacctttgtgcaactcagaactacaagctcttccttatgatttggacaacaggtgccttcaaagaatggttctttttcctatattttccttcccttctcttaatggagaattttttcttccaccctaaaaaggaaacacgaccatcagtttcccaaatatgaagagggaaatgcatgtgtgtataaacagtggttaccacctagtagaattttaagcctttaaggattttcccccctaacgattgcaatttccttcagttactattgtcctatgtcttatatccaatgtattatttaggtatttctttacaggctttttaagatttacaggtgtacctgatcaaaaatagctggaaagatctgagatgttttttactggataatttattccgtgtgtacccaacagccaagcacttggcaaatgaccaaaaatatgatttatttttatttattttgttgagacggagtctcactctgtcgccaggctggagtgcagtggcacaatctcggttcactgcaacctccgcctcccgggttcaagtgattctcctgcctcagcctccccagtagctgggattacaggcgtgtgtcaccacacccagctaattttttatattctgggtagagacagggtttcaccatgttggccaggctggtctcaaactcctgacctcaagtgatccgcccgccttggcctcccaaagtgctgggattacaggcataagcccctgtgcctggccaaaagatatgatttagaaagccagaatagctcatgcaagaaataagcagctgacagattaaaatggcaactttatgctttaatggcaacgtaaactatccagaagggacatttattggttcaacaagaattgattttcttcgctctcaactattaacaggtcttctctttctaaaagataggaatgtgtgctccagtaactaatttgtttatgtgtaactaatacattgagagaatctctgtaagacatctttctctggcacttattttatcttgatcctggatggaagataatgataaccaagtgacctgtttgttgactagggcacacttcaaagcaggtatggatatctgatttaatgtacattagcaggacatcgatgcaagcgtatgagtactgagacaggtaggcaagtggcagggtgaacttcactccttaaaatagtgagctcaagagacataactacctaagctgtctgattttgttccatatgctcttttaaagtgatataaggcaaaatatatttaactggttaattagtgaaaatgtaccaacaaaggatgtctggttaattcatggaaaatgggaattttgaataaatttaaaggtaatgtttgaattaggcaaataaaattaattcttgtgtttgcataaacacagagattggagaattgctgtgtattcagtgttctttcaaatgaccgatcattcatttatttagtacatgtgtattgtgcacctcttgtatgggtgggaacacaccaggttccaaaaataagactgggactatgataaaatttttactctcaagggtaacagttaagtaaataacagccacaatatggggtttgagaggtacacaaccactaaaagagaggaaaagggacacaattttgtttgagaactaacagattccagaaaaggtaaagaattaggtggtctttgacacaagtcttaaaagagtaagcagcaggcacttgccacacatagaggaaagaaagtacagcagacaaagaataggccagtcatggttattaactatcaactagtccatctttaccacttacttgctattcgttcctggacacaattgatctcagggaggtagtgagtagaatggtggttaccagaggctggaaatggtaggagggatgtcagggaaaaagaaatgctggacaatgggtataaacatacagttagagagaagaaataagctctagtgttcaatagcacactcgagtaactacagttatcctgtatttcaaaatacctagatgagatttgcaatgttctcggcacaaaaaatgataaaagtttgagatgatgaatatcccaactaccctgatatgatctttacatattcatgaatcaaaatatcacatgtaccccatatgtatttacaactattacatatcaataaaaatcatgaagatattgataactaatagctaacatttattcaacatgtaccatgtgtctaaccttctcaccatcattgtttcctctgacactcacagtaaccctctgacacagataccatcatcactgtctgttttacaaataaataagaataaaaagaattgatttcaatgtgttttgggtgagcagcgctgagagagccctgattcacttggataagaatgcaatgcgctgtctggttctggttcaattttacatctcagagcttatgtactgtgagtgcaataaatgaggtgtgtgcacagaaattcagggcagagttaagctcctcctaaggagtgagtcaagtatttctgatttgactggatcaccttaatttagatatctttacaaagatattaacccatcaatccaagatgaaattttaactaacatcagggagatgagatggccctttccctctggtatcaaaagaaaccctctccaagaggcagaggcaagagactctgtatctcctgggtttcagttgctgaaggaaaggacttgccactggtctgtgggaaaactttcttgggagctgtctttgcgtttgaactctgaattttgttcagtacatcattgttctaaggatatatttagtgttttgtgagtgtacatttcaacattcagctgttgagtgagacagtattacgagacatgatgctcttgatatcagccattcttcaaagggggcgtttattatggaacaaaagaaaatatgtgcttcaatctagaatttaaaagcactaactgcaacgtttcaagcatatataaataaatgttatctgtcttaccattttcgggagaaaagtgaatctttacatttgttttagtgtgacttgtttctgatattctaacctaaaatttcatggtcacaaaaaagtacaaattaaatgttctctttatgaaaaataaaacagggactatagcacaggtgatgtgagaaaaatagtcactaaaaaaaaaaggaaccaagagtgaacagtgaagtaatctatggacttggggtgataatgatatgtcaatgtaagttcatggggtgtaagaaaggcaccactctggtgggggatatggatagtggggaaggctatggtaggagaacagggggtaaatgagaaatctctagaccttcagatcaatttgttgtgaactaaaaacaattctaaaaaataaagtcatatatatgtgtatgtgtgtgcatatattcacatatacgtatatgcatattatatatgtatagatacgtggaatgcatatatacataaacacacacacacacacatatatatacacatttatacacacacatacacacacccctaataacttttaaggacaaaaactttcttcccttcagaatatctgccaaagtgacttaaagtacacctttactcatttgaggtggtaaggggtggcataaatatcaactgtttcatcactaagtacattgtgtcctaattcttgtccttccactatggaataaaccgttatatagcccagtgtgtataatagaactctcatatggacctctgcagatctcaaatgaggatcttcttagaaacttgaagtagtagttagacttatacaccaacacatgctttgggtaaaaggaaaatcctttatgaaaatgcaaactttaggaattaaatgctccccataaggactcacttattcctgcataagtgattgcaggcagaaaaacagaatctgaatgaacttgtttttctttttttcttaaacttggaaaacctagaaaaacaagagtggtatataggggccaattaaaataaaaagcacaaggaaaaatgagaggaagtcgctcctctcctcccaatgggagtattgtgttttgaacaattcatgaatggaatttcagaaactcagcaaaagaatacatttaactgacttactccaaatatattctgaatttcatatttactaaataaagtgtttccaaatgaacattttgtatgttgttacatgtaacaactgcacattacaaaaggaaaggtaggagaattcatcacttaagtttttagatgcatgtatacttaaacttccacatactccacaaatactaaactcgaaaaacaaagcaccctacataatttaccttgccacagatgtgaaataattgtaagcatacataaatgttaataaaatactttgaatcaatgttaaggggagatatcactgaatggtggaccaaaacaaaccaaatggcaatttgatgtctgtggaaatgacatacccagaagccggtggctcagcactgatattaatatatcttgctcagttgtctcaatcatttatagtagtttaattttttcaagaacacagatgttaaggtacttttaataattttgaaaggccacagagtttatctattttttgaagtcttgctttcattggaattgcttctttaacttaatgagtaaatacaaagaatgcacagataaaataagggtttgtcttcttttattagagaaaaatgtacttttccatgcccgtgctttccacattttggaactgatacagatccacagaggccaaacctaaaactaaattatctttaatgttaaaatttaattgactgtgtatgtaactgtgcaattgctgctttctcacagaactgtctagggttcattcaacagatcatagaaacgtggtctggcatttaacaaacagactaataatagaagagatatactaatttatacaagaattaactaaacactgtcatgtggtttagtgtagctcaagttatgcatgtatcatataacataggttcaagttcttttgtcagtcaccagaataacagaggttgaagatacatctgaataagtgccaactcttgctgcagctgtttcaaaaaaataaatttaagtaattgcgatacacatttctacaaataaaatattccagtgcttacatcaatcctgagtttttaagataaaatatgcactacttacaattaccacaatattattttggaacatggcaatttattttttaagttgactctcttcaccaaaaagagggctttcattatactcttccaagtcctcacactctaaaacaaaaagtctagttcactgacaaaccatcactttacaactcacattttaaagagagtaaattaaatgtcaaaaggaaacagcttttaatattcaaaggatgctggtcatttatttcaaatttaaaaactgtaatcagtacatggagctccaaatacttaaaatttttaatgccagattttagtgaaatattattatagcaggtccaacagtcatgtactttgcttgaagaaaatggtttgatgaatatgttatggtcaagatggagcaaaaacagaaaaagactggtagtcttagatcatgaaataccatattttttcaccagatagtgacccatttgttatcactaatagtcgacataacatggtttccactgaagggataaaatggtctgtgacatgacctcatcaagttagagaaaacataactatgtttgaaatatatactattctctcaacaaatagttcaacagttcctactccctaaaaagtggtatgttaatgctgaggaagatgtaaaaaatgaatacacaatctcttccatattcctgtgacatgagcaaatatgcacgaataaaaaaaataatacaaaacttatgtaactgctgtggaagagcaactcactcggacatgtagccaaaaatggagactgatgtccacttagttggcaaaagatttcaatcgatcaaaaaaaaaaaaggactttaaaagcattgtgagggaagagcatgagcaaagcatgagagtaatggagaggtcgttcagagaaggctgtcaacctggagaggcgggaagaaagacagaaggcagtaaaacaagcctaagagggggtcatgtaaaggggagagtctctgaatatctaagaactgacatgtggataccactgataggctgggaagagtgaagggctagaagcattttaggaagggaagagttttaggaagatagtatttctgatcaatgaagggtggctcagaagagaagagagaactcagaaaagagtttaatagtacaagcaaggaagaatgagttcttgaactagggttgcctcagtggcaatttaaaaaaaagaaatttaaggaccattgcagagtaaaacttgcctcatgaaaactgtatgtgaaagataatggactcagaagagtccaagatgataccgaagttcctaccctaagtggtaacatgtagcattaacattgacaggaaaacttttctagtctcatgttcataccaattaataaatggtttctggggaacattatagcaacatgttctctacttgtgacttctatataaataaccgttttgtgtatagataatctttgagttgcttgaaaattctattttcaaactcttttcccagtttatttaacacatctcagttagtgtagaggagtgacatatgaacatgtctttccacaaggttattaaaaagaatatcttacctcccagaagggaattccattgcttcctaaataatatacatctacatgaagaagcggtcattgtccgatgacaatttgctaatgtgctgtacgacagcagataattcacaattcacaacatgttaataatctgctggctttcccattctgttatacatctgaaccatctcttatgattacaaattgtcatgtaaaaccattactagtcactaataattttgaaagtgaatatgccataaaacactcctacattacagcagaaaacaaaagagatactcagtagttacatttgcctacttcctatttaactaaaactcttgaaacaacacaagtaaaaaagacatccagaaaggacttatggactttctgccttccactaaagatttgtcgctgatctcctaaaaactgaaaataaagtcttcattaatgtgttcataaggtatcaatttttatacacaagatgtatatttctaggtaaaatttccaatttaccttttcctgttctaaataactcctacaaaactattcatgaatcctaaaaatactgttttatgttattttatgttatttactacttatgttaaatctggaacaacacattcaaagtgaaaatggtaagtaatttaaaatgtataaccaaaatgtctttccatacattcagaaacaagcagattgtcttctatttttatgcatgtgttgtattttataagaacgtattgtgttaccaaatagaacagacctttgtgaattgctcgtgtggtggctcaatctctttcagttcctttcccatcttgttgccacctcttttgttgctcttgaaatattttctagaggcacaaaacaaaaaagtgattaaaattgggtaaattttaatacttataaaacattctgcattaaagaaatactctttaaatcaatacttctgaacactttcttttagacaacgtttatgaccaatttgaaacaattgtgttcaccactcatgtgctaaaacaataacctttttcatcagtcatggagtaaagaattttctttcttatacatattcaacacatacgtcttaattcttgatttcaaatgaagagtatttgatgacccttcctataatttgttgaccacagataggtaagatctatacagaaattaactaagaaacattctttcttactaagattttaaacacctgttaaatcttggtcatttcaatatgtacatagataaaccttccattaatgattgcctttctgcaccttgacctaatctccaacaatagtgttctcctctcctctacgtggcactcacagtcatcccctaaattttgtcattcccagtgactgcagtatctacataatattaataatagcaatgataaacagcaaccatgggtcagatcgcatcctgaaaaatttaaataaacctgttacacaggaaccctttaatcctccaaacaactctgaaataggtaccctcaccatgtctcctttcgtatataaagtaactttagcacagagataaataatatgcccatggttcctgaactagcaatggtcaaactggaattggatcccaagcagtggggctccagagtcgcagcccttgaccactgcactcatctgtttctccatcttcccaacatacagccactaccttcctgccactgtaggtcactcacttcagtactacagctcaggagtctgtagggacctgacgcctattgaatggagcacttttcactgcccaatgccccacccccatgtgctcaggtaactcagccccagctgaaattccacagccagtcatcataaccccatccctgcctctatgccctgtccaactctccctctatcaacatgctcggctacaccccaacccaggaaattccaaccctacagctgctcttgcacaaatatgccaactgagttcactttaacttcttcatcgctatgatgctgacttcagttggacccctaatgctgcatggcaattatattcccctagtccatgagtccactaatgggcgaccctctctgggctcatgctctcttccttctttgctggatttctgcatgaactattactacctgagacattgatacaataggttaatcataaagctaagcctgataccaacaatttgttcttccttttctccatctccttcctcatctttctgctcatctgtgatgaactcttcaaggacattcggcaacttcagagaaattctataatcacgtttctgcctgtaacacataataagtaacaaggtcatacgtcatagagggatgaaaaattaatcctattcaaaccaaaactgacttgacatagtttgtactataaagtagcaagggagtaatagcagctgaaatcttctttttgggaaaaggtgaaatgagttactgtcattctgaaaggatcccttcctaactgactactagagcagctatcttacattctttacctgctgaagacaaaggagggtttactgcactataaatttcccagaaacaatctttttctccaagagcagtttacttttcatttcttcttactaaataacatatgcgttctcataaggaggtgcaagaatatcatagccattcatcccgtaagatttcccgaaagaaatacttcacttaactatttctccactttggcacgacaatgatctaaaaggaatagtgaaaacaatttaactaaaataaataacttatttacaacacaaggttatccctttctacataattgaatattgttaagaatctacagactaaacgttgaagacatttatcttatattcacctaccgtatttctagaaatggataaacattaattttacaggaagactttttatctggaaggcaaaaagaggtcatcttcattggcttctaggtaatatctctcaattctgttaaattgaggttataaaactaaagaaacttacctgtttagggaacaatcaagtaaaatatgttgttccctagagacaccaatatgtacaggatagttctggaaattatttgcaccaatgaatacaaagaaatgatataaatatcattattcaaaaaagccaacaatcatacctttttagttgtgttgttctcaaaacatttttaattctgttctttatttcgctgcaagcttttgcaatcttttcaatcctttttctctttgcagcaagatgctctttaatgtcagctagatagtaaatgaatatgcattaaatgttcatgttgaaaagtagtttctttgcatatattaaaatcaatatgggacttgatggttcagcaatatcagaaggacatttaaaatgtaaaatgcaaagatcatttcaaaaagcaagatttacttactttatgtaaaacctttcaggtattagtattccaatttcagttggtataacagcaaatcacttaattgacagataatgaaaaaaagcaaataattaaaagtttctattttttaagtgtgcagaaagggttacaaacacagactttaatttctttttttttttttttgagacagagtctcgctctgtcacccaggctggagtgctgtggcacgatcttggctcactgcagcctccgcctcccgggttcacgccattctcctgccttagcctcccgagtagctgggactacaggcgcccgccaccacgcccggctaatttttatatttttagtggagacggggtttcaccgtgttagccaggatggtcttgatctcctgacctcgtgatccacccacctcggcctcccaaagtgctgggattacaggtgtgagcaaccgtgcccagccacagactttaatttctacatttataaaatgtcctacaattcaaaggacatgtttccgtgaaatactgtcacaactcattatgtaaagcacaaaaaagtatctgatttaataagaccatcaaaagggtagaaataacttaatacacaataaagaaagtatttttaatcaatagttgatgctattaactatattttaataaaagaagcaatgtccatgggtgtaaacatttaggtttaaatagataaatacattcaaaacacatttgaaatattttctgagagctttttatatgacatttttatccacagtgcagtgtttcagaaaactgtaatactgcaaggaatgctttcctaaacatggtttcacatgagagatctaccatcaattgctgagaatagttttgagcaatcataaaagagctgcaccataatacaaatttttttacatacagtatccatctataatgctcattgtattagacaaaaccggcactttgtcaccaccaagcagagcaaagctttccaaatatactgcttatatgaattatcgctatagaagagctgaaaactaaagtaagctttttaaaaataagagtattgtcttcataatctctacagaaattttctcaaacttttttgaaaatatggtcccataacagtgcaactaatatttcacatggcaatataaagtttatgagtttttggatccaattgtatgcttctcactgggtagaaaagttgtctttccttttctactacacagcttgttactggaataataatagaaaatcatcattttagagaattcaattttctctggtactttaaagaaaacaaaattagaaagttgtgacaatagctaaattaggaagatgaaaaactcatattaaaaactgagtacatacggacaggaagaggtgaacaacacacacctgggcctacttgaggttggagggtaggaggaaggtgaggatggaaaaccacccatcaggtacgatgcttataatctgggtgacaaaataatctgtataccaaacccctgtgacacgcaatttatctatataacgaacctgcacatgtacccccaaacataaagtaaaagctaaaaaaaaacctgatatatgacttaatgtgtgtacactgaaaggaacgaatagagctgtttctcctccaatgtcctctaatatcccccaaacaattaaatttccacgtgtatgaaagaaaagccacccctcttgcttcaccattattagaagcattctcacattccacatcaacaattaaaaaagtaagtaagaaaaattattaaacagattacattaaatgctatatatgagaagaaggcatttaagacagtcttgtcatccactaattcatataacctactgtaagggttgtatggttgaaaacaattttcataaaccacaaatagctcgtaaaacatacctgcaatatcttctagctccttggtatcaaccctgtaacaaaaagttgcaacacaattttaacataatgctacacaaaaggccttgtttgttgggaagaaatgtcttgtgtgaaatgttctgcatagaacataacagtgatgacatgatccaaagctgacttttcctaaaagaccttatctgacaggcaaaagggacttaaacactttaccccgtgtgttcatctgtttcagcaaaagatcctctttccccatgctcatcagttacatctccctcctttgtctctgtaacaggttttctttcctcatgctcatgacttactggatcctttcctgcattaaaataaaaaagacaaaccttttttagaggaagacgctgttgtggacatttttcatagagaaacgtactatttgtagacttttttggctctccgccaattaaagctttaccgcagagctatacatggaatcgccggctcctaaccattttacggaggcatttttggaagcccttcgggttcaagtcccagtaaacaacgttcacaggtcagatcccttggatgtcaggaccgcatccatggagaagagctgctctgagagcatctgtaaccctgctatgagggggagcctcccacgggaagcctaaggcccttgagcctgctttgaaaacctggggcatctcagcacatgcacggtgagctccaaagccacgaaggggccgggggcctcgggctgcccatgtgcgccccgcccagaaagcagacagactgttgggcgtgcaccttcttctaggtccccttgggctgtgtttacctgcaagctccatttcctgggcggccataacttgaacctccaactggtccttggcagccatcctgctgcccttcctgcccacgggctccgtggctgactggcctgggaagctagaggcgacctctgaacctggtgagtgcaaagacacactaaggacactaaggaaacgaggcgtgttaaatgaaaatcatcaggatcgcaggttcaagggcgccccgggtctcccgtgggagcaggaggggacgcggagaagatgccatcatcccctcctgtcctggcccgtccagcgcttccccggggctggctgcagagctcgcagaattccgcggcctctgcgggattcttgcagtgcccttgggacagagcctggccctgcccctgggttccccagcgacccagtggagtcgggagggccgcggggtgacacaggatctccccagccatctccatgggaatgagccggtacgcacctgtttctgacaggggcagggactgcccattcgccagcctggacgcccaggggacccctggtgaccccaagtatcccgtcctgatgggcagccagacaagacggacccacgttgaccccccgacccccccccaaacgctgcacacatgcacaggcctccgggaccctcctgggtcctggggaccactcaggcagctccaactccctgccctgacccaggccccaggcgacaatgcctgggccatttcctcacagatcagcctggctgccccgcccttcacaccctcttccccaaagggcctctggcccgccttccccgcatccccaccgagggcgtctcacctgagggagccctgatgttgctccctcagaggacctgcagaggctggcaccgcgaagctcctccgagggcctgggtcctctgttctcacgagagcagcagccgccccggctgcccgcgctcctcgctgattggtcggcccagtgcgcatgcaggtggcgggcggcatggggccacgccccctgcaggcacaccctccccctcacggactgtccatggctgctgtggactcattgggtggctctctgaggcctctgtccccacgatattccagctcctcatcctggtgaaggaagcaaggactcgggagtggtgagtgccaggggaccctgccctaaggaatggaggccaagtgaacggggcctaggaccttgcccccaggctcgttccagccactcctgcccctttgggtggaatggccatcaccctgcgggtggagcccaggctccctcccatgtcctgtgtgcttccaacacgcccagctgcatcctttttatcaatggattgtgcttttatgttttatctaagaaaattgttgactcccagcaggggcaggtagttttctcctatcctactccattccctcacactgggcattgcatgattctgcagtggatatacaaagttaaagactttatgtctagatttctcatgatgtggtcatttcttttctttcatttttcttttttctttttttttttttttttgacagggtcttgctctgtcacccaggctgggctgcaatggtgtaatcactactcactgtagcctcaactgcccgcgctcaagggatcctcccaccacagcctcccaagtagctgggactacaggcatgtcccaccatgcccagctaattttattttatttatttatttatttttagagacagagtcttactctgtccccaggctggagtgcagtggcacgatctcggcttcctgcaacctctgcctccctggttcaagcaattctcctgcctcagcctcccaagtagctgggactataggcgcacgccgccacgcctggctgatttttttttttttttttttgtattttagtagagacagggtttcaccgtgttgcccaggctggtctcgaactcctgagctcagtcagtctgcccgcctcagcctcccaaagtgctaggattacaggcatgaaccaccgctcctggccaattttgtttattttttgcagagatgaggtctcactatgttgcccaggctggtctgcaactcctgggctcaagcgatccgcccgcctcagcctcctaaagtgctggggttacaggcttgagccatcgtgcccagcccgattatttccacagctgggttggaagccatctttccctgacaaggcagctcacctttatatctaagagttctctataacctaaagagaatccctaattactgacactaaataccaccagctgtccccatttccccacaatctacttggtacccaaattagccaatgagacatcttggggaattttaagccatgattgcttcaggtttctctctctttcgagcttaagatgtgtaacattaagaaagaagacaaatcttgcagagggctttgtgcaaccagtcttacagctttctatcccatctggatcaatgtaattttcatatgcttcatcaaagatttcagctgaaagtactataccaggttctgtctataattggaaacacatacacacatacaccaactactggtattcagctaagaattcaatgctggctcatttttctttaaaagaatgtcaaatcaaggaacaattctccatcacaaagtggaatttgatgtcaggtgaagacaaatggggattacagagctacttctttggcataacagcctagaaacaaactgaaaaggattctgcaattttaaataggcacaaagacattcttttcagaacaccaagtgtccaagttacaaaaccctgaagaaattcttttaaactttggatggagcaatttatctctttttcccaactggagtatttgtgagatgtctcccagaaagaaacaactcaatacacaaatcattaagcctttgtaaagggaggaagtctatttgaagcaactctgggttgcggaaacaggttttgtgaactaaccaaagcctttagggcaaacatggtcacttcaattttttttttttcccactagaggttatctacaaagaccacaggaaatgtttaagcaaatttaaaggagatttctcaagagttattagaataagtactttaatttagagaattggtttctaataactggaggtgtaaccccctcctacccccaacaccctactccaccctatgtgaattgactgacaagtaaggataatgcttcataacaaatgtagaaataacaccaattttcaaagcagccctcactcttctattgctgtcattaagaactaactgaaagaaatgcactgcttggattcatagacagacagagggacaaacagatggctagatatgtgataagcaacaacagtatggccagatgtcaatgatagaatctaggtgatgggaacatgaatgttttccatgaaattctttcaacttttctgtgtatttgaaatttctaataataaaatgttggaaaacaacatgtatgctgtgcatacatgtagagacataggctcagaccctctcatcaaatggcaacaacaattgttcattttgaaaacatctagaaatctaagatgtgatcactgggttaaagactgtatacatccatactctgtagcctgaattagtgatttacgctctaatagccaatcaaattgctcatttatcagacagggctggtagcacaggagatggaagtttctctgctgataatcctccagacgtttgagggcttcatgttcattcacatttcagccttttctccaattcttagactcttagcaaaagtttatactcgaatgaagcagcaaattctaggctccagctgtttaagaatgaatgaaaacattcatgtctttcagaaaggcttatctgatgtactctgcacaaataccctcacctatgatcttctctgtgcaaactctatcagggcccttctcagtgggcttttcaagactctctccaattagattataattccttcaagggcaggtctttgtcaactttgcttctccagcactcagcgccatggctggcacatggtgggccgtcagcaaatgctgtgtttgctatacgtgaattaatgctgtgcatacatgtagagacataggctcagaccctctcatcaaatggcaaagtctaccacccagtcctgagaattacatctcagcttagagcagaggggccccaccctggcgtctcctggaatcactcaggaaatttcaaaacacactgctgcctccatcctacccactaagtttctgattaactgtgttggagtttggcctgggcctcaggacggtgaaatctccccagatgatagaaaagtgcaggcagcactgagaattccagggtttggactttacaagccaccaggtaatttcattttcactcaccttctttcctttgattctcaggacaagctaccaggtctccaggactgaaggttatcatctaagttggtgttctcaactggaggcgatttaccccccacccaggagacagttggcaatgtctggaggtatttttggtttttatagctggggatgggggtgctactggaatcttgtgggtagaagccagggatgctgctaaacatcctacaatgcacaggacagccccaccacaaagaattatctggctcccaatgccaacagtgttgagattgacacaccgtggtctatggtaactgtttgattagctagggctttcttagctagagtaatctcctttttgcactctgtgcccatgccctgagtaagacagacaactgcacaacaatttatcccagagtacatctgagtcaactgttgatgttacatgttggattggctccagcaaatgaagagctgacattcaatgagtgttccctttgtgccaggcacattatatacatggccatatgttcctcccagcaatctgggagaggagagagattctaaatttgaaaactaaactcattatacaaggtcatgcatttaattaagagtttgaacctttaacaacaagcccaagacaaggagttgcctcagatccttaataggttgccttaatataaaattaataatgccctatgtttctcaaaaccccttgtttgagaaactcaagcctaacacattgttcatctttcctgctcttgcagaatggaattgatgtgccatacaagcctaatcattaacaagacataccagtaccctttccttgtaatcccaccctcctccaccccactaaggatccacaaaataccttttaaggtgaagttccaatcactttcacattattgtaaccatggcttatggcttatctttgttgtcatggataattgaggcaactgtgtgggaatggcaacttatgaatgatctaacaataggcctattaatatagcagtaaatgtcacagttataataaaaggtaccatacttacacagagtattgccagacctagcacaattcctggcataaggtttgtgcttaataaatgcttgctggatgaaccaatgaagtaatcaaatgagtcggaataagatgcaacatattcaagagatttatagaatggaagatctatagtgtttttatttgagatcgatatgttctgtagtggtaaccgaaagagtaatagctgactttcactttattattaaagcacaaacagggcatatcaatatttattttctcatccttattttggtatctaatagtgccaccaaatattatattatatggataactataattccgatacttacatcaacatttttaatcttgttggtagacattatatttttctttaaaagagagataaacagcttaacatgggaaatatttgacattattagatttcttaaaaagaatttttgtgcttttatcagcatctgaccaatatctacaggactgacttctcctttaggcacagagttgagggaccacaaaattacttcaatttctcttaaaaataacaagggaaaatattaatataattcagtatggattatattatctttatactaacagagtcacaaaatataattttttaatgtattattttatatatataattattatttttttagtggaggaaaggcttcacgaaggaaaatgcatctatagcttattaatgtcatgcagtggccctggatgtcacctctctacattccactgccctactcttttcaaatagcttttttattaattagtttcctttttttttttttttttttttttttgaggcagaatgtcattctgtcgcccaggctgtaatgcagtggtgcgatcttagctcactgcaacctctgcctcccaggttgaagcaattctcatgcctcaccctcccgagtagttgggattacaggcatgtgccaccgcatccggctaatttttgtatttttattagaaacagggtttcaccatgttggccaggctggtctcaaactcctgacctcaagtgatctccctgcctcagcctcccaaattgttgggattacaggcatgagccaccacgcctgactattaattagcttccgatttcaattttttaagaaaactttgtttcatcatctaagtgactatctgggtccttcagtggagggagactggtaactgatgacattttacaaccaattgatgacaagggactgactcaaggtgtgggggaggggtgagggaattggtgacgtgggaacatagcagtttgcaggtcaaaaatgaggggttaaagatgcctccaagactctcagctcagggacatgggcagatgaaggtgcagttaggctagcaatgtcaagtaaataccatgagagaggagatggtcaatggctctcacggagattgggactggaaagggctaaagctgaacctggcagagataaaggaaaaggagccagcactacagactgaagagacaggaggacaagctggagagttgagtccagagacagaagaggacagagattttagagttgtggagagttcagtaaattcaaagacctcagagggatgaagaaggttgaggcttggatggccaccataagatttgaccatcacgagggtacccaaggtctttgcctggtagtttctgaagtgtgatgtagggagaaaccagattgcagtggataaaagatatgaaggcgggggctgggcgcagtggctcatccctgtaatcccagcactttgggaggccaaggcgggcagatcacctgagattgggagttccagaccagcctgactaacacggagaaaccccgtctctactaaaaatacaaaattagccaggcatggtgggacgtgcctgtaatcccagctactcaggaggctggggcaagagaatcgcttgaacccaggaggtggaggttgcagtgagccaagattgtgccattgcactccggtctgggcaacaagaacaaaactccgtctcaaaaacaaaacaaaacaaaaaagatggaaaggcagagagggagagagagggttcctccctccagggccaggacattttagaatataagttgaggaaaaggaattggtggtcacagagagagaaagaacaagctggtgttttttcttctcttctgtctctcaaaattatgctttcacagagagtatgaagtgtaatcatctagaccaggggtcaacaaactacaacccctgggccaaatctacatagctgcctatgcttgtaaataaagttttattgaaacacagctatgcctattttttctctcttttgtctatggctgcttttacactacagtagcagagttgagtagttgtaacagaaactgcctgcccagcaaagtaaaaaatatttactatcaggccctttcgagaaagtttgtcaaccactgttctaggtcaactcccttgatataaagatggagaaacagacattccattacatttctatgttcatttgctttcttgttctgacaaagcagaagtgtctaccggaattattaattacctagtgtatgcgtcatcacccactgaattttaagagctatgtatacaactttcatgcaaagtgtcaccactttctattctcatcaaggtgaattttcctccccattctagctgcaaagcaaaactaaagctaaatgcacttccatcctttatacaggcctcatttcagcaatgtttgttgggcacattaatgagcagaaatgacttagctttataactgcttctgaaaatcttgagatttaagtgagaaggaaatacttttgtttctgcctccatcctattttagtgtaaatcaaagttaacagctcatggtctggttggcagttcacaagaaagggcgaggttgccagaaaatcaaaatcacacaatttcctgtttttgaagatgtatttcaacaagatcactgagagcttcaaagacaaaaatggctgtctgccagggccagaccagctccaagcgcctttgtttgctttattgtttgatgctgaggggtcaaagcactctttctattgtgttgtctctgctccccacccctgttattttttttgttgttgttattctattaagattcctgctgaaaattaaattaagcttcctaagttcttctttgttgatcctagcaactaattatagagaaaccagaaaagatttgcaatacttgggcattttttaagattgtaattggctacccacaaagttggtggaacaatagtttttggggaaaaaaagagattcgtactgatttttcaatgaatatttaaaaatatcttggcatcaaaattcctcccattaacctcatttgaacataaaaaggtcccttttactggtgctataattgactttccccaccctattcttccctgttcatcctgacacatcccccacactccgttttaaattgtggcataggacccatgtggcccctgtaatcttccttcaaggccaaagccgactcccagaatactcagcatgtcagtgccacctgctcacaactttggcactggcatggttgaaaattcttccaagtaatgtccaagagggatagcttttttctgggatgagcttgcaaagccaactcagagggtcacagtagattgtgattacatctttcagagcagaatgtcgggggtggggcgggggcgggtgcatctatggaacggttagaaaactcgctgactagaggggctcccaagatcactttgtgtgaattcgactgctatagaaactatgaaattggttcactgatctgaactttgggtcaagacccatgcagccattctagacatgaatggttttggccttcagtcacaacaattgaaaattagacccttgaagaaggcaggagtctctgaaggggctcctcagaatgtgagggctttaggcctggagtaccttaaaggttttctttaaaaaacatttggatatggtgaccacattgtctgatttttaaattcaagaggcatccatagagaatttgaagtgctacttgccttcgagccaagatgcgttatttacggtaatggcatttctataatctgtcactcctgaatctcctgtaagagaagcattttcttaggcctgatcattcctgtctaggttgactatcaagagctgtacacctctgagaacagatctggggtgtgaggtcacacaggtggcctcaaggggaagacagagctctctagttgttgtaacttaaggtaaaaggtgtgtaaccccagtactacaatgagagggccagctcactctgaaacctggtgatatcacctgaaagtccttgagctgaaatggagcacctgcagtcattatggtgatcacacccctcatgtcttgctaaatatccctcaacagtttagtgatataggtagtcattaacaggtccctaatgagattttattttattgtattgtatttcatttttgagacagaatctcactctgtggcccaggctggagtgtagtggtgctgttttggcttactgcaacctccgcctcccgagttcaagcgattctcatgcctcaatcttccgagtagctgggacgacaggtgcacgccagtacacccggctaattttttgtatttttagtacagatggggttcgccgtgttggccaggctgttcttgaactcctggtctcaagggatccacccacttcagcctaccaaagtgctgagattacaggcatgagccacccactgtgcccggcccctaatgatattttagttaagaagattttctgtatttatgtaaggccatgccagaaatgttttctttaaagatgctttattcatagaagtttgctgtcctctttacggtttaaaataattgattactagttagacactatcagtgtttaatattgaaccatctctgaatcaccagtttattctgttcagatttcaagtgggtcaggattcacatacacatttgaagtttgaatccatattggttcctcaacacaaaaggaactgagacacagagataatctttggccattagtattcaccatggaaattaccaagataatcttaaaacgtcataaaaatcaagaagttatagtttagtcccataaaatcagaatcataacgtatttcaaatcaatatcactctaaatcagtataatccgttcatcacaccatgagtaacaattacccgtttgaaagagcttcctgagtagcctgaaggctcaaatcaatgttttctacttagtacaatcacaacatttaaaaatttttttataattctaaaaattatatgagcttaggataaagaaatgacagtttaccccttctcagtttcattcttcagaaggatgttaacattaccttatgttaacatgaacaatatgttcagaatattgtttactatattgtacttacaaaaatataactgaaatcggttgatttgctccttagcaaccctgtgagtggaagcatattaactaatatttctgttttcaaaaaataggataataatatacatctgcacttgccttttgtcctaacctaatgatgtactttggatatccctgtctattattagaca

SEQ ID NO: 272 - DNA, 102137 bp, Homo sapiens
ttatctctaaatatttttgatcccattttaagtagtaattttcaaaatttcatattccagttatttgttgctggtatatagaaatagaatttattttctatttctatatcagttatatttgatatacaatataatcatgtgtcttgggatctttctaaatgtacttattagttccaataggttttattattttttaaatagattcttaggactttctacatagttaatgatgtctgtgaatagagacagttttacctcttcctttccaatatatgccctttatttattttttatcgttgtcttattacatctgctagcagctctagtattacgttgaatagaagttgtgacagtggccatccttgcttggttcctgatcttagggggaatgcattcattctttcaccattaagttagctgttgattttttctaaatgccctttatcaggctgaggaaatttcaccatatttgttgaaaaataaatgtaaataatgaatattaaatactgttttgagatcttttgagatgatcacatgattttttccctttactagtacgatgaattacactgatttttaaatgttaaatcaaccttttatttctgggataaacctccagttaggcatgatgtgttttcctgctgaattctgtttgctgaattccaactcaattcctgctgaatttcagttccatggaaggtttttatacctagactgatgagggatactggtctgtaattttctttttcttttcttttttttttttttttttgcaaagtgaaagcaagtttattaagaaagtaaaggaataaaaggatggctacttcacagagcagctgtaattttcttttgtcgtaatatccttgtatggttttgttttcagggtcattatgaattataccagttggaagtgttgcactctgttttcagaaaatgtttttgtaagatttgcctttcttaaatgttggatagaattgagcaagaaaaccatcggggctgataatttgttgtaggaaattttttaactgcacatttactttctataatatatagagtgatcattagattttttttcttgggtcagttttatatttgtatttttcaaagaatttgtccatctcatctaagttttcaaatttatcagcactaagttaggatattctttattttccctttatcatcaccaatatctatattgatgtccctctttcagttctgataatggtaacttttggtttctttctttttttagtagtctagctaagggcttatcattttcattgatcttctcaaagaccagctttggttttttttttttagttttttttttttttcaaagaccaacctttggttttgttgatttttttaaaaaaacctaccattgatatgttttctgtttcactaattctttatcatttgcttgattctacttattttgcatttaatttattctttcaagcttcataaggtgaaagtttaaatcactaattttttccttcattttttttctaacgtatatagttaaacctataaatatgtaagctgtgctttggctgtctatttcacaaattttgatgtgttgtgttttcattattaatcagttcaatgtattttctaatgtcccttgatttatttgacccatggattatttattagtatgttatttaattcctaagtatttttaaggtttactgggtatcttttttgttattgatttctaatttaattttgctgtcatcagaacacatcctgtattattgcaatcttttaaaattcactgaaacttattttgtcaccaaggaaaaggcctagtttagtgaatgttccttgtatacttatgaagtttggggttgtttaatagtgttcaaatcttatatattcactgttttattttgtcctcgttttatcatttaatgacaaaggaatgttacaatcaccaactgtaattgtgaatttatccatttgtctcttctatacatttttgcttctatacatttttgcttcatagattttgatgctgttattaggtatatgcagatagtagttatatgttcttggttaactgtcctgttcatcattctgaaatatctttctttatatctattaaatactctatcttgagttctacttcatctgacttttaacaattccagccttcctatgattaacatttatacattgtatccatttccatcctttgtttaatccacttgtgtctttttatctgtggcttttgtaactagcatatagttgagcctcgctattttataaaatctggcaaacactatcttttatttgctccatatctatttcatgtaactatatttgctccatttccatttgaggtaactattgatatagctgggtttaatctaccattatgcagtttgctttctttttgccccatttgttctttgtccctttttacctccctcttgctttattttggactgattgagaatttttttttaactatgcttctatgcttgttttttttttttttttttttttttttttttttttttggtggtcactctagagcaaggggtcagtcagctccatagcctatgggccaaattcagccaaccacctatttttgtaaatagttttattggaacatagccatactcattcacttacatattgtatttgattgcttttgttccatagtggcagagctaactgcaacagagactgtatggtcaaaaaagcctaaaatatttactctcaggcattttacaaaacaagtttgcaaatccctgctcagcacaatcctgcctaacagaaatataatgcaagccacatatgcaatttaaaaaattctactaaccacatttcaaaaagtaaaaagaaacaggtagaatctattttaataacgtcctctgattaaaccagtatccacaatggtataatcagaataatattactgagatacttacatctttttctaaagtcttcaaaatttggtgtctattttatagtaacagcacatctcaattataactagccatatttcaagtggtcaagtcatattagacagcgtggctctagaaattaccatgtgcacatttaactgatcatattacattctatcttgacttaatgtgtaagaaccttaaaaatatatacttccctttatccctcatcctttgtgctattgttgttatacgttttgcttttacatgtgtaatatatttcagaatgcattggtattgttgctttaaggagccatttttcattttaaaaaaattaagaaaggaaaaggaaaaaaagtcttaacatatcccagtatttacagttactgaaattctttattccttcaatagatcttagtttggtataatttctcttcagcctgaacaaattcctttaacatttatcatagtatatatttcctggaatctaattctgtcacctcttgtctgtctgaaaatatttgtatttcacctgcatttttttttgtagtggtggatttatattttatttctgcatttttttaacagtttattttgaagtaactgtagactccgaaattgcaaaaatacatacagcctccctatacccttacctaccctttcacccaactcctgcaaatgaaaacattttacataaccataatataattttacaaagcaggaaattgacattcatatactaccataaaatacagaccttattaggatatcaccaattttgacatgtactcgtgcatgtctgtgttccttagatattttataacatgtatggagtaaccaccacaattatcctgcagacctgttccatgaccacgtaggaattgctcatgctatagtgacactctcttcccaatcctaatcctcagaaagcagtgggtttattctgcatcactgtaattttatcattttgagtgtatcatataaatcaaatcttatgatatgtaacttgttgagaatggctttgtttcattcgtcatcatgcccttgagatcgatccaagttttgtgtacatgagcagttcattcctttttattgctcagtagtaatctgaagtatggatataccattgaagaacatttggtttctttccagtttttgtccattcactattcagtaggttagctgtagacatttttatagatgttctgtataaagttgaggaagctcccctccatttctaatgtactaagagttttcatcatgaataggtgctgaatattgtcaaatgctttttctgtatcaattaatatgatcatgtgatttttcttctttagactgttaccatagtggatgacactggtttgtggttgaatattaaattagtcttccattccttgaatcaaccccacttcgtcattttatattattctttttatatgttgctggatttaatttgctagtattttaatgaggagttttacatctgtgctcatgagagctgatgtctgttgttatctttttattctactgtttttgttggttttggtatcagggtaatggtgaccttatgagttgagaagccttcctcctcttcttaatttctggaagaaaatgtatagaattgatcctgtttctttttcacgttttgcagaattctctagtgaaaccatctgggtctggagattcctttttagctatgaattcaatttctttagtaagactattcagatatttatttcaagagtaggcaaacttttctgtaaagagccagatggtaaaaaatttaggttttgcaggtcatatggactcttgtcacaactatttatctcttgcatttttattatttcatcttgagttagttttggtaatttgtgatttttccaggaattggtccatttcatctgagctatcaaatttttgttggtataattattcatactattcctttattcaaatcccttaaatgcctgtggggtctgtagtgatatttgtttcttcccagatactggtagtttgtgttttctttccctgttagtcttgctagtttgtcattcttattggtcatgtctcagaaccagcttttgattgatcattctgtattttttaattgccaatgttattgatttctgctctaatttctatctttctgcttgctttggatttcttttttttttaattctttttttgacaaatataattgtatatatcatatctatggggtacaatgtgatgctttgatatatgtctacattgtgggatgtttaactcacactaattaacaaatccatcatgtcacatacttgtcatttctttttataatttcttggggtgcaaacagattattaaattgggactttttgtcttttctagtacaaatatttagtattataaatttcccttctagcatgacattagctatgtcccatgttttgatatgttgtatttttatttccattcggttcaatgtattttttaattttcctggggtctctttgacccatttaaaggggtctttaaattttaaagcatttggagattttcctattatttctttccttcatcttgatcttggtgtattttcttcccttttttccagtttaggtagaagcttaggctattgatttgaacccactattttttctaatgtaagtattccatgctataagtgtcctgctaaaccctgtttgtactgcatcctgtaaatatttatacatttcaattttgttcacttcaaaatatatttccccttgagacttttaataccttatttagaaatgtgttaattcccaagtatctgaagatttttttttcagttattgatttctagtttaattatattatggtctaacaatataaatttgttagggtttgttttatggataggatatgacggtctgcctggttgaatgttccagttgcagttgaaaagaacatgtattttcctgtttgggggtgaagtagtctataaatatcagctagatcccattatcttgtgatgttactgatttattttatattcctgctgattttcactctagtagttatatcaattactgagaacagagctttctagttagggagatgtgcgatgccaactctttgctgtttaatgcacagcaggcacggtcaaaagggcaagtgcctctccagtttctgaggccagagtggagggttgctgttgctctgatgtttgctcagtgcaaggtggagaaggttggtagctctctactacggtctctacagtgtctggtggggaggaagacaggtaccacatctgcttgtgttagtgcagggaggaacaggctatatggctctgccttacagttttggtagtctcctggtgggaaggaagggggaccacctcagtagtacaggctgggaaaggttgtcagagctctatctcacaatttccctaacacccagtgggatagggtatcaccttgttagtgtgaggacggtcaacagggctctacctgtctccacagtgcttgatgggggaagggtaggtgtgctccctggttagtgtagggtgatgatactcaacaggactgtaccctccctcttcaccccacccttgccacctccccaccgcccccaccatcccccccaccccgccgccccgtttccacagcacctggagagaagtaaggtacagcttctttcatggtgttcacctagggttcagcaggtataaaaagattctgtcctgtagacctgtcctcccccagggctattggttacatagagcatgtttttcatgtttgtttttttttttttccagtctgtgcatattgctgtttccagaacgcaggctcttttatggcccaggctggggtaataggaggtactaaagtacatggcgggtggagactcaagggagggtcatttttagaattttcagtgttttgataggtgctttttgtccactctttaattaccagaataaggtgggatgcttactctttcttgtctataactggatgcccctcactttgattttgaaagcttcattgaatatggaatctattctttcagaactttaaaaaggatgtttccatcttcataggtctgtttttttttctgctaagaagttagcagttattcttattggcccatttataatgtatttctttctgtggctttcaagatttgcttgttatttttggttttgtaaggatggctgtcttttgtttattgtgctttgggttcgtagagctgcttttatctgtgggttgatatttgtcttcaaattggaaaggttttgtatgatttcatcaatttgtttcatgccttaatctctcttatttctctgagttccaaatacatgcatgttagaatactttacctttttcataggcagctaaataactatttttttaaatcagtcttttatgttgctgtacctcaggttgggtggtggtgttttttttgttttgttttgttttgttttgttttgtttttgcctgacctctagttgattgtcaaatcagctgttaaacctagccaatgaatttttcatgttataccctgtatttttcagttccacaagtatatttctttgtatgttgagattccacctcccccatatctgttcattaattatgttcaactttaattccttgaacatatttatgtagatgttttatagtccttgtttgataattgtaccatctggatcagccctgaatctctgttaattttttctcctggttatgggtcacatttcctgcatctcatttgtagtagttttattgtatactgaacattgtggatgctgtggtctttagactccagattttattgcattcctttaaagagttttgaggttagttctggcagacagttaacttactggtgactaaacctgatcattttataagttctgttcaggcttttttggcctagtctgcagtaaatcttaaattgtggcctttcttaggtctgtgttattttcccttcctgagctttgttttagatccctaagttatttcacatattttgactaattttgttttctattatttatttatgggttttcacagcagaaggggaagtctggtatcagattttcatggccagagtggaagtagtgttgctatttttcatagcttcccagtcgattctgatgtgcattcaaagttaataactattctaatgtagggtttcttgacagctgcactgttgacatttgggagctgagctgttatttgttgtgggggtgctgtcctgtgatgtaggatgtttcgcatcattcctagtacttatctactaggtgtcaatagtatctcctcctagctgtaacaacccaaaatgtctccagaaattgctaaatgtcctctgtggggcaggatcaacccaggctgagaaccaatgctctatcacagtagattattgcattgccttgagccctttgctactcaaagtggggtgtgcagaccagctgtattggcatcatctggagcttctcagaaatacagaatctcaggtcatactcctagaccttttgaatgagatctgcattttaacaagttatgatgatctgtttgctttctaatactcgaagaataatgccgtagagcaggggtcagcaaaccttttcttaaaaggccagaaagaaaatattttcagtttactttccatacagtttttgtcagaactattcaacaatgccattgtagtgcaaaagcccacatagacaatacataaacaaattgatgtggctctgttccaataaaactttattcacaaaacaggcaactagccaagccaaattttggcaactcctgttatagactatcctaatcagaccccctcagtgtactgaagacaacaggtggttaaattctttgatgagtgccttgccatatgatgtcatttgctgatgttcaagagagattaagtgtatagattacacagtagatgattctggaaattatagtagcttgacttctatccttacctaagtggagatatctcccagccttgcacatgtgagctatatgtaaatgctgctctatgatttgatagcataattattatttgtattatgctttataggcctactggaataattattcacttattttgactttagttaataaagctgacaaacttatgaaaaactgcattaatgtgacttcgttagctcagaaagagtagtttaaaatgagttatttaactctaaagtgagtcatttaactctcaagtaattttttttcataggaaagctagtagtttttaaaacatcctttgttttatgtaggactcctttctgacacttccaaaactctgtatctagaaaggggagggctgtttgtttgaagggtggcagtttaaaggttgagaaggtagtagctattctgagaatgatggacagtgaacaagcttaaagtattttgctttgttttataaatttcttctcttctaagttagttacttgataaatggtgctgagggggcatgccagatgtcaccaaagcaaagcagaaaaactcgactttcagccagttaagtggtgatcaggaaactgattcctgggactttggccaacaggaatgatgaaaacatagaagtagctcccgaaacttgcataagtaaccagttaatttgttttatattaataccacttaatttgctttatattaatatctattcggtctatactggttcgtctgtatagctttccaagagacataacactatagctacccctgaggcagttttctttggctgtgtacagcctcatcctttgcccactgtacagtggacacttctcagttgccatggaatcagaaggtaaagaaagaatcacattaatgaccaaaatatttctaattatggctatcttacccccttaagattaagcccaattttttggttttgccaagaaaattcagttttcatattctatcctatttatttttagattataaattacttaagagatggcctactgacgtggtttaaaagaaccactcaaattatatccagatttgcttgttggatgtttataaactcttaaaaagtgtaaatctttaagatctttacctaaaaattacttctcaggaaaaataacacgcaaaaacttgatcttgtataacattttatttagcattcttacacactacacaaaataaatacttggataactcacgtctaacaaactaaactatatatgtattttttccataggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaatagtgtcatagaatagtgtcatagtacagtttggaaaacacttctgaagtttcagatcacctaggaaatctagaaaaggagtttaatgtttttgatcagagaatttgaaaaatagaaatacagagaatgagtttcaaaagttttagataaactgatatactatatagatctatcttctagaacatattactgaaagctaggcacattttatgagatgtgattaacaatttgcttaccttactacaatatggacattcaccaaatatgatgttaaaactctgtctactagttagtagtcctctcagccactgcaaattttaaaagataaaggagaagcgtcagcatgattacaaattacagatactccaaatgtcattccctttgtttttaagtgcattatgtttttattccagaagacttagcttaattttgttttgcaagagtaagggatgtatttcctgagccaatagcagactattaagatgttgagtaacaagggaaatcaacatggaattgaaggcctaaaccactggtttataaccagattatgggcccctttaagaatctgataagaattacgcattttctttatccccagaatagacatacataaaaataatgcatactaagttcctggcattcatagactttccctaaatccattaatcacaaattaacaactcctgctgttaaagatactacaggctcttgaaaatttccctcttagttctggtctgaatcactaacagtgggttaattttcaacccattgattataagcatgagccagtgaatttttaaaaattaaatgaatattcataattacaaaagaaatcacatgttcccttagagtatttctgtaatttgacctgtatttctgtaatttcatgattttatataaggtaaatagatgcctctgcctaagttctccattggcaaagtacagacggcaccaactgctacctctaatcacaaaagtaaagatgtgatattaaggaagactgaaaccgaaggcaacatacaattgcaaggtgttctgtatatagttacacacagtttatcatgtatcaactaggccctaaggtgaagccaggcactaaagacaggaatgaaagtagacttcacatacagtaagtaaagtggcattgcctgagtgctgtgagactcagatcacaaaaggcattcttctcaacatgaaaagtagtagtattggatatattctattcttaaatgcagcctgaaaagtaatagatactacatagtactaatttcattttcactgtattactgccactttcaaccacctccacctcgggtaaacctatgaagcttacattgtggtaacaaggaatttatagaaagattccaatgtaccatcaatttaatttgttatgtgtcaataagctagtccatgaatatattctggatagattttctcccttggatacttcagaacatttctccactcattagtaactgtgatgaagaaatgaagcacataagcatctggaataaactggtaaaaggagttaatggcaaaagagaggatcactattgactcaacagattttagattctgtgtatttcaaacaggaatacttcctatgttgtgttagcggaaaaaagtcttgacaatatttttattttttacctcatataagcatatttgatggaaaggttgtccacactgagaattatcacacacttgatcaggaatggtaccgtcaagttgataagcataacaaattccacaatccatagtaaaatccttcaaaagaaaaatatttataaaaagcgtatgtgtctcactaacttattcgttgtacatatttgggagggtatgtgtgatattttgatacatgtatacagtgtttaatgatgacatcaggataattaagatattcatcacctcaacatttaccttttatgttgggaacattacaattcttctaactactttagaatacgaaatcatctatgtgtttaaaacacaaggtaagatcaggaagaatgttttataaatatagtttttataaaggtgactatattgctgtattataggaaatataattacattactatttaacacctagcaaagctattgtagggtgtttccttttccactcaaatatacacagctaggctaaaaaaagagattccatttttggctggcaagatgtttgggcatcagtaatattcccatatcatacattgttataatgtccctgatagtatttaaagaaaggaattgatattagctagtgattactaaacagcacaattctgtaactaaaggaaaaagaaactcactaccatttagtagtctacaaccttagcagccttgtcaaaaatcaattctattatttttgcagtatagtggtatctattcaattttgagaaactataactgcttcacaaacacttacatcaagctaatcagtatttgagccatccataaacagactatgtagaaaagccaaacatctcattagctactttggagttctccccttatttttaataaatgtctgtcattaatgacgtcactactgaagaccatgaaaaaagtatatagttgacccttgaacaacatgggtttgaactgcacaggtctacttatacacagattttttttttaaccaaatgcagatcaaaaatacagtactgacaagatgcagaacctgtgtttatgtgaaatctctgtatacagagggccgacttcttctatatatgggtcctgcagggtaactgtggaactttaatgtctgtggatttttgtatccatgggcagccctgaaatcaatccccctgttccaagagacagttgtacttaacaaccaatcaaaggtaaacaagttttttgatgcagatcagaagtctgtgttataatatttttctaattccctcctttttcagcctcatttttcactgagagaagcatttaaacttcattatgcaatactgtctggaatatcaaaacactgataaaacttacagatttttccaggatagcacgagctggaaaatcaatttctaaaacatctttcaaattttgtaacacactattttctggatccctgaaagcatggggaaaaaaattatgctgtgaactttgtaaaatcaccaaaaagtaaaaattatattgccaaggtacctaccacaaatgtatgttcctgctcagcttaattcccaggggttttaccacttcagattaaaaaaaaaaaatttaataattgcatgctctactcttggtttctaaagccacatttgatacagaatgtttcttaactacttgattagaaaatcaaaattatatgtattatgttaaaaaacaaaattatacagttcagaatgctgagacattgtcatttaaaataactatcattattgcggtgaaccgagatcgcgccattacactacatactgggcaacaagagcaaaactccgtctcagacaaaaaataaaaactaccattaatatactaatattgtctaataatttaacaatgctaggcaaggattttatgactctattaaaaaacgtttaaatctcagatgtcataccatggtcagctccaagaaagaagcactcaggaagcatagtaggatgcctggggtctacctctatatttatggaaacattattacctagaatgaaacaagattaaatcttttagaagtagaacagctcatcaaacaacccaataaaaaataaagaggtgttggtctggctacctatttcactgtatacccacggaaagattaaccaaatgttttgtagttttatgtaatggtaaatataattgaaccaaaagaagtaattttgatatgattatcattgaaaggatcttaaatttcagccagtcaacaaattgatatatttaattagattgcaattctggtcaactgtattaaagtttaaataaaaatgttctgtggagtgataaaggtctttaatatcaaaactatcacaagtcacatgtttaagaaataactatctaaattatttttcatggctttcctgaaaaagtttacatttcatagaactatggccaaatgtaaaaagaccaacaatacagtaaatggtaaaaacaaacattaaagattcaagttttataaaaatttataaaaacattttctgtattattttgctgcatgtgaaactttcccttataatttaacaaaagatttcattcacattggcaattgttcattaataaccaaaacaataagtaacctaatttcgcaagacctaagaaaattggcactaggttcttttatacattttaactgtactggactacagcgtaagtttcagaaattttacttctattttttgaaggtacatagtgtaactgcttaagatcaatttggatttcattttcatcgtaaaaatgtcttgataaattccatacactgtagaataagcctttcactaaggctggcatcaacataaatgcagttattgcatatctggcaaaaagaggtcattaacagaaaaaaatgactagccattcaatgagacaaataaaaatacaaaaagttataatctcatttggtaacacattatttactatgaacagaaatttcttattagccctcaacactgtcatctggtaatggctccagacagtactttcacgtaatatgggcatattaactaatttttccaatcacttgttcaaaacttggtcttaagaaagcaaatcatgcctggaggagaaaaaagaagctaaaaggtaaatagggaatgaattaaaaactagactatgtatgctgaatgagaaatatagtaagtatatttaatcataacctgataattactttaatggggccacgaaaataatgatttactacatttctttgaagaaaatattttcattcttagtatctacttgttcacaaatataccataatttggttaattgttccaaattaaacacagttagactttttgaaaccaggaaagtaccaatactatttgtagaactgctgtaaactatactttcttctcgtaataccacgtatgtgacattcttcccccagataatctatattatacctaggtataaagtataaaaattgctcactaacttggatgtgattcacatcagaatttcaaaatacccttgaacaacatatctatttagaaaaaaagaaatgggtatcttaaaactagctatggtatttaatgtgagcttaaatatagtttatctaaaatcttgagaaaggctgaagtcacatgttttgcttgcttataatgaaaatacacagccattttatagtcgagaacatgataacattgcacaggtatttatgattataccatatctcattcataaatttcatatacttgtgaagaaaatacttaaaactataaattctttctctgtgctttctgtttactcttcagtggcatggtctactgcaagttcttttatcttcctctgtatttctaacagaaaatattcccagatctgagcacactaatctgagaagattgtaagcttcacaaatgaagactgcattattctgacttttttcttgttctaagtaatgtaaattttgagttacctgttccacgattcctgtgctaattagcagctaattaaactctacttctgaatgttacctccattggatcatcaccttttataatgaaacacctcagtacttctccttttcacctaaaatatttacatttaaatgtgtagccaaaaaaaagtttatactagaaaattttaatagttgacttcatataaagaagtctgagtccaactgtcattgttagatttattttcataatacaaaataaaacacctaaaaacaaacccttaatcctccttgtccctacctaatgcaattctgcgtgctgttgcactccgtggaggtttttctggctcaagtacccaggtcttctcatcgatttcatccataacatcccagaatgcctttagtgattctattgctgccaaaaactgactataaatgcttattaaggagctctgtgaaaaaaatgaaagttgaataagttatatggtactctaccaatagcagataatcttttacttaaaatacactcaatttagaaattttaagctgtttcattttagctacaaagtagactccagtaaacagtagtcgactctccctgcttcacatctcttcctacagcgtttacaggattcttttttattgacagtagactatacacctgagaaagaatggttttttaaaaatcataatttttttattataatgcttgatatactacacgtatgcaatagtaatgagtacaagatgtatgtacacacaactttaataaatattaatgtacatgatatagctaacattggacctatacaaaatgtctataatattttagtatgaaaatcttaatttcatgtttgctgcagcaatcaagttaaatgcagtgctatttgtaatttagtgagattacctttaaatattattaaaaactttggagacctaattaggcagagtatgaaaaggttttacacatttttaaagaattaaaacagaaggtacaaatgatgtttttccacatttaacttttagccaatctctgaattcagcatttcatatattaatccctttataggaattagcttaaatatagtttcactaaataataagtaatgccatcactgactttaaaaatcagtttttaaacaaaggagtttctcatgaaacaatgtggtatgtttaaaagatacaactgcttactaaatacttttgatacaaaatcaaaacagtttaataagaaggatttgtttcaagtacacaaaatgtaaagtcacatactacaaacgttttcaatctgaaataactggccacaccaataatttaagaatatgatacaccctaagatgaaaagaaactagccacttccttaaacatgtattttatacctaatacttaaggaaaacccatcccattttgtcacttcagtcaaggtttacacttggatgaattcatgctcagttccactgtgctggattcaactgttctaaccttctacacatatttttttaaaaagtgggccaggtgcagtggctcaggcctgtaatcccagcactctgggaggctgaggtgcgcagatcacgaggtcaagagatagagaccatcctggccaataaggtgaaaccttgtctcttctaaaaatacaaaaattagctgggcgtagtggcacgcgcccatagtcccagctatttgggagacagaggcaggagaatcacttgaacccgggaggcagaggttgcagtgggccgagatcgcgccactgcactccagcctggtgacagagctagactccgtctcaaaaagaaaaaaaaggtgtgaagtaggaattagagcctaatacccgaaaaataacctttgaggatattgacggtataatgtctgttctcttctggtatactttacttacctgtaagtttaggtgacagaatccagaaatcagaaaattaaactcccaagaagctagttttaaaatcagtacaatagtatatctctgtttctcctttctctgtctgtttctacatgtgtatttaaaatccgtaattacctattcctttgtatacccaagataaggttaactcccctgccaaaaaaagagttataaaatattttcacagtggcatcttttatttgaagttttttccaatggcattgtccatttctcttatgcacaactgcaaataaaatcctaattgcattttgaacagaaaaatgtattcttaataagaaaatagccaaaaacaaaacatccctggaactagaagttacttggtaattacagaaaaagtgaattttaaaccctaaaagccattatacgattttactagctagccatttgaggtagatacattaaacattatttttacattccagatggggaaaagaaagatcaaaaatgtgacaagttggacatagaaacacttctcttagcaatttcaacgaacttagggggtagacatcaaaactattatatcagtaagctatgcgattaatagttttttctccaactgcttattttgtccattaaatcactaaaaacccttattttgaattttttccccaaattgaaaaaaataaattatttctaaatattaccaatggaattaaatactttatatacagcaccacaaatgccaagaaataatatggccaaaattaaaatcaaagttcagtaagtattttgcagggagatgaattctctaaaaaatatttttaaaaataaaaatagctaacattcttggtggctggcaagatggccaaacaggaacagctccagtctgcagctcccagcgagatcaaggcagaaggcaggtgatttctgcatttccaaccaaggtaccggctcacctcattgggactggttagatagtgggtgcagcccacagagggcgagccaaagcagggtgggctatcacctcactcaggaagcgcaaggggttggggagctccctcccctagccaagggaagccatgagggactgtgccatgaggagtggtgcactctggcccagatatgcttttcccacggtcttcacaacccgcagatcaggagattccctctggtgcctatttcaccagggccctgggtttcaagcacaaaactgggtggtcatttgggcagacattgagctagctacaggagttttttttttaataccccagtggcgcctgcaacaccagcaagacaaaactattcactcccctagaaagggagctgatgccagggcgccaagtggtctatctcagtggatcccaccccaagaagcccagcaagctaagatccactggcttgaaattcttgctgccagcacagcagtctgaagtagacctggggcactcaagcttggtgggggaagggacatccaccattactgaggcttgagtacgtggtttacccctcacagtgtatacaatgccacgaggaagctggaactgggcagagctcaccgcagctcagcaaagcctctgtagccagactgcctcaccagattcctcctctctgggcagggcacctctgaaagaacagcagcagccaaagtcagaggcttatagataaaactcccatctccctgggacagagcacgtggggaaaggggcggctgtgggcacagcttcagcagacttaaatgttcctgcctgctggctctgaaaagagcagcagatctcccaccacaacactcgagctctgctaagggacagactgcctcctcaagcaggggtcaaaagacaactcatacaggagagctccagctggcatctggaggatggccctctgggacgaagcttccagagaaaggaacaggcagcaaaatctttgctgttctgcaacctccactggtgatacccaggcaaacaaggtctggagtggacctccagcaaaatccagcagacctgcagcagaggggtctgttagacggaaaactaacaaacagaaagcaatagcatcaacatcaacaaaaaggacatccacaccaaaaccccatatgaaagtcaacaatatcaaagaccaaacgtagataaatccacgacgatgaggaaaaactcgcacaaaaaggaggaaaattccaaaaaccagaacaccttttctccaacggatcacaactcctcgccagcaagggaacaaaactggacagagaatgagtttgacaaactgacagaagtaggcttcagaaagtgggtaataacaaactcctctgagctaaaggagcatgttctaacccaatgcaaggaagctaagaaccttgaaaaaaagttagaggaattgctaactaaaataaccaggttatagaagaacataaatgacctgatgaagctgaaaaacacagcacgagaactttgtgaagcatacacaagtatcaattgccgaatcaatcaagcggaagaaaggatatcagagatttaagatcaacttaatgaaataaagtgtgaagacaagattagagaaaaaagaatgagaaggaatgaacaaagcctccaagaaatatcagactatgtgaaaagaccaaacctatgtttgattggtgtgcctgaaagtgatggggagagtggaaccaagttaaaaaacactcttcaggatgttatccaggacagcttctccaacattccaattcaggaaatacagagaacaccacaaagatactcctccagaacagcaaccacaagacacataatggtcagattcatcaaggttgaaatgaaggaaaaaatgttaagggcagccagagacaaaggttgggttacccacaaagggaagcccatcagactaacagcagatctctctgcagaaaccctacaagccagaagagagtgggggccaatatttaatattcttaaagaaaagaattttcaaactagaatttcctatcccgccaaactaaccttcaggagtgaaggagaaataaaatcctttacagacaagcaaatcctgatagatcttgtcaccaccaggcctgccttacaagagctcctgaaggacgcgtgaaatatgcaaaggaaaaaccagtaccagccactgcaaaaacatacgaaaatgtaaagaccatcaacactatgaagaaactgcatcaactaacaaaataaccagctagcatcataatgacaggatcaaatttacacataaatgtaaacgagctaaatcccccaattaaaagacacagactggcaaattggataaacagtgaagacccactgctatgctgtattcaggagatccatctcacgtgcaaagaaacacacaggctcgaaataaagggatggaggaatatttaccaagcaaatggaaagcaaaaaaaaaaaaaagcatggtttgcaataccagtatctgataaaacagactttaaaccaacaaagatcaaaagagacaaagaagggcattacataatggtaaacggatcaatgcaacaaggagagctaacaatcctaaatgtatatgcacccaatacagaagcaaccagattcataaagcaagttctcagagacctacaaagagacttaagactcccacacaataatagtgggagactgtaacacccccactgtcaatattagacagatcaacgagacacaaaattaacaaggatattcaggagttgaactcagctctggaccaagcagacctaatagacatctacacaactctccaccccaaattaacaaaacatacattcctctcagcaccacatcacacttcttttaaaactgatcacaaaatttgaagtaaaacactcttcagcaaatgcaaaaggatggaattcaataaaatctctcaaaccacagtgcaatcaaattagaactcaggattaagaaactcactcaaaactgcacaactacatagaaactgaacaaccttctcctgaatgactactgagtaaataacaaaattaaggcagaaataaataagttttttgaaacttaagttattgagaacaaagacacaatgtaccagaatctctgggacacagccaaagcagtgtttcaagggaaatttataacgaaatgcccacatgagaaagcagaaagaactaaaattgacaccctaacatcacaattaaaagaactacagaagcaagaacaaacattcaaaagctagcagaagacaagaaataactaagatcagagcagaactgaaggagatagagacacgaaaaacccttcaaaaaaatcaatgaacccaggagctggttttttgaaaagagtaacaaaataggggattggagccaagatggccgaataggaacagctccggtctacagctcccagggtgagcgacgcagaagacgggtgatttctgcatttccatctgaggtaccgggttcatctcactagggagtgccagacagtgggcgcaagacagtgggtgcagtgcaccatgcgcgagcagaagcaggacgaggcactgcctccctcgggaagtgcaaagggtcagggagttctctttcctagtcaaagaaaggggtgacagacagcacccggaaaatcgggtcactcccaccccaatactgcgcttttccgacgggtttaaaaaacggcacaccaggagattacatcccgcttggagagtcctacgcccacggagcctccttcattgctagcacagcagtctaagatcaaactgcaaggtggcagcgaggctgggggaggggcgcccgccattgcccaggctagcttaggaaaacaaagcagccgggaagctcgaactgggtggagcccaccacagctcaaagaggcctgcctgcctctgtaggctccacctctggggacacggcacagacaaacaaaaagacagcagtaacctctgcagacttaaatgtccctgtccgacagctttgaagagagcagtggttctctcagcacgcacctggagatctgagaacaggcagactgcctccttaagtgggttcttgacccctgacccctgagcagcctaactgggaggcaccgcccagtaggggcagactgacacctcacatggccaggtactcctctgagacaaaacttccagaggaaccatcagacagcagcattcgtggttcaagaaaatctgctgttctgcagccaccgctactggtacccaggcaaacagggtctggagtggacctctagcaaactccaacagacctgcagctgagggtctctgttaacagagggtctgtttgttaacagaaaggactcttagctgagggtctgtgtgttaacagaaaagacatccacaccaaaaacccatctgtacatcaccatcatcaaagaccaaaagtagataaaaccacaaagatggggaaaaaacagaccagaaaaactggaaactctaaaaagcagagcgcctctcctcctccaaaggaacacagctcctcaccagcaatggaacaaagctggacagagaatgactttgacgagttgagagaagaaggcttcagaccatcaaactactatgagctacaggaggaaattcaaaccaaaggcgaagaagctgaaaactttgaaaaaaatttagacgaatgcataactagaataaccaatacagagaagtgcttaaagcagctgatggagctgaaagccaagacttgagaactacgtgaagaatacagaagcctcaggagccgatgcgatcaactggaagaaagggtatcagtgacggaagatgaagtgaatgaaatgaagcaagaagggaagcttagagaaaaaagaataacaagaaacgaacaaagcctccaagaaatatggcaccatgtgaaaagaccaaacctacgtctgatttgtgtacctgaaagtgacgaggacaatggaaccaagttggaaaacactctgcaggatattatccaggagaacttccccaatctagcaaggcaggccaacattcagattaaagaaatacagagaatgccacaaagatactctcgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactctacaagccagaagagagtgggagccaatattcaacattcttaaagaaaagaattttcaacccagaatttcatatccagccaaactaagcttcataagtgaaggagaaataaaatcctttacagacaagcaaacgctgagagattttgtcaccaccaggcctgcccgaaaagagctcctgaaggaagcactaaacatggaaaggaacaaccggtaccagccgctgcaaaatcatgccaaattgtaaagaccatcgaggctaggaagaaactgcatcaactaacaagcaaaataaccagctaacatcataatgacaggatcaaactcacacataacaatattaactttaaatgtaaatggactaaatgctccaattaaaagacatagactggctaattggataaagagtcaagacccatcagtgtgctgtattcaggaaacaaatctcacaagcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaaacaagtcctgagtgacctacaaagagacttaagactcccacacaataataatgggagaatttaacaccccactgtcaacattagacagatcaacaagacagaaagttaacaaggatacccaggaattgaactcagctctgcaccaagcagacctaatagaaatctacagaactttccaccccaaatcaacagaatatacatttttctcagcaccacaccacacctgttccaaaatcgaccacatagttggaaataaagctctcctcagcaaatgtaaaagatcagaaatcataacaaactgtctctcagaccacagtgcaatcaaactagaactcaggattaagaaactcactcaaaaccgctcatctacatggaaactgaacaacctgctccagaatgactactgggtacataacaaaatgaaggcagaaataaagatgttctttgaaaccaacgagaacaaagacacaatataccagaatctctgggacacattcaaagcagtgtgtagagggaaatttatagcactaaatgcccacaagagaaagcagcaaagatccaaaattgacaccctgacatcacaattaaaagaactagaaaagcaagagcaaacacattcaaaagctaccagaaggcaagaaataactaaaaccagagcagaactgaaggaaatagagacacaaaagacccttcaaaaaattaatgaatccaggagctggttttctgaaaggatcaacaaaattgatagaccgctagcaagactaataaagaagagagaagaatcaaatagatgcagtaaaaaatgataaagggtacatcaccaccgatcccacagaaatacaaactaccatcagagaatactataaacacctctatgcaaataaactagaaaatctagaagaaatggataaattcctcgacacatactccctcccaagactaaaccaggaagaagttgaatctctgaatagaccaataacaggctctgaaattgtggcgaaaatcaatagcttaccaaccaaaaagagtccaggaccagatggattcacagccgaattctaccagaggtacaaggaggaactggtaccattccttctgaaactattacaatcaatagaaaaagagggaatcctccctaactcattttatgaggccagcatcattctgataccaaagccgggcagagacacaaccaaaaaagagaattttacaccaatatccttgatgaacattgatgcaaaaatcctcaataaaatactggcaaacaaaatccagcagcacatcaaaaacgttatccaccatgatcaagtgggcttcatccctgggatgcaaggctggttcaatatacgcaaatcaataaatgtaatccagcacataaacagaaccaaagacaaaaaccacatgattatctcaatagatgcagataaggcctttgacaaaattcaacaacgcttcatgctaaaaactctcaataaattaggtattgatgggacgtatctcaaaataataagagctatctatgacaaacccacagccaatatcacagtgaatgggcaaaaacttgaagcattccctttgaaaaccagcaggacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttacacactaataacagacaaacagccaaatcatgagtgaactcccattcacaattgcttcaaagagaacaaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccacactgcccaacgtactttatagattcaatgccatccccatcaagctaccagtgactttcttcacagaattggaaaaatctactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactacctgatcgttgacaaacctgagaaacacaagcaatggggaaaggattccctatttaataaatggtgctgggaaaactggctagctatatgtaggaagctgaaaccggatcccttccttacaccttatacaaaaattaattcaagatggattaaagacttaaacgttagacctaaaaccataaaaaccctagaagaaaacctaggtattaccattcaggacataggcatgggcaaggacttcatgtctaaaacaccaaaagcaatggcaacaaaagccaaaattgacaaatgggatctaattaaactaaagagcttctacacagcaaaagaaactaccatcagagtgaacaggcaacctacaaaatgggagaacattttcgcaacctactcatctgacaaagggctaatatccagaatctacaaagaactcaaacaaatttacaagaaaaaaacaaacaaccccatcaaaaagtgggcaaaggacatgaacagacacttctcaaaagaagacatttatgcagccaagaaacacatgaaaaaatgctcatcatcactggccatcagagaaatgcaaatcaaaaccacaacgagatatcatctcacaccacttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctaggactagaaataccatttgacccagccatcccattactgggtatatacccaaaggactataaatcatgctgctataaagacacatgcacatctatgtttattgcagcactattcacaacagcaaagacttggaaccaacccaaatatccaacaatgatagactggattaagaaaacgtggcacatatacaccatggaatactatgcagccataaaaaaggatgagttcatgtcctttgtagggacatggatgaaactggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagctttaggagatatacttaatgctaaatgacgagttaacgggtgcagcacaccagcatggcacatgtatacatatgtaagtaacctgcacattgtgcacatgtacactaaaacttaataataaaataaaaaagattaaaaaaaaaagaaaaagaaaaaacaaaaaaaacccaaatagaccgctagccagactaataaagaagaaaagagagaagaatcaaatagacacaataaaaaaatgatgaaggggatatcgccactgatcctacagaaatacaaactactatcacagaatgctataaacacctctacacaaataaactagaaaatctagaagaagtggataaattcctggacacatacaccctcccaagactaaatcaggaagaagtcaaatcccgaaatagatcgataacaacttctgaaattgaggcagtatttaatagcctactaaccaaaaaaagcccagaaccacacagattcacagccaaattctaccagaggtacaaagaagagctggtaccattccttctgaaactatttcaaacagaaaaatgactcctccctaactcattttatgaggcctgcatcatcctgacaccaaaatctggaggaggcacaacagaaaaagaaaatttctggccaatatccctgaacatcagtgtgaaaatcctcaacaaaatactggcaaacctaatctagcagcacatcaaaaagcttatctaccacgatcaagttggtttcaaccctaggattcaaggctggttcaacataagcaaatcaataaacgtaacccatcacacaaacagaaccaaaaacaaaaaccacatgattatctcaatagatgcagaaaaggccttcaataaaattcaataccccttcatgctaaaaactctcaataaattaggtgttgatggaacatatctcaaaacagtaacagctatttatgacaaacccacagtcaatatcatactgaatgggcaaaagctggaagcattccctttgcaaaccagcacaagacaaggatgctctctctcaccactcctattcaacactgtattggaagttctagccagggcaatcaggcaagagaaagaaataaaaggtattcaaataggaggagaggaagtcaaattgtctctgtttgcagatgacatgactgtatatttacaaaaccctatcatctcagcccaaaatctccttaagctgataagcaacatcagcaaggtctcaggatacaaaatcaatgtacaaaaatcacaagcattcttatacaccaataacagacaaacagagagacaaattatgagtgaactcccattcacaattgcttcaaagcgaagaaaatacctaggaatccaacttacaagggatgtgaaggacctcttgaaggagaactacaaaccactgctcaaggaaataagagaggacacaaacaaatggaaaaacattccatattcatggataggaagaatcaatatcgtgaaaatggccatactgccctaagtaatttatagattcaatgctatccccatcaatctaccactggctttcttaacagaattagaaaaaaactactttacatttcatatggaaccaataaagagcccatatagccaagacaatcctaagcaaaaagaacaaagctggaagcatcatgctacctgacttcaaactatactgcaaggcatgctgtaaccaaaacagcatggtactggtaccaaaacagagatatagaccaatggaacaaaacagaggcctcagaaataacgccacacatctacaaccatctgatctttgacaaacatgacaaaaacaagcaatggggaaaggattccctatttattaaacggtgttgggaaaactggctagccatatgcagaaaactcaaacgggacccctcccttacaccttatacaaaaattaacacaatatggattaaagacttaaacataagacctaaaaccataaaaaccctagaagaaaacctaggcaaaaccattcagtacattggcatgggcaaagacttcatgactaaaacaccaaaagcaatggcaacaaaaactgacaaatgggatctaattaaactaaagagctccttcacagcaaaagaaactatcattagagtgaacaggcaatctacataatgggagaatatttctgcaatctatccatctgacaaagggctaatatccagaatctacaaggaacttaaatttacaagaaaaaaacaaccgtatctaaaagtaggcaaaggatatgaacagacatttctcaaaagaacacatttatgcggccaacaaacatatgaaaaaaagctcatcatcactggtcattagaaaaatgcaaatcaaaaccacaatgagatactaccacatgccagttagaatggcgatcattaaaaagtcaggaaacaacagatgctgaagaggatgtggagaaataggaatgctttgacactgttggtcgaagtgtaaattagttcaaccattgtggaagacagtgtggcgattcctcaaggatctagaagcagaaatactgtttgatccagcaatcccattatggggtatatacccaaagaattataaatcatgctactataaagacatgcatacatatgtttattccagcattattcacaatagcaaagacttgaaaccaacccaaacgcccatcaatgatagactggaaaagaaaatgtggtacatatacaccatggaatactatgcagccataaaaaaggatgagttcatgtcctttgcagggacacggatgaagctagaaaccatcattctcagtgaacagaaaaccaaacactgcatgttctcactcataagctggagttgaacaatgagaacacatggacacagggagggaaatatcacacaccagggcctgtcggggggtgggggactaggtgagggatagtattaggagaaatacctaatgtagatgtcgggttgatgggtgcagcaaaccaccatggcacgtgtatacctatgtaacaaacctgcacgttctgcacatgtataccagaacttaaaacataattaaaaaataaaataaaatacaataaaaatagccaccttctcattttttaacataagcggtctcacatctcaccagagctactgtgccattgtttaaaggttttttgtgtgtgtgtgcccatttgtaatgtgcaaagtaatcaaaaaagaaatcgaaacttttcagaaaaaaaagtgagagtactaatattaatgagataacattaaaataataaatgttaataaggacacaaagcaactgaactctcatatactgtcagtgcgcatgtaaatggcacaactgttttgaaaagatttgacaatttctttaagaactaaatatattcctaccttaacctggcaattctactccaaaaaaagtgaaaagatatatccataaaaataccgttaccggaatgctcacagcagctacattcataagcaccaaaaactggtaacagtccagatgtttgtcaacaggcaaaaggattaacaaacctcagtatattcatgcaatggactattactcaggaataaaaaggaatgaactattggtccatgtcacaacatggataaatttcagaaaatggatgggtaaaataagcctatgtaggaaagagtacatactgtatgcctctgtttataatatctggaatagacataactaagctttggtggaaaacaatcaaaataatggggatttactaggatgggacaaaaccctgtgatgttaataatgttctgcatcttgactgtggattgcactggtgtatccatttactggaacttatggaacacttaagatttatgcactttactgtttccaaattttacaaagaactgaactctagttaaatgtatgcatgccgatgacatattttgaagaaagtattcagatacctgcaagttactttgtatagaactaaaaatggctggatttatgggtggaagaaaggatgaataaatggaaaaacatgataaagcaaatataggaaagattaactatcaaatttagatggtggatacatgggtattcaccattaactttttcaatgtttcttgtatgtcagaaaatttgtaataaaacattggaggggggaatgaatctcaaaaatattaaataaatgatataaattacgtatgagttatttgttataactgagaaagctgaccaaattattatttctggattaggttatagactaatttgcttcatttaaaaaatatttaataactggccttttaaaataaatcttcaaatctatatatttaaataatatatttaaaaccctctctaaaacacacaaatacgtcttctcagaaaaaaagctcactatataagacaaattataatctttgaaatgtctatgataagcattctgaatcagagaatctcaaataggctgaaaaaatacatcttaacttctaagtaaaatgtagcatttccttcaactatggatataggtaagaaaccacagaaatattatcagtaactgtaactttttccacaatgaaaatcgtactggaatcacctaaggaacttaaacattaatatacaaattctattccacccattcctttttaattgatattagttcaatacagcctttatactgggacttttaaaagtttctcaagtgattctaatgtgcagataaggttaaaaaccactagtggaagaatgaagaatagccatgcttgtttcagtccaaatattaccagagtcacacttccatacaattcacaaaaagaaaggcacccttaagaacattttcatcataactttgactttcgttgttaatgtttaaaataatattctattttattcctgcgataaattttggaatttttgaggggtatacaataaatttgtaagaaataaaacccattttatacaactaacccacggaagaaacagttttatcttcaacttaaaatagtcaatttgtaaccatattcaacaaagtatatgagtcaagcactgaagaatgcaatcctcacttacatcacatcaggttatacaaaattaagtaaacaaatattacataaatgaatgatgtcctaatacaattcaatacagcaactctgaataatgtgtctactgagtgttacagtcaatactagatactggtgatactaacaatatagaagatgcaatagagtatgctgattaagatcaaaaactatagtcaagtaagtctcatccctagctctaccacttaacattagttgcacctttttagcaagttacttacctcccttagcatttgtaatacggaaatagtgttaatcctcacaagatccgagtgagataatgaagataaaatgtcaacttcttagaagagagtaaatgtataaaaattgggagccattattataagacatatagtactcatcctagagaagttcacagcctaatgaaacaatagcaaaatatctgtaccatattggacaaaggattgatacccttaatatatataaggttactaaaaaatatttaaaataaaaatgaacagataatagaaaaaaatgaataaagacataattccctaaaaagtatatacacgatcaaataaaaatatccaaactcttaagtttagagattatttcactaattgcagagcttcagagttacaggatggtgaaaaaaaaattaagtatatgggtgtaggtctgaattctccaaagtagcttttccatcattaactgagatagcttaatcccatggtttggctcctctcttacagcactccccttattagttactgcttttattaccaaacctcagtgaagaggtcagcattttgtaggtcctattgaatctttatccatgctcttaatccactgcagaataatcaagagtggttttgttctcactctgcttcattgattttattctaatctttcactggtccctaattagtgtggttatattttaaaaatcctcttttatgacaatgacaattttttattctcttctttgtacctttccatattttctataacatttttataatcctagaaaagcacatgtagaaataaaaataagtgatctgttacccatcctttcatttcctgatgctcacagtatagcaaaaaaatacattaaagttgattcaatgaaattaacattttagccatgtacaggactacgttggcttctctgatataaaagtacccagtttgcaaggaaatcacagctctcatattgatggtaacaaggtatttgatcttaagcaagacatactcagcctctctaagctttaacattgcacctataattgtggatggtacaagagacaacttctaaggtaacttctaaggtgacttccaggtatagaagtcaagaattctaaatataactgtttgaaaatccatgaagtaggtattgctttccccttaaaagtaccaagattccctttcaagatgccaattattacaatgtaatctcatttattaccaattcttgtttataaagagattttaacaaatatgaatacatccattaaatataaatgtctatttatatgatttaatatacaataacaatttactctttgatcaaaataattttcacatcagaatcaaaaaccttttatatgagaatcaaaatatttggattacattatactttatatctccatgtatttaaaggagaagtaaaaaatgcattataaatctactattattgtctaaaatatgggagaaaaactgcaatagtcaataaactcttgagttttggaataggttttgaaccacaaattcttaacaggaatagcaaaacaactgtacagcttaaatacagtgaagatccaaaaattacaaccagaactttgcaactgttagatctgctaatcaaagcaaaatgccgtctgttttgtgcatacatacaataataagaataaggaaatgaataaaaatataagagaaaaattaaagacaacagaaattagcaacagaaaacaacccttaaacatacatacataaggctgcatgccccaaaagcaataaactgtcttataggaagaaaagtatcctagaaatcaagttaatgcagaagcctctcagctaagccttagcatggtatgagaaggaaaagaacacaattctcagcaacgtcctgaccttaaaaagtcccccaaaacgggaggaaacatcgtgagaaagttaggaaacataaaacaaggtgagaataaataatagccaagtacattctacttcgccttccacaaaaggtttgcagcaaaggtccgtgttgaaggcacaccaacccaccacagactttaaaaaatctatttgttggtatgccttaacgtggggtaggactgcaggagaaaaaagaggcacaggccaaacaagagaaactagaaaactacctctataatactacatgcagagggagcacagaagctaagtttaacagggaaatattccctgatatggaatctaatcttcctatggtgaaaaatcaaaggtcagaagaataaaaaaaaagaattaatcttaaggaaaaaatagacatctccacatcatttgaaaagagcaagcataaagatattaagagatcaatccaatattaagttctcctaaggcacttaatgaaattctctgcacctaaatcagaaataccctgactgttccgtatacgggcttgtccatgaaaagatctgtatttgggatctctgtgttaatgcacctgaaagtttctgaacacacatactgaaaagatttctgaacaaaccatccaactagcatatctgacatttaaaccttgagatcatgaaccattagaaagttactctattcaaaggtcaccaaatcacgaacttacaaaaaaactaaatggcttattctacttcctgaatagtcttataacactgaagcaccatcagttgcttttggcaatgcttgccaatttttatgctggaagttatgaatgagtcaaagaccccgataattaagcagggtaaggacagggttggttattcttgctcatgtttaataaatgaaataaaccactcgaaaactgggtatcattattctaaagccttaaaatgtatctcatttttgaattattgcttaagaagcacaagttaaggaatcaggagataaacaaaaattctgttagttccatgactagggaatataattttagtcaaggagtcagtagtttggcttgtacagtgttattttccactgctgaattacttgtacacttaggtctaaacattttaaaaaacatattagtacctatcactgaaatattgagaaacacttacattctgcaaactaggtacaagtgcagctaagaagtcagtgcctattacccactgttagttatacagtagtcacagaaaatttttcaaatagtgacaagtcaaaggaagccgacagcaactgtgaagaagattacaattttctaggggcaaggaaataatttgagagaagcctagtgcagcctttgatttataaattgattttaaagaaggcctgccaagttatactgcttaggaggtcatatataattgcataggttttgttcaatcttgaaaaataagtcaaataatcaaaaagcaaacatcagaattttctttaagaaggtaaatttctgggccataagtatgattggtatatttggacccttgtcctacatatcttcatctgtagcatacaacaatgacaattggcccaagcttgagatttccccagaaggcaaagccagagacaaggacatgtatggggaaaatttattggaagtgaactcagggaacgaagagtggggactggaaagagtgaaacacagtagggaatgccaaaataaggatgtgctttcaagctggttattgtagtcaatggtagctatgtaagcagctgtagaaaaagttcctcagaattcctgtccaagaaccagaatgcaagagcatttttttccggcttccatgccactggctgaattgccctaaaggggattcagtctctcacacttacaggtgtagatatgtatgtatgccttgtggcttccacaagcatccttggtcttacagcattagaaaatccctggggcaaaaagaagtaaagtggcggaaccgcagtgaattgttttgtcaacatacaccaccacgaagctgactgaagcaatgtggttgagtaaaaagtgctgcaaaaatcaaaaccagaatgagatatcatctcacaccagttagaatggcaatcattaaaaagtcaggaaacaacaggtgctggaggatgtggagaaataggaatgcttttacactgttggtgggagtgtgaactagttcaaccattgtggaagacagtgtggcgattcctcaagaatctaaaactagaaataccatttgacccagcaatcccatgactgggtatatacccaaaggattataaaccatgttactataaaaacacatgcacacatatgtttattgcggcatgattcacaatagcaaagacttggaaccaacccaaatgtccatcaatgatagactggattaagaaaatatgccacatatacaccatggaatactatgcagccataaaaaaggatgagtacatgtcctttgttgggacacggatgaagctggaaactatcattctcagcaaactatcgcaagcacagaaaaccaaacaccgcatgttctcactcgtaggtgagaactgaacaatgagaacacttggacacagggcaaggaacatcacacactggggcctgtcgtggggtgggggggatggggaagggatagcattaggagaaatacctaatgcaaatgacgagttaatgggagcagcaaaccaacatggcccatgtatacatatgtaacaaacctgcacgttgtgcacacgtaccctaaaacttaaagtataataataaaaaaaaaaaagtgttgcaaagaaagtgaagttggaagcaagaattacctgatttctaggcagaaaaagacaagcaactgacataagttcaattccctaagagctaagtaaatatattttgaaaactttttacacatgaaataaatttatataaagctttaatggtagtaaaagtgttatccttgaaaaatctagaacgtgtgtatacataaaacaacgtccattttgagttttattattgaactttgagagttctttatatattttaaacacatcagatatatgatttgcaaacattttccagtctagcttctaattctcttaatagtgtctttcaagaacagaaatttttaattttgatgacgaccaatttatcaatttgttcttttttggaccttgcatttggtgttatactaagaaatatctgcctagcctagagttacaaatacttttccctgtgtttcttctagaagctttatatttatgtttttacattgtttataattcattgtaagttaatttttgtatatggatcgatgaggtcattttcacttacagatatctaattgtctcagcaccatgtgttgaaagactgtccttcctccactaaactatctttgtaccttcgttgaaaacagctgtctgtatatgtatgggtatatttctgaattatctattccagtgatctacttgtctacctttatgaaaataccatattatcctgaaaaaagtagatttttaagtcttgaaatcaggttgtgttagtcttctaactttttttctttttcagagttattttaactatcacaggacctttgcagcctttgcacatacattttggaataattctcttaatttcggggtttttttgttttttggtttttttttgagatagggtctctctgtcacccaggctgaagtgcagtggcatgatcacagctcactgcaaccttgagctcctgagctcaactgatcctcccacctcagcctcctgagtagctgggggactacagacacgttgcccccacacccagctgatttttgtattttttgtagagacgaggtttcaccatgttgcccagatggtctccaactgctgggctcaatcaatcttctcgtctcggcctcctgaagtgttgggattacgggtgtgagacactgcgaccagccataattttgtcaatttcttaaattaggaaggaaaaaaaaaaaaagagctgttgggattttgattgcgaatgcattgaatctctagatcaatttggagaaaattttactagccaaattctgaaaacaacccatatgcccatcaaaaggtgaatggccaatatgtggcacatccatcaatacttaccaaaaaaagaatgaactatattacatgctacaacatggttgaatctccaagtaattctgccaaggaaaaaagactggcacagaaaagtacccagaattatataagattctgtaaactgcaaacaaatcaatggtagcataaagcacatcagtagttgcctgaggccctggtggaaggttgagaaggactaaagggagggacaataatgaggaaggaggtgactgggatgtgatggatgtgtttattatcctgattgtggtgacaatttaatgtgtgtagatatttgtcaaaactcagcaaagtgtacaccttaaatacattcagtttactgtatgtcaattatatctcaataaagctatttaaaaaaccagtcattctgatttatgaacagtaatggatctacacagcagtagatgtgtagaaactaacagcttctcgttagttttctcaacaattaggaacttaaaaaacacaaaatagtaacaatcctcacagtaaggacaaagaatgcagaagagttcatacacccaacacttaaaagaataaaactgtattacttttatatgtatatatagatacataaatgtatatatattggagaagagggaaagatatatgtgagaactaagatgttagctatttccccataactgttattaaattatgttgagctaggaaagcacttaagcaggaaagtatgaacactgccaatctcagaatgtaacgcttattatctttaaaagcattttgttactttcataatacctgaagtgaagtaataatgtcagtcacttaaccagatcttagagtataatatcttcatcttaagtactattatttccagtattttaataatttccacaaagtgccagaatgtgatcttttgtgctatgatgacacttaaattaatagcataattttctggtacttgcaacagttgttttcaattctgatcttttttattcttccctataatacttgcagataaatcccctaataatcctttttttttctttatctttgggggattccaaaagtataaatagaataagagaatattaagaaataaagctttttaagaaatttaattttagtattacttgcaatatctccatcaggtatctttaaacaggtgataaatctaaatattcagttcatttgaagttacttacaggcttcattgatgttttcaactctttctacaggtatatctgtaactgaatttgtctggtcaaacactgttatctgtcaagcaatccgtaaagaacatatcacctcttctatacttaagttattttgactataactgatcactgatcacccatcatttaaaaaatctgctagtgtttttcattcatgtgaaaagggtatctgcccacaggaccaaatgaaacatagtcacctcatgtgtagccatcacagagtaactatagcaattccacttttgaaaagtgaaagaaagaaagctcctcaagcacatgctgaaaataagtaggtactttcaatcttatccttagcatcctatattgtgtactattcaaaaagaaaaaaaaaaaaaaaaggccaagccaattagtggaccagaaaaaaagaaagaaaaaagaaaaaagactagctttttgttccagttaggttatacccaaaagggtgctaccatccataaagaaaaaagttagctatatctaatttttcatcactctaaaatcaatgaaataaaaaaagatcataaaaacctttacatcacataagttcaaaactaatagaaagaataccaatttgctgctagctgacaatgttattctcacagccagagccaaggaactaacagtgacatcatttaattaattaattaatactgtctcagtgtctctactatttacaaactccaatattttccaattctatatctatctaataaattggtttggcttctaaaattcaacttttattttggcacaaaaagatgaggggggaatattttctagctctaagtattaacatttcttagtgatgctaggaggtcatatttgaattaacactttttgtcactgaagtatctatcatttctgtcttcaacctattggatctttattctccaatgggcatgtttttcagaaatgaaggtttaaaacttataaacacatacatgcatgcatgcacaagcatataaacacccacatattccaaattagcccctggattataaaaaaaaaaattcaaatagacatatagacatagtgtatcaatttaccagagtccctgtcaggaacaaaacatgagagaatgttaataaattatactcgcattaaaataaatttgcttcactaatattgaaaaaaataatttttatccaaaagtattttaaaatattgatcacaacattaaaggagtcatttggagactgatactcacatgttttctcttacttaggacacctgctatataagaatattttactgagttactccaaaccataacattaagcattaagttcatcaaagtactcacaatatattaaccaataaaactgtgaaaccaaacagtatttctctcaacatctcttatctctgttatttatagtacaatgtatatgtagtcaccttccacatccacgtagcctggtgagattgaccatgatttttcattaatcatccctatttcatttttgagcatagaaaactccttgtttactgcacgtaaataaaatgctgtctttaaagtctttaacatatacataattcaatatatagataataattgctgtctgacagatatgtgtgtataaatccacaaatatacaatatcattacacatggagagagactacttctttgcccatattagctctcactatattaagagttcaccagtttacaaactgcattaactccctacatcactttgtacatttgtacagcattttacaattcaaaaggattttcatatacaacaccccaatttgttctcatatgtaatctatgacacagatattctttctctctttttataaataagtaatttacacaaggtcatgcactggtaaagacagagccagaatttgatccagactttaagactctgtattctctttatactatgctacagtggctgagcagatatgaagcctactgtgaaggtctatagtaaagtcatatttattaacatcagcaagtaaatcagttaacgtaccaatgaaggcatttgattaaaaaaacctgttccatgcaactagtttctttgggtctttaaattcatgagagagctttgccattccacaagtatctcatgtgctcaaaatgcacagatctcaaatcttctacaaagcttaaaccaatttttataatcttagaaatcaactgaaactatagcgatataatatcttctttaatctggcaagtaagtgagattcaaagtcatatatccatcccactgcccataaaacacatttacttaagaaataccattggtattttagtatatggaggttgaatgagttataacaacttagaaaactaaagaaatggaaaagttttttaaaaagtgacctctaggaataataaaaacgagggtgacaaaggaaaattaatcaccgttaaccacattacattagacataagtaaccacattacttatatctacataggatacaaatatcttcataataatgtaaacactgaatattattatccaaattacaatatagttatttggggaaagcaggaagataggatggagtgagggtaggtggagaaaacaacaaactcctcattatctacggtggaatttagtagataatgcctaaaacaaaaagtagtataaatacaaaagcatgtaatgacaaattaactactgaaagaatcagctaacagccaaaagtgtttgcccctggagaaacaggtgagatgaaggctatgctgttttttctaaaaagaaaacaaaaacaacaacaacaaaaaaccttgcaaacttaacttctgaagctatgttcacatatttgatcaaaataaaacattttaaaaaatcaatagcttgcccacatcctgatgatcaactaaaaaatacaattaaaaagattgcattaaaaataacaaaaattttaaaatacttaagaaaaaattcaacaaaaatatgtaacatgtagattaagaaatcattgctactttactgaaggacctaagtaaatgtagagataaatgtttttctagattttggccatattaattcttaatttgctggataaacgtaaacccaattgtaactaaaacccaagtaattctaagaattatttggaataacaaatgcacagtattatcaatgatattttttaaatgaaactttgttaagtgacaagcatagtttcaaaacaattatacaatgacacctcaatactactgcctaaataaaagcattaatggtaactttacattttaattttagttgcttgtatttttcctctttctcttcttttttagaatcaatataggctgctttttaaataaataattagctatcgagaaagaaaaataaaagaaaggcagctgataggtgactaagtctataggtcaaatgactgctacgcttatactttttctaccatatcacataatctcaataataaattttctttgttttgatccctttgatgtcttttcagccataccactgtggcaacagtaagactgccaacaaagaaaaagcataagaaattaaccaatttaagagtgaataaaattccactactgtaagtcctccaacaaaaacagcagaggaaaaaatggaaagaaaaagaatccagttggtcaaaagaacttccacaggattattacagtgaaaaactaggggatttgccccaacactgtgtttgttttaaactcgatttatttttctttacatatccatgaaaagaaaaaaggttcaccatttccatatacagtacatacgaactgaggcaaagggcagttatgtgacttgtctgaataatacaattaaattaatgactgaattgtaaacacaacttagaatacccaaatgctagtatactgctctaactaatggataatgctccctgctatgtaataggactgactcctttaattacaaattcttcattcaccatcagattatcagccagaggctttatcattagttttgctcttcttgcattcatggcattattccaagaatgtaagatttccatgataaaaaaatataaagaccactatttactacaccacactgaacctgaggattccaactgcccatggcaagaatacttcaccaagcctgcacttagtggcacacttacaggcaaaaccgcaattttcacatccatttttgcttgatcagtgacctggacaaaaggaatttcgtttttttataatcataatatcagtgcacttaaaatctgacatttaggcattctacagtctcagtcaagagtatttacacatctgacctgtatgtaaaattctaaagcattaaggatatattttgaagcatttgtgatgttagaaagtagaataaaattatgagatgttctcatcgtctatgctaaaatctataaaagattaactgagcaaacaaataaagcaaatatctagaaagaggtgcttagacacttgtctttgagaagcactttgtgcttctttggcacatatcatggcagcaatagtagcagcagccttgcccttggtgctgatttcttactactctaaatgtctcctctgagccagaatacactggctgttgctgatcatgctgtgagacacctgcactggctactaggcttgtcatgacgcacaaaaccctaccatcttcagcttgacattgtgcaagttataattattcatccaaatgaatatgtcagagcagcagcagcagacctctcatcagagcaaaagaaaaatacatcaaaacattatcaacccagcaggaagacagggaccataaggaaaattacccatttttaatatggatgccacaaagccatgtctattatatcacaaaaaaaaaagaaaaataaagatcttccaagtttaaagtccagaaacactgactccaaagagaaaatacacaaaagcagaaagggatttttaaaaaatcaattatctgaaatctatttaccatctcttaaatctaactctgctattaaactacaacagtaacatttatattgcttgagagacaactgtttaaaaattgttttaaaaaaactcccacaagcagaattgttttcagccagccaattaaaaaagattacacataacaagaagtctcacatttcttcttattttcaaaacataaactatcaacactcttatcatgtctaaaagactcagagttcacactgctggtaccatccaaagtccttatgatatacagccagaatcttataggtaaatgatatattttttaaactttctaaatattaatggcatgtgtaaaagaaaaactgtgaaatcagcccccaacccgcacaaatgaagaagacacattcaaattgtataagcatatagaatataggggctatctcatacttaaatacttaaatagcaaaaatacctttctgaactatagcagaatatcttttcagaaaaatatatgaaagattttatttgaaacacaacagaaaccacaagagaaggatgtgaccagactgaaagttaaactctgtatgacaaaatatatacaaagttaaaagacatgccacagagatatttatatcccatataactaacaaaaaattagtatcaaaatatagataaaatgtttataataaaaggaaaaaaatataggctaaggctatggacacaataataactataaacttataagaaggtcagactaagatgagactaaagcttgcaaagaatatgcattgctgaatgggaatataaacttatacaacaatctagggaaggcaatttgtcaatactgcgtaaccccaaagaggcacatagcctgaaatccagcattttcacttctaggaaaaacccatactaaaagtctcatacatgtgcacaaggaaacatggaaggatgttcactgcagcactgtttgtcagaatttgtgaataaccttatcagtagtgctacagataaatcaagttgctgattaacataatggaataatataaagtatttaaaataaatatagtagacaaacataagattatggctaaatcactgaaattatataatgttaaaaaaagagactgcaaatatggcataaacaaatatggcaaaaagtatgcacggatggcctatataccaattttgggtaaacagttactacttaaagggagagaagcaaagaaaggaaagatgggaaggagggacagaaaagggggtcaggtcttagctattcttaaaacattttatttttaagacaaagagaaatatagatgtatctgaaccaaaagtgacaaaatattaacatttgtcaaatctgagttgtgataaaaggctgttttaatttatctgtattttgcttagaatttcagtatattccacaaattaagaatttataacactcattactacgaattctacattttcttagagttactacaaaacaaaacttgtatgacccaattaaacctgaaacttaaatttgaattaatattattaatataatatttattccatgcttatatgaataaggcactgagcatgtggatataaaatttaaaagaaattgccttcaaagactttccagtctagtagagagtcacaaactgattttgttaaataacaaaataaagtactaaacaatcttttcatggcattgcaaacttttccacagataaatgcctggggaaacttctagaattatctacatctaaaacacaaagaaactcataaacagtgtatttttcaaccttggaattgtgataaatattaaagtataatttagaaataacacctggaaagagtaacacaacctagctataatattttctcatgatctcacttaaaacatcaagattgaacttccagagccaaatagaaaatgtgtattttaaaaaaagggacatgggtctcatgaaatttttttaaaataaaaaaagaaagctataaaatttatgcataattccaattctttaatagaaaaaaaaatcaacatagtattttacttatagcatacatcaaaataccaaaagcaaattacaggctctctcttctctattttgctatgttttctcaacttccattgtggggagattgggactttaaaaaaaaaaacaataaaaggatatgagaaaaataatttttggataaatacaatatataattaaaatggcattttggccttgacaagactatttaaatcctattaggctttttatttttttactaatttcttatatatttactttactcatgtatttatgttttaaaatacaagcataattttttatttaaatctaaccaaaattttatagccaaaatgagtagcctccatttacggaatatttgtaaaatgtcactagaaatgttttttctctttgcctaagaataaaaatgttctctccattttgctatcaactgccacaatttacttggtgaaagaactatgccctaactaatcacattgtgccacatccttaaaaatcacacacatgaaatggtgatagtactaccgataatcataccaccttatatctatgttatagtttacagtgcacttctaaaaaacattatcttgctaatatcatcaatgtactgcgaaattcaactgacagaagcaggagaatcttctgtattctttactcaaaatattgaatgttctaaagcacaaaataaaagaatataatcaaagtttaaagatgaactaaggacaaatactttaaaacaataaaaatggagtagaaatgccaaggtttatgttttcagtcataattcattctcctctgaaaaggattctctgatattatgtaatcaatgtcaaaagttttagcaatataaaacatttcactcaacttttcagttaccattcactgctttctacagagttctttggaatttaaatttaaaggaaaatgtctgtcaaaagtgcttctgcatgtttactgaaaatgaagcataaatatctacaggctggatggtgtgtgtgtgtgtgtgcgtgtgtgtgtgtgtatttatgcatgggtgtgggtgtgagtgggtgtgtttgtgtgtgcatgtagagagggagaaagaaaatggacattaactgtaaggaaatataaaagaagcattatagaaggtgtgtttataaataaatgcttaaggaaaactgaaaaaacaaagattacttcataacctataatgactacctaagtaaaaacagttacagttggccctacccacggattccacatgtgcagattcaaccaactgcagacagaaaatattcaaaaataaataaataacataactatttacagtataacaactacttacatggcaaatgcattgtattaggtattataatctagagataacttaaagtatacagaagagtgtgcacaggctataaacaaagtcccatttatataagagatttgggtatgcatggattttggtatttacagagggcccaagaaataatccccccatggatactctgggacaactgtactttttaattacttaaaacaaatttaagaatttacctgaggagaatttacctgaggtgtccaggaggcacaaaatggaacaggaaaatccacaaaataatctggtgattctgcaggatactattaaaaaagcataacattagaccatttttgcttctgtgtgttaatatcactgaggtattttagaaaaactagatgtattaggggccgggcgcggtggctcacgcctgtaatcccagcactttgggaggccgaggcgggcggatcacaaggtcaggagatcgagatcatcctggctatacggtgaaacctcgcctctactaaaaaatacaaaaaattagccaggcattgtggtgggcgcctgtagtcccagctacttgggaggctgaggcaggagaatggcgtgaacctgggaggcggagatggcagtgagccgagactgcgccactgcactccagcctgggcgacagagtgaatctccatctcaaaaaaaaaaaaaaaaagaaaaacgagatatattgggggaaaacatattattataactgaaaatgtattacatataaatatttttgctccactttcatagtgatgtgaagagcttatttatagtcaacctatggaggtgcaagtttggtgatttggaagtgccaaagcaatcggtgttgagtaaaaggtaatgaattaagtcagcgttgtgtcagctgctgaagttatgatttgaggaatgaaccaaactggatctctgtttatctttaaaataagagatcaaatgagttgatatttaattttcttctagtcctaaatttaatttcaaatagcatcagtcactatttaaataggcagtatcagttaaaggaattaagaaatacacaaacatgaatacatatagctgtcaatttaaaaaattattttctatattaaagatattaattttagcaagaagataaaaagaatgaaatatcttctggcttattaagaaaaaataaaacagtttttagcaagaaaaacctttgaaagattgctaaatacaaaattatttcttcaactagtcatataaaaactggcagtcatgaggacaaaccaagtttttaagttaacaaaggcaaaagataaaatttcttaaaatcaatttccttattagagaatcatacttaatgatttctctataatccaattctgattcttcaaagtcacatgtaattaaaaatacccatttcttttcattaaaaagctaaatgtactgaaagaaaattagttttaggaaatctttcatttgacaaattattaaaagaagttttaggctttcacttttttcagcctcttatttttcagtactctgctgggtaagtaaaagggaagaaaaaaatcactacagtatttaacaaacatttgaaatcaacactttcaaaaaaattaacatttagctacaataataagttggctaaaaagatttactatcaatatacactctgactaatggaatctggctatgtagaactaattaacacaaaggcaaatagataagaaatcatataaaaatattccagtggtctacttctggaaaaaaaaaaaaagaaaaaaatatcatgctgaaattaaaagaggaagttctatttcagacaattaaaaatatcagatgatgtgcttcagagtatcattgctgtaatcactggaaaaacaatttgtatgccatatttaaaaatcgtgattatctcaaagtaaatgtagacagagacctcagctttctttggttccagctctgctaactaagttgtatgatcctgaacaagtcatttaatttctctggctgtttcacatgtaaaaatgacaaaactcaactagaagtgttacaaaatctcttttccttctaaaatgtcaaaattctttaaaaataatgtgcacttgaaacctctgtgggtcaaaaatggaaaatttagttcattttgagttgctatttatcttagtgatgctgacaatgaacaatatcaactctctaacttcaatgaatcatcaatgtagataaaataagactaatgaaatgtttactgtatttggagtagatacacaaagtaaagtatctgtggccccattaagtacatacacagctcattatgctaaaagagagtaagatactacattcaagtaggattcagtatagtaaatggtatcaatgtcctgatatggaaagagatccacaaacagttaaacaaaaaagcaagttagagtaaatatatgatcctacatatataaatgagtccagtatgtagtttctgagataatgacatctttcaaatatatttttatatttgtaatacaatatgtatataataaattagactgatctttatgcaagtggctttacttcatatctgagttaaatgagtatttgcaatatgtgttaattacattcatgtgcaaaatcaattttgtttatataacaaacctcacataacagtacagagcttaaaaagaacatttatgtaagtctggatgatttatcataaatattaaaatataaactagcatactagatattcattttcagaatagcttctgaattataatagtattaactacagtgtagatgactaaatacaatataagaaagtaacttgatcaaaattaagatacttttcaataataagttgtataggtatatataaaaccactgacaactaattgtcaaaacttttcctttcaaaagtaatttacaacaacaaaagctccatatcatataggaatattaactgaaaaataagtatagtatttaattattttcaagtaaaacatagttctccaaatctcatttgcagaaaatcaaatcaataactaaaaaaaaagattacataatattaagtatatatttttatcacacacagtattttttagactctataatattaatatattctaaaacaaattttaaccaagtctgttctgtgactagactacctaagcagtaaggctgatccccaagtaaatacatacaaattgcagcagagaaagagtgcccaccctctgatgcatatatgtaatttgtttttcaagtagtactgatcttgattgaccaaagctgaggaagccctgggctgctacttttgtaaagcaaaggtaattcagtactgaatgcactgtaagcattgcataaaaatatacctataaaaaccaaaaaatttatctggtttacttctacttatttattatttacatatttacttttaataaaggacatctagtcaaaataggtatttgttttctttgtgagtttcttggagatcgtgaggggaagtggtagaattgggaaagtatgtattccagaataaatagaacaaatgcatttatttactgtatatttaaaaaatcaagtaacagaaataaaggtttgtgtatttatgaaaaaagcctactttgaggtatgttattaataaaaaaaattcagcattccacttaaaacttagtttggattaagattttgcataatatactcttaacatacagttaacgtttcaactattagtgtagttgactgacaatcgcaggcccaatttctttttttttccctaaaatttttgtttcctaaaatatttttcagttaatattcctatatgtggagtttttgttgttgtaaattacttttgaaagtaaaagtttgacaattagttgctggtggttttatatatacctatacctttttcctaaaaaaaaaaaaaaaaaaaaaagacttcctggttttcttcaaattctcatgtttccccagtgattactaggtaaatgattaatatgctgaacttgtttattctacttatttgtccaaattcacaatctagaactaacttttttttcctaaaaaaaaaaattatcacatctcaaagacagctatggtgtatatatgaaagctaagctaaattgagaaataaagattctaataaatcataccaacataagattcagttacatgcttttgtttttccaaaacagttttttttttctttttttgccaaattccttcccagcttaaataaagctttctcttctcttttgcaagaatatctataaaagtgcttcgtaactacagatgttgcaaaactgaccctggaaaatattctccagagaaatactaaaagcatcatcttatctaccttgaaaaagtatagaaaaaagcagacaaaatggaccatattaaattgtcacaacctcactctgaatactgccaataaatgaactaaatgtcatcaacttggattaaaatcttgtaggtatagttaaaggcagcacaaatttacagcaacatcttcttaggaagtagaagagcttgtaaaaatgaggacagggtgtatttaaaatctttagttttggtcttcatagaaaaacggctaattttactaaggtacaaaatataaacaaatagagctttgaaggaaatgacagaacccttgccactggcaacatgtgaccctttggaaggataaaggcaaatttctcttaaaaaaaaaaaaaaagcacacttttacaaactaaaaaataaaaatcttttcaatttaataaaaataattatctaacttattttacaaataatgagatttccatcccactaattttttccaagacttatcacatatggatcttaaaattagacctacatacatattctgtgtgtgagagaattagtcatttctcaacctgtctgttatagaaccactataagatatcaacttttctgtgtcatccagtacagctttagatattaattttctcttgtggaaagcttaaatgccagacacatttttaaaaaggacaaacacaattgatcttttcatcactacaatcttctgaaaaagagttgattgattgactccaagaataattaaaaaaaaaaagttggacatcctggttttcttcaaattctcatgtttctccagtgattactaggtaaatgattaatatgctaaacttgtttattttacttatttgtccaaattcacaatttagaactaaaaaataaagatgaaacaaccatgttttgtgccaataaaatttgtgattatagatcactatcctataagggatctataaatagaggcataacctctgcaaattcttaaaatacttaaaaaaccccagccaaagcaaacaaactataaaaaagtatgcatatatgttgtttgtgttagggagtggggatcacagataagaataagaactacaaaagaaatttatagtaacagctgaatgcaaaagattttctcagtacaacttgggatagtggaagtgtccactgtcttctacatgttacatgtaggatgttacaaaattaacaccatggtactctgagtctataaaattgtaactgtagtatttgttataaagtctgtattttgagcaaatttggactaaaatatgacataaaactgtctaggcttttggaaacgtggtgaataaattctttgaggctttccaaaatcaatgttttaaagcatgatatatgtatttttagatgtaactagcacttctttacattgagagcattcacagagttcatttcacaaagtattttctgatcacaataacagtttaacgaggcacatacctttgccttcaacttgagagtgattaaatgctctctaccagaagcatcttctgcttttaacttgatggtactgaagcaggtatccgcatacacaagtctggtgagcagaggagaataaaaaatgatcacaccggggagagctggagaggggaactggagatggttgaatttgaaatgaaaatatttgctatattcctattaatccattataaaaatcagagcaatttctgcatgccaaccctttctgctgctatagatttactgccgttcatataccagcctagcacttaatgcagtcatatatctctggattatttacaatgtgtgtcaaggctcatgctgtggtcagtgagcactatgtttcagttttccatcactggaacctttggcacacacagcatgttcctgtcagcctctacttatgtacacattaaacttcctgtcaaactctttgatccatttctgtagtttcatacagtatgagactttaatgctccctttgtttttctcctcaatgaacttctcctatattatcaataatgttaccgtacaaaaatctagctggtatttgttcatatactcaaattgatcctctaaggaaaatgctgtataagcacaggtacagcctggtctcctaacaataaattttctttctgcacgatatatagcttctgacacttaacctatgcatgtattcaagatgactaatattctaaacatatagcacaagcacaactgctttggctttaagttaccctaaatgcatgaattttctacaatggaaaccaatatcctttgaaatatataattctgtaaaaatacggtcccttgagtagcataagctactgccaaaaaggttcaaatttagcagtatatttactagtgaactgggcatatggatatttttgacatttttacaatgctattctcttataaagataaaaagtagtctaagagtattgcaaaacttatcacccaggctgatagtaagacccattggagttcagaatataagcctcctaacttaggaaatatattttttaatatcactatatgccatttagatactgaccaggtactatataatgataacatgggctaatttcaagaaatgcacaatgaagttgtgaaacactgtaatgaaaatatgtctaaatctgaagatatctatcttcaataatacaatggaaattttatcataatctgtagaaagtctagggtcttagaaaacaaaactattctagaaagtgttttatacacataaaaataacaatgactatattttctttcagctatatctgtaaatgcttcacctccaaaaaaaattagaatgtctttatcacgttttaccatatgactctgaagttcagatatatcaatacctgactcttaaaactcccacacttcagattcaagatgttaagcacatgcatttatattctctacttccagaaaaattaatcatttaaaaaatgtttcaaaggtataaacctacagttacaaaaaaagaagaaggaatagtattaattgaagcaaacttcaacaacttttaggaaaatgtagagtagttaaaagagcactggctgataaaacagaaaagaagagagaacaaggactccaggcagaaacagctggcaaaaatgcagtgttcaggatagagagtatgactgatatactggcagaaattatgggaatttttaagtgcatgataaaagggggaagaagaaactttaaaccaaattataaacaataaaactgcattaaaaatggtaattactctgccactaacttttcagttaaaaatatttatgtagtcgtaaaaaattaaactgttactagttacaatttttagaatccaagaatacgcaatgctaaaagacttaattatagttatagagactaatgtaaatatatttgactactacaatttaaaatgaagaattgacaaaaattgggaagtagaaatgggaaagataccagaatggaaaattagaaacaataaaatctgtaattgctaatttgaaagtcaagagataccatctttaattgaatggacgtgaaagaggtttaagaaacagtaaagctaatggaaaaataaaaaagaaaagcaaaagagaaataatacattagctaaattctttttcattaatcagttcataattcctaaaaaataaagaaatattgcatgtaggcagattatttagaaacatggaagttgtaaacatgaatatttcaaagtatttgtctcaaagaataagactggggatagaaaataatatgggagactgcttttctttataagccttaaatagttcataaccatgatgaatataaagagggagagagaaggcatgcacgtttaagaggggtggaagaaaaaactacatcaccacctactactttctgtacttcacattgttgctcaccatcacaatgtttaaaatcattttttaacatctataaaataacacagaaataaaagctctttagttctttgtttgtaatcacataacataaaattatcatcatcccacaatgtaagtcagagaggtaatacactacagaaaaagtgccacgctcaaaaatatggcctgtaagccaaaatggccatgaggttgattttgttaaactttaagacgcaatttaaataaagcagtaaaaaacatttatactttcagattaatatcagcatggccatttaaaatcaaggtacattttacccatgctgcttcctggtcactttgtttggggcacagaaagaaaccttactgtgattattaataggttgagtatatgcgaccttgattgtcaattgccctctagtatttaacttaccttctccagtttggtaataggatccctgcccccactcaactctcaataaaaccaagttttagcaggatccacttcacccagctagtgacttgtcctagctgcccttgcaaggaggtgttggcatataactacattttggccagtggactacaagcacaagtgatgtgtgcttttgggggttcatttataacagaactatgctttcctctcttccctcctcttactctcctttcctgtagactacaatttggacaggccaatatgagctagcaaagatcatgaggacaggaacaacactctataaagcagtaaccaacacaacactctgtgatgatgaaggtatgacatatctgcactgtttaaaacggtagccaccagccacgtgtctatgagggactcaaaatgtggctagtgggttttttagttaagttaatttaaatgtaaatgtcaatagccacacatggctactgaacaatgcagtcacagcggatggctgagaaacaaaagaaacctggattcttgaatgtccttgtgaagagaggcaccaacccactcttgaccatctgcctacctctgaattgttaaatgagagatgaataaaattctaccttgtttcaactactgaggatttacatttctctttgttaatagtggcctagcctatgatataactaatagagactatttgtatcaatttatgacagaaaaaaatatcttggtgtttggtgtatggaagagatcttaaaggaaaaaaagagtgataaactcttacaagtggtatcaaatcagtttgtctaaggaagtctgtttcatgtcgggcataatgactcatgcctataatcccagcactctgggaagctgaggggaggattacttgagcccaagagttcaagaccagcctgggcgacacagtgagacctcatctttacaaaaatctttttaaaactaactcgtcatggtggcgtgcacctgtagttccagctattcaggaaactgaggcagaaggtttgcttgagctgaaaagtttgaggttgcagtgagctatgatggcaccactgcactctggccttggtgaaagacagagaccatgtcactaaattttttttaagtctatgttaagttggacgtctcactttagacaacaggaaataaataactttcattcacttaaataaaatataaatcattcaaataatgatttaggaaacaatcatcattggaaagctcaaatttttaaataaaatgctagcaataagcccacaaaataagaattaagatttgtatttagaaggagtttagatattatcactaagctaagcatattctaaaattgacaaagcaaatataaaactgaagtataaaatctaaagaaataaaatattttacttttggcactccactttgtatttatcatttgctatatttctttataagttaaattttttaaacatttaaaatgtttgttaataataaagcttcagggatgtttttgttgttgtccctgttaatagctgaatgtcaacaagtaaaacaaagtagaagaaatgtgttttacatagctcataaaatactgcacttatattgaccaagagtttaagttatttagcttttattttctttagccatctagatgcatttaagtagtattaacatcaacaggcagactgcttcaaaagacagactgaagaccttcatgtttgaataaagcatccaagtttccacttttattgccactctcaagtttaagcattaactacttcatatctggattactagaaacaatcttcctaatgcgtgtctttacttcgtctctgtacaccaatccattctgccttctgtgtctaatcttcctaaatacatttttaatcatatcaatcccttgctcaaaaatattcaatgagtccctatcacctgcatatagagaatcattagcctcgtagtcaagacccctctgtttagccctaatatgttaatccccttatgtgagccactgatctactccaaagtcaaaaaataaattgcacatttctattgctacaaccttgccttcaccattccttccctttaaaggctctgtatattccttcaaagcttatcccaacattcatctcctctaagaactctcctaaattatttgtagcccaaaatgcttcaaattcctccaaactcacattgctccttttcatgtaagttttagcttgccaaacacataataaactttttaataaggaatatgaaagctttatattcctatgtatgtgtcagtgtaccatgttccatgtatatatgacaatgtagaggatgttgtcagactggttcacatttactgattcatgtgtaagtttcaaacaatagctgaaagcaaactgttttaattaaatactgttaagcatattaccaacctagaaaaacatgattttttttttactactagataatttgcagttattcaatgacatggatttatgtatgaagaaaaatcatcctatttataaaggttttcagtttaactgaaaaccatactggttaatgtctatgctattatgttttacaaaaaattatcattattggttgtaattaagtcataacactaattaagtactataaaactcagaggcagtctgacagtcagttgaactagtatctcaacaacttgatacacctactttacactaggaactatatgagtcacataacatgcctctttgaaatctttattattaggcattattagcttcctttaaaaaatgaaaaaatgtgacttaaagagattaagtttgcccaagatcacacagcagataagcaagaattaaagctctggtataattattggaatgaatttagtatgaacaaggatctccatttccccaatatgttaaaaatcttcaaatgcattaacaattatacaaaatatcaccattaatcagcttctaagatagtgggcttaatcaaaaacctaccaatatatgttgacaatctcccagttcgcacatcagatttagtaaaactcagttagctctttcccaagacaaacttgaaaagttcaactagttgaagtgtactcactctagactctaaatgataaataatatattgtttaaaaaggacaaaagtatcagcacatttctactagaaccatttaacttctgaattatctaggaacatatgattattacaataaatgtatcttataaagtgtattagtctgttttcatgctgctaagacacacccaagacttggcaatttacaaaagaaaaaggcttaattggactcacagttccatgtggctggggaaggctcacaatcatggtgcaatgcaaggaggaacaagtcccatcttacacggatggcagcaaagacagaataaggaagatgcaaaagcagaaacccaataaaaccatcacatctcatgacacttattcattaccatgagaacaatatgggggaaaccgccctcccacaacacatgagaactgtgggagtacaattcaagatgagacttgggtagggacacagagtcaaaccatatcattctacccctgacccctccccaaatgtcctcacatttcaaaaccaatcatgccttcccaacaggccccccaaagtcttaacttatttcatcattaactcaaaagtccacagtccaaagtctcatctaagacaaggcaagtctcttccaccgatgagcctaataaaatcaaaagcaagttagttacttcctagatacaacaggggtataggcattcgataaatacagccattccaaatgggaggaattggccaaaacaaaggagctacaggccccatgcaagtccaaaatccagcagggcaatcaaatcttaaagctccaaaatgatctcctttgactccatgtctcacatccagatcatgctgatacaagagttgagttcccatgaccttggggagctagacccctgtgattttgcagggtatggcacccccacccggctgagttcatgggctggtgttgagtgcctgtggcttttccaggcacagtgtgcaagctgtcagtggatctaccattctggggtctggaagatggtggccctcttctcacagctacactaggcggtgcctcagtagggactctgtgtggggactccaatcccacacttcccttccgcattgtcctaacagaggttctccatgagggccccacccctgcagcaaacttctgcctgggcatccaggaatttccatacatcttctgaaatctaggcggaggttctgaaacctcagttctggacttctgtgcacccacaggctcaacaacatgtggaagctgccaaggcttggggtttgcaccctctgcagccacggcccaagctctacactggcccttttcagccacagctggagcagctgggatgcagggaaccaagtccctagcctgcacacagtgctgggaccctgtgcccactttttcctcctacacctccagggctgttatgtgagtggctgccgtgaagacctctggcatgccctggagacattttccccattatcttggggactaacatttggctccttgttacttatgcaaatttctgcagctggcttgaatttctgctcagaaaacgggattttcttttctatcacattgtcaggctgcaaattttttgaacttttattttatgctgtttcccttttaaaactaaatgcttttaatagcacccaagtcacctcttcaatgttttgctgcttagaaatttcttccaccagataccctaaatcatctctctcaagttcatagttccacatatctctagggcaggggcaaaataccaccagcctctttgctaaaacataacaagagtaacctttgctccagttcccaacaaattcctcacctccatctgagaccacctcagcctggaccttactgtccatatcaccatcagcattttgggcaaagccaagcaactagtctctaggaagttccaaactctcccacattttcctatcttctgagccttccaaaccgttccaacctctgcctgctacccagttccaaagtcgcttccacattttcaggtatcttctcagcaatgccccactctactggtaccaatttactgtattagtctgttttcatgctgctgataaagacatacccaagattgggcaatttacaaaagaaagaggtttaattggacttacagttccacatggctggggaagcctcacaatcatggtggaaggcaaagaggagcaagtcccatcttacatggatggcagcaggcaaagagagaatgaggaagatgcaaaagcagaaacccctgataaaaccatcagatctcctaagacttattcattaccatgagaacagtatgggggaaactgcccccgtgattaaattatcttccaccgggtccctcctgcaacacatgggaattgtgggagtacaactcaagatgagatttgggtggggacacaggggatacagaaccaaaccatatcataaagtgatatgtatttcttccaaactgggacatatttgagactgacaggggccaaaacaaaaagcataaattagggctgtcctaggcaaaatggtatgcatgataagctactcaaagcaaaagtatttggtactttcaactctaggatactcttaataccaaacagaaaatcttgttaaacacaaaggactgtttaattcttatttttttaataggccattctgtaaaacaacatgggcagaagttaacagaaacccaccaagacatcattttgtatcacttacctttgtgagccagtgttacacccaaaataacccagacctgtcataccatcttcacgttaacctttggggaagttgctgttttgactgtgtttttatagaaattgaaataagaacagaaattataacaatagcaatcaaacttaaggtcaactactaattctcaatattatttccatatttctttctaaggaaagaaagggaagctttcatcttattttaaatatttctttttcttttccaacttagaatttgtataatgtctaatcctatagagttgattagaaataccaaatatgtaatttaaaaacacagcaaggccagcattatctaacaaggatttttctgtatcagattttatgattatactgacaaatctacaagattattatttagagtgtaaggaaaatacagacttattgacagagtctagaaatcattaagattctgtaaatacatttaaatcaatctgtcatgcaaatcattgtgtgtgtcatttcaaaagataatttaaattaagaatttagccagctcctcaggcggggccttaaacagtagcaattctagtatgtggacagcacagttcaggtctcagctttagatcagcaggtcctgaaacccaattttatcagtgtatgtgtgtaccagacctaatttaagagttaagccataaaaataaagttgataggttttgtcactctaccagacagtaatggattaacacaaacagaattatcttctttggcttctcacaatccatgcacaccacttctcttctgctaaaacattctttatttttaaacagtataaaacaaatgattaagtaacagcagctaaatcgaaagtcatttattcatcctaggccaggcatggcagcgaacacctgttaatcccagcattttgggaggctgaggcaggagaatcatttcagcccaggagtgtgagactcgcctgggcaatacagcaaaaccttgtctcttaaaaaagaaaaaaaaaaaaaaagagagggaaaaaaagtcattcatccaccttagtaactataattaaactataatctttcacaaatctacgcaacagattttgaaactctccaagggtgtgttaattttgcaaatcgtccattttattcgtggtaagatactttttattagtttcaccctcaatgtgtgactatctccaggtagttggggagaatttattaaaggctccatatcggagctgccctatgggacaactctagggagcatcattcacacagaatgcctgagtggtgttatgtacccagccctgtctatatacacttgttttatagaaaaagttggaaataaaaatatttatcctaaaatttatcctgagaaattaaataagaatacatgaagcacctagcacagtcagtggcacacaacagaaacttcataaacaacagtcccagtatgtaacaatcttagtgaaaaaaggaggcaattatattgtgataagtgacatatgatagagatattcatatccttatttttggctttcatctattatcgaagttagaaatctgttcctttttctcctacattagaacaatgggtataatacaaagcaaaagacaacactttctatttagctcacaaaacacttactccatattttatatacttgactatttctcttataactctcaagaatcctataattatactctacccttcttatcgtggtcataattcagtattactatgatcaactacctaaattctgactcttccactagatataagttccatgaggaatctttattgttgttgctcttgttgacagggtctcactgtcacctagactgaagtgcagtggtgtgatctcagctccctgcagcctcgacctacccaggctcaagtgatcctcccacctcagcctcccgagaagctaggtgcgtaccaccacacctaatttatttatttatttatttttgtattttgtagacacggggtttcaccatgttgcccaggttggtctcaaactcctgagctcaagtgatctgccccacctcagccccccaaagtactgggattacaggtgtgagccaccacacctggcccatgaggaatcttaagtcttgccttatgtatccttagtgctttacattataggaagtccataaatattattagcagggtaaaaaaatgagtgattcaaaaatctcatatcacatccttaacgcttcaactgatttttcttattgcacttctctcaaccatgtcagatccactgaggtaggctgcctcaaactcaccatctcaatacaacagaaataaaactagaacatttcctctgtccttgacaaaccctttctacatttccaactatgctctaaaaaacaaatattaacattaagcatctgaagataagtcaaaataatatttctttattccatcaatctatacctaaagaatgactaggtccatgacatcaatgcctcaaaactaatcataacctcagcaggaactgctgctagggcatctcaactttttgcttgtcttccctgtctctcctcaccattgttatgcttaattttatttaaaaggctccaaccatcccaaatcctactcaagactaatgtcttaataaataaagcctaatctcatgaataaatatcaaccagtcctcaatatcataatatagtacacttacaattatatgtaacatctatttctggcctaaatggaatagcttgctaaagaccaacacttctacagtgaacaactaaagtaggctgataaaaagaaaatgggggaaaaaaattgaaagcatcaaagaattgctaaactgaccaggccttgaagggccaaagtcctaaagaagagggaacagaagtgaagtaagccaacattctgaagccattttcctcaatatatttatcaattctggcacagggcaagagaagaaggatctgggcaaagagcccagattgagagctgctattaagtggcaaaaaaaaaaaaaagcatcatttccgccaatctcttgaggatagagagagaaaaataacagactggaaaggccagaatctggggaaaggtaggcccagaacctggcctaacattctgccaatattccctcaaaacttctgataaatccttaaactgtagggaataagaggataaaaagtcaagcagaaaggcaatgaaaaacaagatttagaaagttcataatacaaggagaaattaattggaattcagggcctaccagtgagacaaagtctcagtgaataccccaggatctctgtgggaactcttgaaagactgctcctaaaagcaatgctaacaaaaagtgatagagctttgtcaaaaatggaccccaaactgtaattgagaggtcttgtggagacacaaaggttagagtttaggatctaccaggggggaaatcccaatgaatatacctggctcttgcttggaagctctaaagggttatagcttgagacaggaagggcagcaatcagaggtagactgacctctatgaaaactacaacccatcctgaacccacttgggccctttgccaatctgttcccagtctatcttcccaggaagagaaaagctaaaccctgtacagaagaaaataatatcatctggggcctctaaactattttatgtgcaatatccaacagtaaacatagcactacatagcactgaagtctgaatagccaagggcaaatgcagcaggggcaatgagaaaaggtacactaactagtatgcctccaaattaagccagtttcctcatttatctcctttcaccagttcttttgaaagaaagaatagttaccttattgagcagagacaagatttaagattttacattttttgttacagaacatttcaattctgtattgaatcagttatgaaaataaagaaaagtagagaaaaaccctttagttttcaaaaagtattagggatgccaaaatataagatcatatgacaataaaccatacacaaaaaagtgaaaacagaatgcacactgtccaccttcccattcacacacaggtaccttcataccttgacctctgacctcacctacaactgggatgtacctagagatgtggggtagttctccttaccgcccaggttggaatccaagcacgggggtaaagcgggtgaggagaagaggctcgcttctctaccatccttcatgattcctgaccccccaatcctttttcccatttcctttgatgttattttattacagctttttaaatatttttaaaaaattatttaacccttggcagcagagactaaggaggggaataaggaattgcagactctgtatgactgaaataaagagaaataaaaacaacagaaagggatccagaatacaggactttgaaaaaaatacacacacacacacattacatatatatatatttttatatatagatttatatatatatttatatattttatatatatatatatatatatatatatatatatatatatatatatatatacacacacacacacacacacacacacacatatatatgtttggctaaaacaagaggaatttattctctcatagttctggaggccaggggttccacatctgttcactgggcaaaaatcaaggtgtcagcaaagatgtgctccctctggaggctctaggagagaatctattccttgcctcttccagtttctggtggctgccagcaagaaaaatattttaaaactatgaaagaaaatagagaaaaagaggaagaatttcaatacagcattaaaatctgttttaaaaaaatgcaaatggtaaagagcagtttttaaaatatgtaactaattagcttgtgtagttataacaaagtagacattaagacaagaatatttctagagatgaaaagaaacatgtcctaataacaaaagggaaaaccaacaaggaagatatagcaattataaatctgtatgtacccaataacatgactgcaaatagacataaagcaaaattttgaggaacaaaaacaattccaaaaattcacaatcatattgggagaatttaacacagctctctccagagctctcaggacaagcggacaaaaaaaaaaaataaatcattaaacatattggatatctgacacacataattaataaatgtgaggaatgaataaaagcaaagcactgtacccaacaagagattacatactcttcttaagtggaaatagaacacataccaaaattgacaaggtgctgggtcataaagcaagcctcagtaaacttcaaagtattgagataattaaaaggatgatttctgacaaaagtagacttaaactggaactcaataacccaaaaatctccagttgtttgaaaattaagagatatactaaataagtcaaaagaaatcacaatgaaaattaatatttttaactgatagtaatagaaatataacatcaaaacttacgggatcaagctaaaattgcttacaaatttacagccttaaattaatatataataaagtaagataaactggaaaaaaatcaatgacctacatatccatctcaacaaattacaaaggaagcaaatctaaaaaaattaaattcttaataagcagatattaatgataaaaaaatatacaacagagaaaattaacaacgctaaaagttgggtctttgaaaaaacttaaataattgatatggctcttgcaaaactgattaagaaaaattaaaaaggcacaaaaaactcatgtggaaagaaaaaggcagcatcactatagatcctaaaatcattttttaaaatgaacgtaggatgaaacagagaatgtgacaaaacaatctgtgttacaaatatgggaaagaagtacattgaagtgggtggaggaaatggttctaacctaagtaactgaaaatgagtgaagcctataaaggcaaaaaaaaaaaaactataaaaataagcattgtatagttgataaagttgtcacccatggaggtacagattaataattctgatagtgctctgcacgtatactgcaactgaacaattaagtaaatggataacagataatgggagctcggtttctccctgttggagtatgagatttcagatataccaagcaagtgggctacaaaactacatatggtaatggactggagttgtagacatcagtataaaatcatgtttaccttaatacagatataaatggttatatacaaaaacatttacaagtatgtacacgagttagtataaacacatttgttttccatttttcagctaagaaggcctagaaacaacaacacaccaatagcaacaagcacccatagtgcccacatcctagtttctaataccactcacaaataaaagcaaccaggactccttggaaaaatggctgattctaggaaagggcaggaaatatacaaaatttctttcagtgccagaaagtaaatacatgctaaaaaaaaaaaaaaaaaaaaaaaaaaaaaaaatatatatatatatatatatatatatatatatatccacaatgatgaggcctgtcaaaaggacacaggagccaactgaaagagctctcaatggccaaagctagaacaaattgagcaagaaaataaaatagtatttgattataacccaaagtataaaataaatatccatgagtccatagtatttcaaataaatgactgaaaaaacaaataaatgagagggaacaaaatctgagcagaaaaattccaaatctgtgtaaatactgtgccctaaaggaggtgtgagcgtaactgcccactcctgaagtgtgagctacatatagtgacttccaaagagtaaagtgtggagagagagaaaaaaacagtaactttacggtgcagaaacccgacaaatactacctcaccaggtaatcaagatcaagatcaacagtgatgagtcacagagataacatgtacccttgatatgaagagaagaatcacaggagaacaaaagtcaggtaagattagcatacagaaatataaatcctatatccagcatggctctaaaaagtgtgccaaaaatttgactctaaatttcctagaggccaagtcaaagagaacatagtcaattacatagttcacattattcattaagtggcaggttggatagtcaggcaaagcatgacttttctagcatctgaaacagaataaaacttctttcatggcttctcataaagatagtgctattatcatacaatggaagacatccaaacataaaatccctactgcatatcttaggactatttcatacaacatcctttaatccaagtcagtggcatcctcaagagcaattatacaagagagcaaaataaagtagctcggttctaatatccatgggtaaaactgagaaaacatataaaataagattacagagactttaagcagtccatctgcagtgaaacactattacatgcaatcgcgattttagtaaggttttaacagttgaaatccgaggctgtaatttttatcaagaccaggatttaaataacttggctcttaagtacagatcgtacacactttgactcttaatcagggaggcggtaaggaaaacggtaaggtaaagaagtattcataaaaaattaagtctacataaagtcatgactgaaggaatggctaacctatctctgcacataggtgcaccaaaagaggtatggcccactcagtcaaattttagtggttaaaacaaaagggaaaaaattgatctacacataagaagagaaactgttctaaataaaagccttttaaggaatataaagggaagtagaaggcaaaggcaacgaaaataattcttatttctgtaataatcacagtgcatttttatcacctctagaaacaaatttacatgggaacaatttggaactctaaaatatgtttaagtctctatttagtttttctttagttatcaggtaatggtataaaatatattaaaggacatatattctgcacttaagatatgttccttgttctcttttaaatggcgatttgattttctggttctttttaggttagttatcaaaaggccaactcatagaaaatagctaaaaaacagatgaataataagatgtttaaaacatattaagaaaaacttagtggtgaaaaattgcacattccttccacattgtacctaagttagccctcgatttatcttagtaatagggcaatctaaatggaaataataaatgaatactaaaatactattgataacggttaagaagtgataagaattgccgggcgtggtggctcacgcctgtaatcccagcactttgggaggctgaggcgggcggatcacgaggtcaggagatcgagaccgatcctggctaacacggtgaaaccccgtctctactaaaaatacaaaaaattagccggtcgtggtggcaggcgcctgtagtcccagctactcgggaggctgaggcaggggaatggcgtgaacccgggaggcggagcttgcaatcagcctaggcaacagagcgagactcggtctcaaaaaaaaaaaagtgataagaactaaaaattggcatatttttactggtgctttagctcaaagtagaaaggttataatacacttaataataaatgtaatgtttcaaagtatccacactaagaaggaagctaaattcagaaactgaatagcaaacaaatcatcacatactttttccaggtggtatgtggattaagttttaacaacttgcatacacgtttactgaacttaagtttctttatgcatcagttttaaaaaaaaaatcatttttttcaaagaaagctggatgattcttacaaaccctagttgctaaaatttaccactcaaattacaaaagcacttataatgttatatatatgtaaatttagacatgccaaattgtatattaaccaaaaataacaattattccagaaatactgcaatttttccagtctctttcatgtgtctcagcattactcttcaaacatggaaaatttagaatacagttgtatgttcagtgaaagtatctattacggtaacatcttactgtgtacataaaaatgtcattttttccaaattatatttagcattttactttgtaaggcaattttttatgatgatatccctctctttaattcacagcaacaataaggatcaaatactctagttacaattaaacactttgactaaaatcaggtataaactgctaaaactagaaatacattaagttaaaatatataaaacaaaggcatttaaaacatattttaaaacagacatacttatcccaaccaagagttcctatctcttcaataaggcttgagtagaactggggaggaggaggtagtgcatacagctcttgtctattctttaaggcaacttcctgtttaaaagaagaaaacctgaattagctgtggaacgcaagacaatgaactgttaatacctgattgcaaaacataatttcattatcttcttagtgcctaataaaagtgcctgtttttttacggaaatctggctgactcattcccctgctcatgaaaaagagacaagaaaaagttaaaggactgcactgaaggtcatgcaaaatgtcaatttttatgccatgaaaataacttgagattttaatattctcctggactattatgcctatcggagataaaaaaaaaatttttattaaattcatcctcaaggcttcactatggctctattcccatgaatatgatgtttgatatatacattttttaaaaagtacctctaaagaaaggcctgaactctaagtacattacctaaactgacatatttgtataccattatgaaccacatcctaacaaacaaactcattatcagaacaaatatccacatgctaatttttttcactgacttatactctgtactattcttcaagcaggtaagtcggagtattatgccatccatctggctagattacagtcccgttccttgctaggcctatctatgaaggctttaaaatgtttatgttctcccaaccaaaactaaaattttttacaagacacataaacatcactagaattgctgaagctaaaattaccaattattttgaagttaccaacctagatagacagcttatttggaaagtaaaaataaatctatctacaaattacttagatgttcatatggtctgaagtatcaaacggtattacaaaaagtaaataattaattaattaaataaatcagctacaataaataacgaaagtagatagggacaagttgaaaattataaacacttctgaaaaatataatcctaataaaaggttgtaatttttattcttttaagtatatgtttaatcttattttttaagtatatatcaattttttttaaccaggataggacactatcaaattgagatcatattagaaagaacagatattacaaaacagcacttcaaaaccaaaactattaacgggaactacttcaatttcgttctgaatctgctttatgatgaaaaaaaaaaaacaactgggaaaacagatccgtacagctgagaatatcaatatggatttaattagagggtaagctcctagaagacaaagtatatgctgccttttttataatataaatgactaatgttgcctaaaaatagactgatggtccaccaaaataaattcgtatttaggttgtgcaccaacctaatactatgaagattgtgctctactagttattaaataaaatgcattaatatagtatagtacttctttcaagatttgtttttattctgaaatattaattattgctattcacaaaaattgaaggtaaaaataaacctggataatagtaaaaacacttttcaatcttaggtttatgacatttatacactctaccttctattctgagtcaggtaagttactcctactgtagaaccgtaacagctaaaaaggcaaaagcagagaagcaacatattcttcacagaaaagaggcaaaggtacatagcggaaaggcttcacaaacagaagttttaaatactgactttaacaattcctattttgaggccttaggcttcagtggctcagctctaaaatagaaataaaataacctaccacttaggattattttaaatataggtaattgttcacttgttaaatatatactgaactcccactatatgcagtaattactaggaaactccatggaagatttacaacattttctgaataagttcaataactactgatttcatgtgagcatcactctcaacatatttattggtgattatagtataggaaccctattacttacaatacagcctaacactaataattcttatatctttaggtatactatcttaaatgagcaataaaatcaccaaatttgtccgtaatttctgaagaaagctaaaatacaggatttcatttttattcagaaattgaataaatatactaaatagatattgtaaatcagagatctcaaaattttattttagttttaaactaataagtgtttctccaaaattacatggccaagagagctgtgacttacaatttaatgaagttatttttgataagaagagtttaatgggacatgatatctatacttttactctggttcccttagtctctccttgtatttgtattgtttattaaaattataataaaaagataaaataaatgttgcaaacttttctccaatgtcaaggagatgtaaaccaaatatgcttcacttgttcactttacctttttaaggttattacattaaggcctttgatgtaatttgtaatcaagtttgataacccttattaattaggatttatgaactcataaatcaaaattcaaactttagaaattaattttaaactattattctaatctcacacatttaatcaaagtcctaccttagaaggttcttattagcattaaaaaaggactccagaaaacaacctagcaactaagttatcaatatgtagtagctgctgctaggaataaaatggtctcaacaaggatcacaaagaaatatcaaaactttccattgttagcaatattagtattgtaatttttatataaactaacaacacatagacaggaaaagcataagtgaaatataacaagtagaacataacaaaaaaccatactacaatgatgttaacattagaaaacagcattttcagagtaaaagtgatacaagcaaacaagtaaaaattctataatgccaatttgaattgtaaatatcaatacaaactcataattatattctttccaaaaagtattttttctcagttttgtccactgaaaaaacctacaagtaacagcaatgcacactcaagtttccagattgaggcatccaaatactatttcccacaaagaaatcatgattctttggagaaatggctgattacagttacggaataaaatgaataaatgaacctggggcaactggtatcagaaggcaaacaagcttgggttatattaaataaagagccaatatgaagggacttgtgctgaccaaaaaaatgggacaatttaagcatcaaaaagaaaatgactacaataaaaaaattaattaaatatataaaaatctatgagttcataaagatactttaaaaaaaaaaacactttagatccctgtgacagttgctaggcaccaactcattattctaaaaattggtttctgttttaaaaggaaaagaaacaagcacttatccagtctctccagtataagctgtacctcaaattaaccaaacaactgatgagaagttctctacagaagattttcaactaataaatgcagatgatggaatttttaaaattaccatttgtaaatcctaatgaaacattagatacaggcaatgattgttattagaggctaaaatcattaggtgacagtctgatgggaaactttatattgaatggatctaaacctattgatcaatcttaaatttactaaaacaggaaccaaggaaccatcagataccacgtggatcctcatgtaatataataaatacagagcaccaagtaatctcataagaacaaatgaatccaaatctgctgaagcctctagatctaactgccagattacaaagaaagtagaatatgttaaaagataaaccatgaatatcttacaagccaaatccagaatgtagaagattttataggacacctaatttgttttattcaacaaatacatggcatgaataaaaagggtgaggtaaagaggagagagatgatgttatacataagtaccttataagtcttatataaggcttaagagacttatcaactaaatataatgtgaggaccttgtttgcatactaatacaaacaaagcagctataagaaattattaactttattgaggttataataatatatttaaaaacagataaaaagcacttagctgttaaagagatacacactgacatatttacagagggatacatacaatatccagaatttcctttaaaatactatggtgtctttcttctaaaaaagtagaagaggaaataagattggcaaaatgttaaaatttggtcaggcccagcagtattcactataatcttccctcttcttttgtttatgttgaaaacttgggtaataaaatgaacttgggttttaagaaaataataaaatgtctacaggataaactgaataatcaagtattttatgcaacactgattaaacagtacatatgtaacagtatacataaaatgaagcctaataagtttttcagatatctgtagctatacacaaaattatttatacatcatattatatctttaagtaggactacctaatctcttcttagatgttaaactctctgctgataggccaggagtacattttatttcttcaccacctgcccaacactagtgtcaagaatacctagtttataatacaatcaaagaggttccttcgaacagttatgtccctcatgcagttcaagaaatgcgtcatctatatttatgtacacagtaaaagaaaacatcaaatgactgagagttaagaagacaaattctaataatgtcagtttttaaaggagttacaaaaaagaaatcaagacttgcagtatggtaacagtgtcagaaaaaaaaaaaattcttaccaaaagcatcttcaactccatcataaagctcattagatcaggagagtgctgcattctctagatcaaaatatttccaattaatttcatttgcacaataaatattctatccactaaaactgtaaaaaaatgtaggcccaagtgaatgtgaaaaaaagattagctatatctacatctgaaaactataagaaatgaagtatcggtcatcaactttactactcctaccaatttcattttgaaacagtaattaatgtcctcaaatctaatttgctgagatatattaaactgtgttagaatgtcacttaaaacctcacactactctgtttcttgagcactgtttactactgaatcccttgtcccccttgcagggcatgcgatgggagtgtggcttgcttcttcagtgccccgctgcataaacctctaggggagcatacagacgggcaggctgtggagctccaaccccacagcagtgtctaggggtgaatgtttacagctactgaaagcccagtgggtgtgtgttacaaggtgcttttttagtttagccatccataggcagcttgtgttagtcagctcaattagacccctgccttattgcaaggacaaagaactttctgtatcccgtggttcctgccttggtgtactggaaaaattggatcacatgtgggcttggagaatgagtgcaaggttttattaagtgcaagtagctctcagtagatgtgggagacagaagggagacggttttcccctggcgtcgggttgctcagcagcccaggctctcctccaaccaccctggtcgaactccacgtcattctgccggtcaatggcctgccggcatgctgaagtctatcggtgtgctcttgacatgctctcgatgtcctctcgatgtccagccacttgtgtgttcctccaccgatatatttctctcaacgtccagccacttgtgtgtgtgtgtgcctgctagggtctcgggtttttataggcacaagatggaggtatggcaggccagggtggtcttgggaaatgcctgtcctcacctaggtcagtgggcacaggcccgggggtggagccctcaccagggacccatctttctctactcagcacttccctgccgcccttctgtatcactactatgtctagcaaatctaacaacctcatcattactttttttaaagaagaagagaaagaagaggaggaggaggaggaagagaaaaaaaaagagaaagaagaggtataggagtgatgtgagtgggaagaggagtataaaatataaaaatcaggcaactctatgtaatttttaaaatctagtggcagcaataaattaacaattattaattaacaatatggtcattttttttatttttcccttgaccttaaaaactacctataattgtgatttttgtcctctcacaactaatccatattagtcaaaatggagacagtcattcattaaagtaaaacctgttataataaaatggcaaaaaaggaaataatctctaaagtacaataaatatttaagagttactattccatttcctagaaatccttcattcttaaaataactacagaaaaaaatattctcaagttttacattgttttcaacaatgcatgaacacatatgattcacatcttaacatagctttgagtgggtctgtgtagagcaaatccttgactatcccttcttctacattgcattttccccttagtttattacagatgatcaataaatgacagggtctggaaactaaagtccagaggccaaatccagctcaatactgtttttgtaaacaaagttttattggcatgtagccatacacattcacttacctcttgtctatggttgctataacggcagaattgagtagctgcaacagagatcttatggcttactaagccagaaaaacttattatctggttctttacagaaaaagtctgttgactccctggcccatatttactaaaattaaaaatgatacaagaaaagaatagtaatattcactgggactgtaaaataaaaagaagactttaacactgggttctacctaaccaattggggggcaaggaaagataaataattgggatttttttctaggaatcctcttgataacttgctggtgaaaaacagagtaatagatcttaatattagactacataaaccattttttcccatgctatttcaatatgtcaacagatgcatttcttaaattttagtgtacaatataaatagtcaaagggatggagacagggatggaaagaaaacagaaataatttgaacatatccttaaaaaaacttctgtaattatattgccaggatgataaccttcattctataaatcaaatagtttatctcctatacttctttgcagctttaatgctttatgggagagttactgtgattgtcagttatcatagataataacctgcctttaagacacagaaatatagaaaatcaggaaaaaaacacacaaatgcataaagcataaaaagaaaggcaattctaaaaactatttttctaaaagaagaattatattatgtcattattttgcttcagtaactgatttttttttctaatctttaaaggaattttcaggtagaggaacctaaacattaagaataaagaaattaatcctgcctattaacacactaagcagcctttaatttatctcccctcattatgcaagtacacatgatcctaaattatttctgccacatcttttctgttgctaatctaggactaaaatcccatttttgccacagatatcccacagctctaaatgggtctgattttttttccctatcaccaccattcagtctcagaagaaaaatcactgaagaagtgatggatatggataagggtgaatgcatttgaagaacctaaagtctcaaagatggaaatcgatttcaacacaaaggctgcctggagatctcctgaggacactgagatttaaaaacacacagagatgaaacctacaaaacttaacaactattaaaccagtttgttacaacattgtgcaaagcaggtctttaaagaacaataaatttagtaatttcttatcttcactgaaaacataaaccttttaaaaaggacttacctgttgtactattcgatggtatccactaagtattgttctcagctgccaactacataataatctaaaattttaatgagacaaaatggtttattcattgttcagaattaaaaacttatttgtatgctaacacaaacatgcatgtacatacaaaagaatgacaaacataatttggacaagttaataaaatttttaccactgatactgttcaaagtcttgtcttcaaactgttggtactaattttatttcaaaatataaataactgcaatcagtaaatgacatgcaaacagtacatcttgttttttaactttaacacatccgaagcaaagttttccactgaagtagattcttttccaagataggttaaataaaaccaacagttttgataacaatatatcatcaaatataatgtatcaaacatgtatttgaaaaagcatgtgtagcaatattatcttcaaattcccgattaatataactaaaaggatacattttatttttattttttattttttagagacaggatctcgctctgtcactcaggctggctggagtgcagtagaatagctgactgcaacctgaactcctaggctcaagaaaccctcccgcctcagcctctcaagtagctgggactacagacacccaccaccaagcctggctagaaagatacatacttctaattaattgtataagaagtgataagttaatgttcatccacttactggctgacctctgttgtgctcccgatactattaagtaactcttctaaggaattacttttagttacctacaagtaggaagcctctctgagttttccccaacatggccttttcaaactgtcacaactctctccattcttggtcttcaaatccccataaccatccctatctcctctcttagtggcagagtagttcattcaaatgtccattggtaacccctgctcaaaatgtgctttctctcccctgctaccaacttggtgacttcaattaattatccctttattgtggtatccttaatttatgttctgctagtttttttctccttaatgaattaacttgctcaaatatatatctttaaagaacatcataactccttcttgaatgcataccattctctaaccacctctttttcttcaaaatactttatactttcctcccactcatccaacacaaatggcttctgccaccacacaaaacttacttgcatctaacctatctctttgtaatcctcagcattgctaaccatgccttgcttaagcctctctttatttggcttgaaagactctgctgcccaagttttcctcttctctggtcaatccttagtctccttgtaagttcctctttagtgaccagtcctttaaatgttggtacgccccaaggtcttgtcactggctttctcttctaccccgctagacacagcaccaaaaagtctattcataatcaaggtctcaaatccttcatctgttgtaacttccacacacatctgcactccaggtctcacactctatttccacaccactacattactacctactaaatagctcctcttggtatttcacaccaaatatgccttaaaacaatctctcttctacttttccatctgtgacctcttctctagcttagagatctgagccgggaatttgaaaagcatcctctattcctttttccctcttaactacacttctgttggtcacaaaatcctctcaattctactcataaatatctctggattccttttcctccattcttctccagaaatatttagaggcagaattgagatttggggtggtacctaaattttcagtctcatatcctgactagttgtatctaccagcactcaatgttggtacctaatttaagccaggactgaactgatgtgactcttctcatataatgaatatacacattaataatatcagtcaaaagttggaaaaaaagttttctaatccttttgttctccctttatatacctgttcagtatttgttagtgaagtgtacacaatggctgtttactgctttaaatatttttttaaaaatgagagaactaatgtttaaaagcactttagtaacaggtaaatatttacaaatgctgcattggtttggaaaaatcagaaatgtttcttttggggcaaatgactaataagcattttaggcaaaactctagtcactagaatcaatttataccaaatgtactgcctgtcccaccaaaatgcaaaaatgcacgtttataactaaacaccatatcaccttgcattcttcagttgtaaatcttcaggcaacactatcctaaggtggaagtctcttccctgtggaaaatattgaaaaggatcactcaaatttttatctttcacttaatgctgagaagttaaacagaatcacaaagaaaagacaatgttttcctttattttctaaaaggtatcaattttatccacatctttatacttgttaaaatatatgcaacacaatattgcatttgagggaaaataactcaaaactgtcttacaaaaactttgtagttactgggaaatcaaaacactcagataagactttgtttttaaagagaaagtcactcacaaacacaagaaatattacaaaattgctaaccaggcccatagaagaaatttcagtgttatttcttagtaaataaatttatgaaaaaagaaattccttcaaattgctttaatggaagaaaaacatcacaatataaaataaggatatataacattatatagtcgttttcagcttactttctaaattttaataaaatgaaaatatatttagttacacaatctatacagacataagtgaaatacttgcataaatcagagtatatttaattctcccattagtgggcctctaacttttttgaaatcagtaacatattaactatatatttgaacaaacagaattttactcaagagtctttctaagagaagaaagacctctgagacatttattccattttactttcttggaaaagtgaatgggtaagtagtttaaactttataacttaaataggataatacacaggaaacttgagcaaaaatagcagaaaaagacaaacagaaatgtaatcttttactctaacagaataaaatgaaaaagtaataaaattctcaaaaaacaattaccatgtggaattttaacacagtctccctcaaagcagtttcaaaaacagaggaacacaattaaatgtaccctataacctttactttcatggtaatattacagttctgactttcattacatttaaatgtcctttaaaaaaatgaaacaaaatgtactactgaccttttcaaaaggtcaagtaacaataattcactgtttcattaaagcactaaaaggtattatgtagtaactttaacctaacattatagacatcccacacaaaggtgtaagaacaatttggaattcttaatttacacgaaaaatagaagaactattctatatagaaatctgtgctgttatctgaaagaataaaattccaaagtcccttatttgcaaagcccagccattttaaaaggtcaaataacatgtcacatgccacgatactttcctgattcaagaaaatgtccaaaattagctttttagttaaagtatctagaaatattaattgttctcaaaaaagccagattttccaggctttcaggcaacagaaatactaacagttacctaaacctccatctccccacatatcataccaaaaagctacatcaattaccatattaagaataaataaaaccacaaaaatcccatgttttcagccagaagacagggtacacgataaacctcaaattacctacaggaagaaaaatatgaagcactttccaatagaacctactctaggactcccacagcaactctttttagagtgctaggaaggtcaggaaaaaaaatgcatgggagagagactgggaggactaagtaagtgtaaaaaaaaatagtaacaagctctggtaaatcagaacactgacctacaaagagaagacttaatgtgcattaacacaaaagtcaaggagccagtcctgggaaagaatgctttagaggcagaagataggagaaaagataggtagagacaccttttggaaactgggtattaggaggaaaaagaaaagtgggaaacttaggctcttatacgagtaaataaaaaaacaactccttcccacccagcactcgccaacatttcatccattaaataaattgtacaataaataaaatacccaacagaagagggtattcttaaactagtaattttataaactattgcaaacagccaaaacgtccatgaatacaaagatactgtcttcatcaatgcaaagctactatgagacaaagaaacaaaaagagactcacaagatttcaggtgataacagactccatgcaaacaaaacccagaaaccataaacaaattataataataaatgaaataagtgagcatttgtatccagattcagacattttaaaactaaaatgagaaattgtattttaaaaaatgaaaagaaatgaatgagctgaataaacgcagggtgaaatgaaaataaagaaaaacacaaaattatatgaaagtgaaggaataaatttaaaaagagtccaaggaagaacaaaatgaaatacaaatgtcataaagggcaaagaaaaagcaagaaaattaccaaatgagaaaaaaattaaagaccatcagagaaaaggagttgaagtggaacacagacccaaaaaagtccagagtacatataattggagatcttggaaagaaaaataaaatagtagaaaaaaaaatttaaaaatataatccaagtacacttcctggagttccacataccaaaagggataagtggccacatgataaaagtgattcacaatgatcaactcttgagatatatcttaatcaacagattttcaaaataagaaaaaagtccagagtctctaggtaaaagatcaaatatatagaaaacagaatataattggaaacagacttcttaaagcaaattaaaaaatgaagcaagaatgaaatagaaaatgttaagaaactgaagagaactgcttctagctattatggagttaaaaggacaggatttatcttccctccttatttaaaaattggacaaaacatatgaaacaatgattttcagacattaaacaataggcagcgaggacagtgatccttgaaataagggaaacaaatgtgaaaatgcctaaaattgtctggttctatgatgggagtattttcaggctgcaagatagggatggacaaacaaataagagcataatattctccctgatgtgagaagaaacatgtgatcaaggggaggccaacaattgtacaattcgcaaggtatagtaccaagcaggagagaaatgcatggagagtagagaaatatacacagagaaacgccagcgaatttcagaggattcctgacaaggagtcttcagctgagtactgcttgctccatggatatgaggaaaacacccaaaggtgggaacgtacaggaacagtctgcaaaacaatctcaaagttcatacaaggctgggtatagccatgttccaaccagccagagtggaaaccttgcaatgtaagagccattaaatagagtgctcagaaggtgttgcttcacttgtagagactaactaccttagactaaagtctgctctgggtctacctagcaatgcttaaaagcttaaagcttaaaattacttggaaagatcaaactgtttccaagtaatttaactgtagctcacaacaaatctcaagaatacttagagaacaaaaatatctagcatgcaacaggtagcattcattatgtctagcatccaatcaagatataccaagcacatatatttcctgcaaagaagcaaggcaatacccacaatgaagagaaaaatcaagagagacataaaaatggcacagatgataaacctgatttaaaaaattaaaacaattaaatttcatacgttcaagaaggtaaaggaaaacatgagcgtactaaatagagacaggaaagatgtaaataaagactccctcaaaaaacataatgtttgagatttttaaaaaatatgctagatagtatcaacagcagattccaccttacaaaagaaggtattagtatacctgaagacatatcccaaataaagagaaagacattgagggaaaaaaaaatgaacagaccatgagtgagttgtgacaacttaaagtgacctaaatgcatgtatttggagtgcccaacacagaggacagaaaaggaggaacaaaaaaaaaaaaagaaagaaagaaaaaataatggcagatgttttttccaaattaaatgaaaatatatactcagagatccaagaagctccacagaccttacggaggaaaaacatgaaaaaagctacaccaaggtacaacacacatcaaagtgactgaaaccaatgaccaaaaagaaaaatcttaaaagcagccagaggaaaaaaatattctatttacagagaaacaaagaaaagagcagagatttctcgtagaaaacagtgcaagacagtgaagtaacatctttacagtatcaaaagtgacaaaattatatagttgataaaccaatagtgcataaaaaatggaatcctaatattacgttaaggcagaccatgatagatttaatatgtatattataaaccctttaagcaactagttaaaaaaaaaacacacacacacacagccaataaactggcaaaggagataaaacagaattacaaaaaagaattccaataatataaaatacagaaaaataccaaaacaattaaaaatatgtaagacaaacagaaaacacacagcaagagtagatttaaatccaaccatatgaataaccacgttaaatgtaaatagtcgaagcacccccaagtaaaaggcaatgactatcatattgcataacaaagcaaagcacagaagaaacacactaaatattaaaacacaaataagtttaaaataaagaagtaaagataaaccatggtaacatcaatcaaaagaaagatgcaatctatatgttaatattggaaaatacagatttcagagaaaacattattactaaagataaaaaaggtcatttcataatcctaaaggagtcaattcataaagagtgcttaacaattctaaaagtttatggacctaataacagaacttcaaaatatatgaagcaaaactgatagaaattaaatagaaattgaaaaatcaacaaagatcgttggagatttcaacaccccctctcactaactgatagaaaaagcagacaaaaaagtcagtgagcacagtgctacccaataagggcctgggtagcactctgaaccaatttgacctaactggcatttatataatactctacccaatagcaacagaatagtcattctcttagagtacacacagtatattcaccaggatagactatattattggtcataaaattaaggctcaataaatattttaaaaatttaaatcatacaagttatattctgtgaccaaaatgaaactaaattataaatcaataacaaaaagatatctagaaaatccttaatattgagaaagataatcataattctaagtgagccatagatcaaagaagaaattaaaaggcatttggaactgaataaaaacaaaactacagcacaccaaaatgtgtgtgatatagctaaaccagtattcaaaagaaaatttaaagcactaaatatctgtactagaatagaagaaagatctcatatcaataatcttccatctaaagaaatcaggaaacttaagatcagaaaactatcatatagaaacataaaaataatagaaaaaaattgaagaaattaaagacaggttctttgaagaaatcagtaaaatttataaacctctatctagatgtatcgggggaaaaaatgagacataaattacctacatcagatatgaggatgaaagctatttttaacgtatatccataaattatttgacactcctacctctaggagttggtgcctaatttccctccttttgaatatagactaagaaacttgcatctaacacaataaagcagaagtaaatgtgtgtgacttcagagactaagagattaaagagaatgtgcatctttattgatctctctgttgtatcatacactcaggagaagctagctgccatgtgtgataacagtcaagcaacactataaagatccatgtggtgaggaactaaggcctcctgttaagagcagtaacaaactgaggcctcatggccaatagctatgtgaatgagcaatcttggaagcaaatcctccacctctagcttgaccaactggcagcccaggacagctctgaatgcagcccaacacaaattaataaactttcttaaaacattatgggattttttgtgatttttttttagcttatcagctatcattagtgtattttatgtgtgcccaagacaattcttcttcttccaatgtgacccagggaagccaaaagattggacaccctgttttagaccatcaaagtcttggcaaatatcttgattgcaagatcatgagagattttgatcaagaactaccatccaagttgttcgcaaatttcaaatccacagaaacagtgagacaataattgtttttgttttaagccactaaggtttgaagtaaatagcagcaaaagataaccaacatagagagcatcattacagatcctaaagacattaaaaggataataagggattattgtaaataactttaagccaataaaatcagaaacctagatgaaactaacaaattccttgaaagacacaaactaccaaagctcactcaaaaggaaagagaaaatctgataatagagacaacacctaaaactgattacatattaggtcacaggaaaaagtaccagtaagttccatggagacttttttataaacaatactgtctaattacaatacaagaaaaattagaaatcagcaacaaaattaaaaaccaaaaaggaccttccacgagaaaatttttacaacctattaaggtgcatagtaaattgacatcatatagcttctaaaaatggtggttataaggctacatgtcagcatctataggatacttttaaaacactgatgagaggaaatgcaaagccttaaaaacttacatacataaaacctgctcactggccaaatctgggacaattcgaggatcaaaataaataatgattataatcaagtaatttttttaaaagtccatgcatccattctaatataattaaataaatgagaaagcaggcaatgctactccttataatgaattgccacttcataaatatagaaatgacaagagttagaaaatcatcatttggcaaccgtgatagtaatagtcgactcaagcaaaagtcaatggacgctaaaaccagagaatgtgtgtgaaagtttgatgcctcagagtacctccccaaaagtacttattaattacaaaaggagactctgacagatgataccttaaccaggtgatcaaagttaacatcattaataatggaaccaaccaggtaacctcacaagccttgagaaggacaaaacaatctttctgtagtatccctgccaaaaatgcattagctgaatttaatagtgaggaaatatcatccaaacccaaattgagatacattctacctaacagccaatctgtactctttaaaaatgtctagcttataaaaaacacaaacagactgagaattgttccaggttagacatgacaactaaatgtaatgtgggatcttaacaacagatggtaggggatgggggtataaaacatacaactgtatcataaacaaaatttgaaatatggactctatcttagataatagtatatcattaaatatcctgattttaatcactgtactgtggttatgtatgagtgtgtcctcgttcttatgaaatgtatgctcaagtatttagggataaaggggaactacgcctgatttgacctcaaatggttcaggaaaataatgtgtatacacacccacccacatacatatacttaacaatgatcagtaaaatggagaaaatgtaaactggtgaatctaggtaaagggtatactggaattacttgtactgtatatccttgctacttttctgtaaatttaaaatatatacaaaatatttttagacacgtaaaatgtttaagatttaaataaactgctaaggcaggtacaaattggaattctagctatagcaatggtcataaaagaaactttcatctaatctcaattctaatgggtgtacttgtttcctaaaaggccttagcagatatagacatacataacagtattttgcctaaaattaggtataacatgcttcctgtaaaaaaaaaaaaaaaaaagtaacttaaaatttttcaacttttctaaatgttgtctacaagagaatcatattttcagctaggtaattcaagaagaatacttctaattggagagggaaaggtggattaacttttttccatatggaataatgaatttttaacctctactttctgtgatggtcatatggtaattccacatatactcaaagactatgcgtgatggtggggaagtgggcacaaggttgagtgtaatggtcagaaaggaaaagtctacactcctaacctaaggtatcctggtgcaatgtaaagagaaaaaaatccaggactgaaatcacacagcctgcgtttaagggattctgatgtgatcatcagcaaataacgtctccggtttcccataccttgatttcttcaactagaaaatgggaatgatgattcttttaaaaatttctgcctcaaagggctgaggattaagtgaactatttacctggaaagcgctttgtaaacttcaaaaccctacacatgtgttagtatgtgtaataaactccatatgagaggccactggaatcagcaaagttaattaattccattgctgtcatgcttctcctagaagatattgtaactgtgggtgtacaggtacatacgacttggcaaagggccaaaataaggttttcttcccaaatgttctttctacaggaaacacgaaaataattagcccagattcccgagtgaactcatcaacatccgtggaggtggagggtgttaaaatcgagttaaggcaaaatttacaaaaaaaaaattaaaaaacagtcaattgcgggacactgaacgaagaaggaagccaaactcggggaagggctagggagagaggaggcgtggccccagccccgctccacgccgcgcgcctcctcgctccccatccagcgcggcgaccaccggggtggcggcgacagcggcgcttctcaaacctttagtctcccaagagccgttacgcgccgcccctctcaatccccacaagtctgggcccctaacctcctagcccgtcacagacttctccgcgcagctacgctgcaagaggctctcttagctagaaagcaaccactgggcgggtacctgagccgagatgaatccctcatacacggttttcgaccggttctggggcagaagcagggggcactggcgcaacaggctcgcttccgtcaccgccatggctcgaagtccggagaaacacagaaaagctctagacctgctgggtcctgcacatgcgcagtccgctggcgctcggacgccgcggagcggaaaccccagccttggcgggaagatcctggaggattccgcgggcggaaatgaaggtgaagcgcaggccaggccaagtggcgctctgcgggaggcgacatcagggctccccaaccggtagtgggagggaagattgccctcaagtccacaggactgactgaccaagatcattctagcctcaattgtcccaggagccctttcgatgattctgttttactttattgaaagactgttacaactttggtgttgcatttcctccagaataaaatgacttttacagcctggacgttgtagcactctgtcttctttgctgttgtcctctctcccttaacatacagaataatgtattattttgtgtataattattgtaatataatgtataacacattgattatatcatatatattacagttctgtggcttactaagttcaatcagatatatttgaggcacacacatgtatacgtatatgtgtattgattagactcaagtcaacactggactcagttctgtgtacggcactcacaaatatataaagcaaaacatgagtaaagattgctgatggacttgaacttaattttcctctgacagcgcttgcaatatgtttttctaactcaggaatgttatccatcccatcttattaagagttgattaaataagaaacctactaaaatatttaccatatgattatttgattttccaattttccaattttccaatgcatcacgtttgagccctactatttgaaaaacatcattgtaatgtgccaaaggttgagcaaagattatttcgtcccctacccatctttattgacctcaagacagaatttgacatcctgaagattcttaaagtttgacaagaatttgtcacagcattctggatgcttacagaaaagaatgctggagcagtggttagatataaattacattaaagcagtggttctcaaaacgtgatcctagaacctagcaacagcatcacctgggaactatgtagaaatacaagttttcaccgctgatggggttcaggatatgctaccccaaaatatggccccttgacatttgagaaaacaacaaaacctaagatcactctctgaccttctcccatccttcttccctgaggcgggtcattggatcctcaatccagaggtgctcttcctatacccacaggaaagaaatatccttatctctaaagaaacggagacatagaaaagaatctgaacaaaaagacctttgacaacttaccccagtttattaccattagaccatgctttgtccaaccgtacttccccacaactgtccactgttccttctaaaaatgcacaggttttcctgtttctttgggcttcatctctgaaggctcccatgccacataaaacttaaataaatttgcacgcttttctcttattaatctgtcttttcttataagggactcaaacaggaatctagcaacaggaaagaaagatgtttctcattccctacaggcccctatttcaaacctcgggaatcccaaacactggcaatagggctcagcagtctgcgttttaacaagctctccaggtgattctgatgcatgctaaggtttgaggatctctgcaggggcaggacataacacctgctttattttgcaactcggtaattaaggacggccatgctacatgttttcctataagaataaagtagaggctgtgcaaaagtgggatcaacacaaagattaagagaacatatagtcccttacttcaagcactttataatttatctgtgaattaagatctttattgtatccagtatgttaaacttccccaccaccacactttcccccatggaacttctaccctttctttaaagttcttctcaagtgctatgtctttttggaaagcttttttaatcttctgaaaattattgctctccctaatcatttagcatatttcctgctgcatcgtaggtgctaataaattatttactaaatatcttaatttgggttgttatagcagaataccataaactggataggtaatccgcagaaattaattatttcttagttatggaggctgagaagtccaaaatcaagacgcaaggacaagatttggtgtctggtgaggagtcacttcctggaacacagtcttttggctgtgaccttacatcacattcacctttactattgatacactggacagtgtgaccacttgccaaaagcagttggctccttgattcggaatccccataattaggtaactagacttaaagatttccagcacgtttattgctaatttatcatcttagattttaaagaaaagacatccaagtcactgttatgatagttgaacttgtaaatgagcattccttatcaataaaatctataattgaagaaatccaatgaccaaggaacaaggtaagataccatataaaaactttttaattcaattactcgactattatccttaggtgttcaagactgaaagttggatactcactaccatcatcaattcatacgtggttgtgctggaaccatttatatatagcccagttgaagtcagccaccccaaaatccaaaaaaaaaaaaaacaaaaatgctcaatatgtttaaagatcagaaagccaaggaactacttctaccaccatcagcatgatttcaattttggaatcactctgacaaactgcacaaagatcctcattaaagttcaagttccaccaggtatcctaggcaggatttcatttatatactttgccacaaaaattactactatttaaatgctattgcctgaggaagaactttatattctaacacagaaaaatatccaaacattttgacaaataaaaagcacaaattccagaatggtatgcttactattataacatttatattcaaatatataagtaaagttgctctgtattactagcaatggttactttaggggagggagatgggaacaaagaatggagataatggcccatggagacttttatcttttatattttaattttttaaaggagaattattagtcttaaaattaaaaattaaaatttaaaatgcttataccattccaattagcatctgttatccttattttatagcccaaatgtttagccatgtcccaagagtttcttctcccagttcccaccagtaatggaagaagataggatgcctgccattaacattaataagattaataaaggagagattgtttgagtctgctgagaagaaagatgaaggaagagacttgcgaaatgtgaaaataaagggaaaatgaaaattaggggaaagtgaaggaagaatagccatttaaaagagttttcaaaaaaactggaaaagcaagccaataatatcctattctctgtggcactgtgtcatagaatggaaaagacagcagatagtcaagattaaggcatgatcaggagtgtaaaatgctacctaaaggttgaaaaaactgagaattatagagaggcctttggatttgatcacgcaaaagcatttattaatttgaaagatcagtttgctcttgcctgtttttctatccatgcactaaacagcagtttataaattgcgatgtagtgaataatttttcagccttgaaaagaccatatccataagaaataaactacaaagacttaattatgtgaccaaagtctggtagggtgatatatggagaagacaacctggctcctataaccctaccccaactcttttggagcacactcccttggtaggtaggttttaccaataatgagtctagatccattgcaggtacagaataacaatttctgcttcactctgggctgtagacttgaggagcaatggtacccacaacccaactacaggtaaacaaaagaccatttaagggttaagtctgctaaaagagttgatgggttacaaagattgggctggaatcagaagaatatttatggggtcatcatctaaagaaaggataagaatgtaaacgggccgtttaaaagtatagaagaatccagattattaaacaaccctcttcttagcaaagcacgaagaccctcttcccaagaaacaccatccccacacccagtgaaagccactgattagagagattaacagctcttttgtactttttaataagccactgggagaaatgtcctcagattactagcatctaacaaaaattacaactcaggaaataaatgttgcagttgacagtggcagaatagaagagacctatttacagggggtgcaagcttgagaaggccacagttgtagaggttaggagaaaaaagagaataataagtacataggattagagaagagtagttgttaagaggaggaggaagcatgcagcaagagaaatcaaagggaaaaatgactctatgtttattttgaaattctgcttgaggctagtcaatcccacttgccctaagataccaaaaggaaagcaattccatccctgagaaaaggatttccaacatccaaagaggaaagaagatgcacaaatccctcacttttactctggaaactcgagctaatagatcaaagggaatgagaggaaacagatttaatcttactcattctcaataaaagtttctaatactgtccctaaaccatcaaaatcattttaaaatattttaatacataggtgcctaggtgatgctgaaaggttctcaaaagtatgatctctggaccagcagcatcggcatcaccttaaaagaacacaccaactctgatctactggatctctcatttcgggaagaaggattcaacaatctgttttaacaagtatgtgtgtaccaaattcatgggccaggcgcagtagctcatccctataatcccagcactttgggaggccaaggcaggcagatcacttgaggtcaggagttcgagaccagcctggccaacatggtgaaaccccatctctactaaaaatacaaaaattggccaggcatggtggtgcactcctgtaattccagctactcagaaggctgaggcacaagaattgcttgaacccgggaggcggaagttgcagggagctgagatcacaccactgcactcccgcctgggtgacagagtgagactctgtctcaaaataaaaataaaaaacaaaacaaaacaaaaatttatgttttaattgggcaaatctgatacaagctaacaccattaacctagacttagtaaacccaaattctcatatctgattttattgtgcagctataattgaaagttattgcattaatcaaatgaataattgttcagacagaagttttacagtgccaaactcagagttagcctggcacatatttaaggcttagaggacatcagctaaaaaaatgtagtctgttagtgtcaagccattatttaaaagaacttcttaatgtaaaaattattttagttataaacagataaacttttttttaagctaaaaaatctatctcaatttggatcagacattagggagctgaaattttcttgacccgtccattgcagtcccagatggctgccagaactctaaccataactagagggaaggacaataatagctttctcagaggtcctttcgaacactagccattctcatatgcaaaggggctgggaaatacagtttttttaagctaatatattacctagagttctattagtaagaataaagaagagaatgtttacaagatgcactactccccatttctgcaacactatgaaatccttctaacacacacaaaaattaaaacttttttggcattgcattactaataaaatgtatactctatatgacgaattttcagactgaaggtccaatatgatcactgtaattccaaagatattacagtatgtttaccaggtattttctattttttcaaaactattttttctttcatgtgactactaaaattaatttatattttgttgcttacctgaagtgaacatcatctatgaaaatactaaagatggatgggtaacattataagaagcaataaggaaccagttttacattttagagaatgtgtgatctatacagtaatgaaatatgctcaaataaataaggagataatgaaattatagtttttttatcctaaaatgtccttcatctatgaaaaataaataagatttggttatggcctatgccatctcttttaaacaatcctttgttgattgggataggatttgctgaaataacaatttggtttctatttaatgttgtttgtttctaaatacaacaaataaaataacatataatacctgtaatctgaaaatacctgactttatgaaatgttgttaaataaattttaaaaagttaattaacttttgttccaaaatttaaaatggatttttataagtatacagtaatttcaaaataacaaaaacatttcaagtatcttagcaacactttcttatattctacaaaatcttaagtatataaaagtcattattagcagatataattatgcatttgctgatggttatgtgtaattggcaaaaggttttttttaaaaacaatctacttaaatacagcaggaaacataaaaatgattttcttttgagcaagtaccacatatagaagtatataccaaaaaaaaaatccggaaatgttcctagaaataggagacaaccaaatatccagtaagttggaaatgggtaagttatagtaacatagtagaatgtctaaaagccattaaaattacatgtaggcatacaatattggaacataagaagtatatataagatacaaatgtgtgaaaaagaccaaaacaatgccaagatgaagagaaggatatataattagctgatattttaaaagtaaagaatctttcatttttctatttaaagcaagttactttacaatgaatttttaaaaataagacattagcaaagattttcagaaatctaaatgctgtcagaattaaaaagtcatctattaaattaaaggaagcacagtaacatgaaaagagaataaagaaacttgggttcaaatagttgattttattgttttcacttaatatatcttagagtttattgcacaccagtaactatagatcaacctcattctctctaaaggtaacataaagtttattttgagaagactaatactaacttttctcattttaaaaaattaagatatgatttacataaattttactctttttagtgtgtataagttttgaccaatgtatacattcaagagtaatttttattgatactgcaaaattgccctcttgagaagttgtaccagttcactctcccacagttatttatgagtacttgcttttctatagccttatcaattcatatgtgtcatcaaatgctttgatctttgccaatatgttagtgaaagtggcattgtgttataatttaaatttttatttcttttattatgataaagccaagcatcttatatataagatccattaatagttccttttcttgaattctccatattttttgggggggtgctcattttccttttgtgggttggccttcttttcatgaatgctagacttcagttttgggggattttgtttatttctttctttgtttgagacaggatttcactttggtgcctaggctggagtgcagtggcaagatcatgactcactgtggcctcaacctccctggaatcaaagaatgctcccacctcagcctcctgagtagctgggactacaggcacccaccaacacgcccaactaattcttgtatttttttgtggagatggggttttgccatgttgcccaggctggtcttgaactcctgggctcaaatgatccacccgcctcggcctccccaaatgctgggattacaggcgtgaaacactacacctggctgaatgcttgacttcggataagttacttaatgatttctgaggttgtttgcaactataaaaatgcatttgtgaaaaatgaatggttttacaaaataattacagttaaatatgaattatctggatgataaatctaaaaaagaacttactttgaaactgttattcatattgtttgttactctgtttaataaaaatgtttgtgaaatctaaagtgaagtgccaacattgggtattttcactatttcgtcaacaacagagaagaaagtttaaccttacacattttcagttggaaaataagtactttcgggaaatgatgttgtaaagttatgaaccaattattgcactgggagatgaagttcatgttcagtatagagtgagcaacaacaagcaattgaggcaaaatatctttacataaagttttactattttgtttgatgaaatgagaattcccgaaatttattagacgcttatattcaaattatgaacataaaaaccttacaaattcagatgtagataatctcctttctgtaggtttatatcattcaaaaatgattatatattatcattttaaaatgacaaaaacattttaagtaactattgaaaattaacaggaattcaaaactattctttaaactcttcctaagtcgataaagttgtttttttaaaaagaaaaatggttattcttcaaatagtccacttgaggaggattcaatttaatctcatttcctttatggcctaaaaaataaggcacaaagaaaaagatattatggaaggaaaaaggcacaaaggaaaagatatcacatgtcaaggctgactagtccaagttttatagctgggcttctaaatgaaaaccggactgacaaagataaaagataaaatcgtacaagttttaggacttttagaatattgatatttatcctagtaaacaaatataaataaaatctggtaacattaacataaagttattttctacatttaaaatttgttcaattttctaaaactaagtatttttaccttaccttagtgttccatcatttcatagacagcacaacctaaattacacactcttcatctactgtcctgagactgaaaaacagatgtagattcagaagaatgtgaaattttaatggccccattggataagcaaatgagttcactcaatgaagataaatccccataggcaattccttcccaagaatagtcttggcttttcctttagtcaattttcagtgaacctaatttaattgaaatacaactttatatactgtggaggatgtattgagctaaaaccctaagtctttaggccatttaaaaatggagtaacaacacccatattagatgtgactatggatagtaatggacaaagataaatcttgcaagaaagggtggtgtagagccagggaccacagagaacaatggacttctttccaatgatcagaattaaaattgattcaagaaatattttctcctgccagagcagaggctttttccagttcttaccctgtaggatttcattactgctatgaaccggcaactgttctgtattttctgctattcctttttcaaaataggtaagcttattgtatttatcctactcctgctgtaccactgtattttgcatctccgatgttgtatgtgtgtctgtttgtatcaggtgtgtgtctgggtggcgggagggtagttgcagtgaccagaggaatctaaatccagattctcatagaaggacatgcaccaccagcagtcctggaatttgagataaatacagttgggttgtccactttgggaaggggatgagtaaactttatgtgagggaagaagaaggctattcagctatcagaagggtaaactacagtagagtctgttaagtgctaatcaagctcatttccttttcctcttgggcccatagctaagctacattttcccacctttctttcagattgatgtacaagtgattgagtggcagccaatggaatgtgggtggtccattaaaaacctactatgcttgattcaacattctcttctcctatccgctagtttgaataacggattctggggccctcggaatgataaacctacaaagtaaaagttgtgtctcaaatgtcttccaatcggcttgatacgaactaggaataaactttttggtattaaggcactgcaattgtgaggttcatttgttacactcgtatacagcatgcattattctaagtaaaat

SEQ ID NO: 273 - DNA, 51148 bp, Homo sapiens
tcagaagaagaaccttatgataattttttttttttttttttgagacagagtctcgctttgtcgcccaggctggagtgcagtggcgcgatctcagctcactgtaagctccgcctcccgggttcacaccctttatgataatattttatagaaacttcaaaattatgtatgaaaatatattttaataacttgtagatatagttaaatcacagtactgcattaagtaaaagaaggaaaatacaatcctacattacataggattaaatgtatttaatgtacgtattaaatgcatttccctaactattgttagcaaagcaaaagaaaaaaaccgaagaataatctccaaagggtaacatgggttagctctggttgatgagtagtttttgctttcccccccttaaacatttctgcattttaaatttttctacaagaacatgtcgtgatcagatgaaaaataaactgtggttttttttaagtgttattaaagagcagccatctggtatcacaagatcagttaggttagatttaggaaactcatatgaaattaaaaaaaacctttagaggagcaaacttggttgtttaattcctagaggcaaattgcatgccactgtgtgtcacatagtgtatcacgtacacacagtcagttccccaagtatcaggagttaagaagatgcatttattgaaataagaattgatatgatgtccatgttactcttattttattctacaattgtttctgctaatattggaagtttttggctgggcgtggtggctcacacctgttatcccagcactttgggagtccaaggtgggcagatcacttgaggtcaagagttcaagaccagcctggccaacatggtgaaaccccatctctactaaaaatacaaaaaattagccaggcggggtggcatgtgcctgtagtcccagctactcaggaggctgagacaggagaattgcctgaacccaggaggcggaggttgcaatgagctgagatcataccactgcactgcagcctggacaacagagcaagactctgtctcaaaaaacaaacaaaaaatttttgaatttgggtggtgaggtaaatatctgggctcgtgaacatattaaatgcataattgttgcttataatttcatttatctctcttcagtcagattaaatatgacctactatgttgccagacacagtgctagatgctttttcactgtatctcataattcaactcacataacaactttttccagccagttttaatgtccacacttgacagatgaggaaactaactttcagagaagtgatcattccaaattcaagttgtttgttgggctatgaatgctgatcttcagcacctgagaaactttcgatagtatcagaagtagaccatttatcctattagaaaactaaaaagcaacaaacatatttatttaaaaaatttacaaatgataaaaaattaataataaaaacaattctcatttttaaagttggaatagtctctagggcttagtaactggaaaaacaataactgaatctccatccaaaattatgttctcatagccagatgtgatgccacacacctgtagtcccagctactcaggaggctgaggtgggaggatcactgaaccccaggactttgaggctgcggtgagctatgattgtaccactggcgctccaacctgggcaacaaaacaagaccctgtctctaaataaataaataaataagtaaataaaattattgtttcctatctgttttttatttctatcatatcagttccttctatagagtttgatgattggcacatactgtaatgtgtgagcaaatcgcatagtcttatggcacaaggcgtgcccaacatagaattcttctagactgtattcaaacctacataaaaagaaatgaatacaaacaagccatgcatgcacaaccagaaacatataatttcactaatccatagccactaggacttgtcaaaaccaagctggtctatgtgtgaatgtgtgtgtgtgtctgcaaattttaaggaacatgtgtatgatgaggttagaagccaccattcaaaaatctcttttgaaagacatacgcagctgggcgtggtgactcacgcttgtagtcccagcactttggcaggctggggtgggtggatcacgaggtcaggagatcgagaccatggtgaaaccctgtctctactaaaaatattttttaaaaaaattagccgggcttggtggtgggcgcctgtagtcccagctactgggagaggctgaggcggaagaatggcataaacccgggaggcggagcttgcagtgagctgagagcacgccactgcactccagcctgggtgacagagcgagactccgtcttaaaaaaaaaaaaaaaaaagaaagaaagacatacatgcagccaacaaatatatgaacaaatcctcaacatcactaatcatcagagaaatgcaaatcaaaaccacaatgagatatcatctgacattagtcaggatgactattgttaaaaagatttaaaaaaacagatgttcattatatcgaaaagataattacatacgtatggttatcacagcacaatgcatagttgcaaagatatggaaccaagctaagtgcccatcaattgatgagtagataaagaaaatgtggcatatatacactgtggaatactactcacactacctggccataaaaaagaaagaagtaatatcttttatggcaacttggatggagctggaggctagtattccaagtgaagtaactcgggaatggaaaaccaaataccatatactcttggttataagtaggagctaagctataggtaggcaaagggacatagggtggtataatggcccttggagactcagaagtggggagagtgaaaggggattgagggatattggacacaacgtacactactcaggtgatggccgcactaaaactcagaattcagcactatgcaattcatccgtgcaaccaaaaaccacttgtaccccaaaagctattgcattgtgtatatatatatacgtatatatatgtacatatatatacgtatatatatacgtatatatatatatatacgtatatatatatacgtatatatatacatatatatacgtgtatatatatacgtatatatatgtatatatatacgtatatatatatacgtatatatatatagtgtgtgtgtgtgtgtgtgtatgtatatatctaaaacacaacggatgttgatgaggctgtggagaaaagggagcacttatacaattttggtaggaatataaattagttaatccactgtggataacagtaagaagtttggatatttatttcttttccctttttttttttttgagacagagtcttactctgttgcccaggctggagtgcagtggcatgatctcggttcactgcaatctccgcctcctgggttcaagcaattatcttgcctcagcctcctgagtaactgagattaccacacttggctaatttttgtattttagtggaaatggggtttcatcatgttggccaggctagtcttgaattcctgatctcaggtgattcactcgcctcagccttccaaagtgctgagattacaggtgtgagtcactcactgtgcctagcctacagtttggagatttcttaaagaacttgaaatataactaccattcaacccagtaatcccactgctgggtatatatccaaaggaaaataaatcattctacaaaaaagacacaggcactcatatattcatcacagcaccattcacaatagcaaagatatggaaccaacctggatgcccatcaacgatagactatgtaaagaaaattggtacatgtacactatggaatactacacagccataaaaaggaatgaaattatgtcatttgcagcaatgtggatgcagctggaggccattgtcctaagcaaattaaagcaggaacagaaaaccaaataccacgtatcctcatttataagtgggagctgcacacattgaatatacatggacataaagatggcaaagttagacagtggtggctactagaggagggagggttggaaaactacatattaggtactcttctcactacctgggtaatgggaccattcatacaccaaccctcagtgacatgcaatttacccatgtaacaaacctgcatgtgtacccccagaagctaaaataaaagttgaaaaaaatctctttggaaccccttacaagagaatgaatgaaagacgaaagaatatctagcctttttctaataagccgggtaaatctattttgacatgattttacaatagctgtccctctttgtagcgacatctggggcttacaatagcctcagtattgttctataaatggcattttaaaaaggaaacatctcccctgtagggtgtaagttcttcaaaggcaaaccatgtttatgtatgctgtatttgcaacacttagcactgtgtttgataaatggtttacttttttaactgttggagcggatttttttttttttttttttttttttgagatggagtttcactcctctcgcctaggctggagtgcaatggcggctcggctcaccgcaacctccgcctcccagatgcaagagattctcctgccttagcctcccaagaagctgggattacaggcacccgccaccacgcctagctaatttttgtatttttagtggagacggggttttgccatgttggccaggctggtttagaactcctgacctcaggtgatccagctgtgtcagcctcccaaaatgctgggattacaggcgtgagccactgcacccagcctggatatattttttaaaaagaaaagtatatctagttttttaaaaacattaattcactcaatagtcacatctaaacagacatatactatctatgcagattgtaggcacgctgtatacaggttagatgaaaattctttggcattactgttcaaataaaaatataagacaagctggtaatgagagcaatatatgtaattttaaaatttctgtctttcttttttttcttttcttttttttttgaggctgtcttgctctgtcattcaggctggtgtgcaatggcatggtctcagcccactgcaacctccacctcccaggttcaagcgattctcatgcctcagggtctcagagttataggtgtgccccaccacaccctgctaatttttgtgtttttagtacagacgggtttttgctatgttgaccaggctggtctcaaactcctgacctcaagtggtccggctacctcggcctcccaaagtgttgagtttacaggcatgagccaccgcgtctggccaatatatataattgtaaagtgtctaataatggcatttaaaaagtacaaatacagagatctaattagttttagtaatatattttatttagcctcatccatccaaagtattatttaacaatgtaatcaacataaaaattattcttatttgtggaggtattttctctttttctgggatactatgtcttcaaaatccattgtgtattttatacttatagctcatctgaataaggactagccttatttcaagtaagcaggagtcacatgtgattggtggctgctgtattcacagcgcagcttgatagcaatttagcttcaggacttttgtttttgtttttgaaatgaactaaattgccaaacctacatgtaatataccagatacactcatgtccttaatgttatttgatttgtttctttaggacgaacaacctattttattcactttgtttatataaaaagtattattcttaaatatgtactatgcacatatgataaaacatttcacaacattaaatggtaggaaatataaaaaggagtgtcctttcattgcgtctccaagcccagtcccctgaggtaaccactatcacataaaatgcagattttttccacatatatatgagatatgtatatcttttttaagtatcaatgaggatataacttacttttcatagtcctgataaaataccaacaaaaactttgctatgtgcataagattatataggatatcttcatgtatcaattctttttttctttttttttttttttttgaggtagagtcttacgctgtcacccaagctggagtgcaatggcacaatctcggctcactgcaacctccacctcccgggttcaagtgattctcctgcctcagccccccgagcagctgggattacaagcgtgtgccaccacaccgggctaatttttgtatttttagtagagacggggtttcaccatgttgaccaggctggtctcgaactcctgacctcaggtgatccgaccgccttggcctcccaaagtactgggattacaggcgtgagccactgcgcctggcccttgtaaattctttactagcaatgaggaaagaaaaagcaaaagtaagtatctgggatcttaaatttgatactatttttagacactgattttgtaggatccaatattttgatattcatagaaataaccagtggccataagttctgtaatatcaaatgaagtagcactcttctatgaactatacactttacattcattatatggtttctttttttacttatttcctcaatcagtcagtcaacgaacattcgagatcctgtcatgtgtcagacactgtgcggagagctggagataaaactgtcaacaagatgaatgcagcctctaaaataaagagtttctaatccagtggattctctgttcatgcttcttgcactttctctacactttgctctatcaaaaaaaaaaaaattcaaaacactcacgagtttgttgaccttaaagtggaatcagctgatacaaattaaaagcattttgcatttcaaaaagtgataaagtctaataaatagctcactaatggtgaaatttcagagacatttattttaggctggggtcttcctaattcagaaaaaatcagtccagtttccctattttacatccaaactcctcaaatgaccaatctctattctctctcttttttattttttggatgagtctctcactctgtcgcccaggctggagtgtagtggcacagtctcggctccctgcaacctccacctccccagttcaagcgattcttctgcctcagcctcccgagtagctgggactacaggtatgcatcatgatgcccagctaatttttgtatttttagtagagattgggtttcaccatgttgaccaggctggtctcaaactcctgacctcaagtgatccacccacctaggcttcccaaagtgttgggattacaagcgtgagccactgctccaggccccaatctattctctctaactgcttttatttcctggcctagagctccctaccattccactgaaacggatttaataacacaaatagcattatcactaagtccgaagatatttcattagaacttctcttccattattttatggcattttaaatttttaaaatcactccttctgcattgaaaaactatcatactgaggtttgacgccataatttgtttagctcccctcccacttctctgtggaatcattttttttctcctttaaaagcttttcttcttttgatctcctaattgtgtgagttcttcaggctactacttgagcaattaagcccatatttaaaattgtcactgatgatccattatttatagcttaccaacgtgtgttttatggaacactgttcccacaagaccacattgaaaaacaatcaagaaccctggcaaacatttctcctttgcctgcacattctacagagatcataaaaataaatattctttctcctgatcatacttccagacagagtgaacatatgatacaattctgaccaacaaggcataactgaagtctgttgacccttcgcttttcttactgctttcaacacgaactcaaagcaggaaccgtggtagataatttgcaattttgaaggatgggctaaatgaattgcagggtcatcagcctccacgctgcactgaacataggtcagcaaccacttacctcctgagttctcactacgtaagatgaagaaatctttatttgtttggacttccgtagtcaggcaatttatacctcgcaccagaacatactcttaattagatataaaaatgctacatactatatgtccttcttggagcttcagaacgcacattagaaaaattagagaactgagaaattcccaagagaagaaacctgtggaattctgctgaatttgtcatctcctaaatttatttgatcaggcagcccttttcttctttctgtactgaactaccaatgtctcacagaactatggctctctagctttttgcttttcaaagtgtaatttctagaccagcagtatctgcattgtctggaaacttcttagaaaacccaaatattaggccccatcctggaagcagagttacattttaacaggatcttcagttggtttgtatgacactaaagactgagaagtgccgcttgggaaacactgatttagagaataaagtacaactaaccttaatatccttatgtggcctatgatttcaagggcctctatatcattactgtcccttaatgcctacttcacaagtcaacacacctagttcttattgaatgcttactttgtgcgaggcactatgccaagtgctatagttttataattctcaaagcacccctatgaggcaggtactattgtaatcgttaccttgtagatgagatagctagggctcagagaagttaagttgcctacccaacgtcacatagccattaagtggcagaatccttggcttaaggatttaaggatcactcaactatattggctttctaagcttttgttcccaagcactttcctgctctgtgtacttaacacacatgattccctctgcctgcaatatctccccacgtacaccttcttaaaaggtctcagctcaaaaagtcagttgttctgggaagcttttctgatctcctaccccaaagccaggtcagatcctcctggtaaacattccccaggcacatatctttacttcatacatatcagcttttataattatgtatattttgtgattctatgattagtgtatgtgtttaccaaaaaactaagctccgtgtgggctttaactgtatcctctgtgcctgacacacagttgacacacaaatattttttagagtatctttttttttttttttcttgagatggcttctcgctttgttggccaggtcggagtgcaggttggcacgatctcagctcactacaacctctgcttcctgggtttaagcaattctcctgcctcagcctcccgagtagctgggattacaggctcacaccaccacgcccagctaatttttgtatttttagtagagatgggttttcatcatgttggccaggctggtctcagactcctggcctcaagtggtccacctgcctcagcctcccagagtgctgggattacaggcgtgagccaccgtgcccagccttttggagtatcttttactctcatttgaaacgttctctccctattctgcaccaatccaagttctacccagaagaagctataggatggtggcaagatatttgatttagcatcagaagacttggatttgaggccttgttcccctactttgtaacttggagcagtcacaaaaactcagacccactgattctcagctctgttaaatggacataataataacctcacaggattggcataagaattaaaatgagccctgtgagagaagtgtataacctacataaacttcctaaaaatacgagtagcgttttgtagtgattaagatcctgggttgtgcttaaaagtttccactctgtaatccaaaacctgagttcaaatcccaactcataatatttattgtctctgcggttgattcggcaatccattatttgctggattttgtcatgtgttttgccaattgcattcataatttattatgcatttatgcttgtatctcctaagtcatggtatataatccatgctttttatgttttgtctgacataagctcttatcagagccctttgcacacagggattcaataaatattaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaattatttctccattatttgattagaaatagggacaatgttgattctggcttcaatccagaaacaaacatgtggacacaggtttaactgaaagaaagctaaaagagaagattcaaggacaaatcccaatactctgatatttttcttttttccccacttgtatgactttttgtgaaagatccaataatatatctttataaagatatatatattttacaacttattattatgttcattcagagaatttttgtactgtaacttcaataatgttccattgaagattaagtaaaaacgaagtccagctgaaactttgctttgtattaagggtaataacattttacccacaaaaatatgaattaatatgtcatctcaactaaaatatggagataagccaaatttttcctagttataaaaaacaaggcaggttaataattgccaaggtgaaatggtcagtttatttgctctctaagaaaaacaaaagtattccctgaggtgcaaaattgtgaaatttaactggaagcatcgattatactctggacaagttgttccttttgttttaaaatcctctagaagattttctaatgtgtaataggcacttgttagctccattaatcgtattgtgtaacagtttcttactggaaatctgggttcatcatttcttctttccttctgatgtaactcaagcagttgtttgccatttgtcctgtggtccctatttattcactcagattccagtaaaataccaaagttttgttttctttctgttctttgttatctactggacttgagcactgacgatgtttggtcttcccattaaacatcttcctgtccttcacgtggacattttgaagattattaagggaaaggtaatcctgttgatttactggaaaaaagaaggaaaaaaaaagccagttagactgaagtgatttgcacacacacagaagaagtggaaattatacattcataattgtagagaattcaagctgctaatgttaaatttcaaaagcaaaaatatgggattattcggctaattcaataatgatctctgtggtaaaatgacatattttgaaatacaaacttatctttccttcttgtatgcctttagctttgtccccattcaagcaataatttagccttgtgttcatttcctcactggagggacataacattaacagcagctaacatgtggtatacttatcatgtgctaaacatggtaattttatcaactcactcagccacacagccctataagtaggtactgttaatgatctccatttcacaaatgacgaaactgagacacagaggtttaagtgacttgcacgaggtcacacagctaacaagaggtatagctgggctcaaaggcaatcctgctcagaatctgtcctcttttctactaaaggtagactatgctgtctttcggaaacttggctagcatcattacctcaggagaaacttgcaaaagttaatcaggcagtaaggactactctagggccaatactttgtggaggaattccaaaagccaaattttcttggagtaacattattccatggatgtactgccataacatggtggaagaactatcatcaggaaaggtcaaaattatggccaggtgcggtggctcacgcctgtaatcccaacgctttgggaggctgaggcaggtggatcacctgaggtcaggagttcgagaccagcctggccaaaatggcaaaaccccatgtatttttagtttctactaaaactacaaaaattatccaggtgtggtggtgggcgtctgtggtaccagctacacaggaggctgaggaggagaattacttgaacccaggaggcagagattgcagtgagccgagatcgcgccactgcactgcagcctgggtgacagagcaagaccctgtcaaaaaaaaagaaaaagaaaaaaagcaagaaagaagagttgtgaccttgcacaactgcaccaaagctatgaaatgagaatgagacctgagatcactggctgaaaaaagtacaagaaaagcatgatataataggacaacaagtacagtcccaccaagatcaggctgattaggctctcaaacacattaaacggacactgtcaattcttttttccttttccttttggaagacctttttcagagaactcttcaattaatacatcagttacagcacaattttcatccaaaccctctggaccctgtattgtgcctgccagattgaacacctgtccattatttgatacttgacccagtcaccgtgggaaggtttaattccagatcttgccgcctccagtccactcaagcttgcagcgaggaacatgtctacttaaggctgcatgaggaactagactcagacaaatgatcttatatccttgactgtattctaccagcataaatttctgatggttatattttccaaacttgactcccagttcaggaggcacccttttatgggacttataaaactccatgctctgattacaatgataacattttaaacttcaaatgtgccctttattaaaatatttagaacggagcgtattgtagatatcaaggaaaggggttgttaagaacagtcttcgttccacacaactagcagagcttcctcaggtggaggtaatcaaattccttcctgaaatgctggtttcaatgtcatctcaggcagagtcctgaaaaactagaaagtttatttgcacataacgtaggtctcagaaatttcaatggagaagcattttaaaattaataaaactaaaacagttttactagtgagttatcctaagtattcccattattgatgtaactagcagaaagtttacattaatagatgatcaataaatagttccaccttcacacacactttctgggaaagattctgacaatatgaactagaaaaataagggtaaaggtggataaagaaaaagaggaagaaaagaaaaattgaggtgctttgtaatgtgtcaacttgggtaggccgaactacagttcccagaattccttttgccttatgttttccattaggagcagttggcaggcagaaaggaagtggcagccatctttgcagctctcccatgctgtaacgtatctcgttggccttaagatagtggctaagcctccagctgtttcacttccctttggatataatttggagcctcgtttagcacattacaaatgggtctggcttctgtaggacacccacatcaaccaaggtcagaggcaacaagaactgacacaggtttcagtccgtcctcatagattccagctcctgcttctattacgctcatctactctctcgcttaactgcagttcgtacttcaagctccaacatcatccctggagacagctgcctttcaaagagtacttaaccagctcccacagttgcattaagtcaaatcccttatatatcctagaagctctgcttctatgattgaactctgcctgtaactctgaggctcctggacaggaaagtcgaatgcctcagaaggaattttgtcactgcaccattatttcttcctcccagagctctctgttcttttgctcacatctggattgctctccctctaggcctgctacatgaggcatgtaaaaagtaatactgatagacatttggcagatactcccaaatgtgtagcttcaggttccacacaacctatgtcctcccctgcatactagttaagataaaatgaaacgcttattcactactcatcttttcagagctttctcacctatgtgtttggatttttttcccctctgattctcaaactaattttagattggttccctagcaggaagagtacaaagatgttttctttttttttttctgccacaaaaaataaaaagtgttcttgctgaggaatatgtttgtttttctttctgtgtgtttgcaaggactgtggactggcatttattttatgcttctgaataataacatctttcttattaaagaagaatctccccagaaggtcacatgtcattaaaaaaacaattttaaccaaatacacgtaaattctaatagaaaacagattttttacccgtaacacatgaagaagaaatttagctatattgtataaaaatatgtagggaaaaaagaacacaagagctcgtgttaagtaaaaccacattttaaaatacgcctttaggaacacggaagatggaaggtatcagaagatacttgctttcattctactcctcggtgatgatgtatctgcttttttttttttttttttggatgaatttgcagtgtatcttttcatcctgatgcctaaatccagtctctatatgtacctcttttctccagtttttagacttttaaaatattatcttttcatgaagaattcaactaattggaaaatgcgtgattcctaccactatgacaatatctgaaagtagaatcctcagggttgcaagctattctgacaaaatttctgaactctagcagaaaatgtaaaaatatacatttgacaaaaatatatttgcccatttgaatttaaattttgtcttttttttactcagtttttatttcttagaaaaaggaagacaatctaaatataattccctgagatatagtttcctttcacttcaaaataactgtacattaggttgagagacaaaaaaattcattgtctacaattacacatactttctgattaatctgttggttagcccacatttagttcatcaggcacaacttatttttctgcatgtgcatttgggacaataaccgggcatatgaaacctttaaaatttacatttaaaaatttatatttgcacttggataactttgccaataactagaactccctcaaaaacaaaggctaggtccctgactcctataggcatgaccaagagtatactacaaaatgattcctctgagactgaaatgtttttttcctgcttccccctcagagacacattgtggaaaaattctagaacttttagaatagacattgtgtgcttgactccagcgatcaaagattctgaaatattgaggccctatttgagagtcatacacttatactagttttatttgttgttgttgtttataatctgaagaaatgaacttcagccatctagaacaaaaataattggatttgttggagggttacggactgaggtaagtagtacaatcagtgacagactgatacaagccaagggaaggcagaataaggaaagctccaaaaatctctcaaagatgtgttcttggatttattctgtagtatgcagcccttaaaatgttttaatttcagtggaattctggcctctgtgtctgtccatacaaatctcacatccctaagagggagaatccaattagcccagtcatcggtatttctttctgtttttttctttttctttctttcttccttccttccttccttcctttcctttcctttctttctttctttttctttctttctttcttctttctttctttcttttttttttttttgagacagagtctcactctgttgcctggctggaggatagtggtgcaatctcagctcactgcaacctccacctcccgggttccagcaattctcctgcgtcagcatcccacgtagctgggacttgggcatgcaccaccatgcccagctaatttttgtatttttagtagagatggggttttaccatgttggccaggaggtctcgatctcttgacctcatgatccgcccacctcggcctaccaaagtgctgggattacaggcgtgagctaccacacccagccatctgtgtatttcagtgtacacctagatatatggcacccacacactgaggccacacctttactccctggccccaaaatttttgtcaaatgtggctgctgggtgatctgttgtgagcaagaaaagctccatagtatgtgccattctcctactacaaaattaggaaatttcaagagaaatgaaaggtggggatctgtccagtttaatggaagattgcctggctcaataaagatgctcggcaagcctaagactgcatctccaatgactctttcaccaatgaattaaccataatacatgtacccttttctattgctgtgatgtatatagttgttacctttttatttgcctattctaatttctatgtaccctctctgaatgaaataagtcttaattagccaccagcccttctcctagcccatccaccaaggctagatgttctcctatgtatttacttctcttatatcacacatcactatattgtgtactggagcttctcttttcattccagggagatcaggggcttgttttttcttatttcaatatccacagcacccagcatatgcacaccacacaatagaagctcagaaatatttattatgcatggaatagtaatatcacctatttgtattagcatataatgtaaatattcaaaattggtaacgattaaacttgataacttacatgaagtgcttatgacaatgcctgatagaaaatatgcgataaattttcgtttccttctgtcttgaaacaatgtcatgattgtttaattcgttctgtaaagaaggaggcagcaggctggctcctgggattggtggcttacacctgtaatcccagcactttaggaggccaagacgtgtggatcatctgaggtcaggagtttgagaccagtctggccaacatggtgaaatcccatctctactaaaaatacaaaaacagccagctgtggtggcaggtgcctgtaatcccaactactagggaggctgaggcaggaggatcacttgaacctgggaggtggaggcaagatcacaccattgcactccagcctgggcaacagagtaagaccctgtctcaaaaaaaagagtgaggcagcaatgtacaaccaaagataatacatcatttcatgaagataattccaatgttagattaggaagctaccatgtccagcctgctgcatcattctttacagaacgaatgaaagagtcatgatgttattcttaataatgtagaactatttgtgaaatgtggatgcagtgaacgttgatgcagacaatacaatgcccctaaactcattttactaagattcccaaatttactcatgctttagcacaagaattttacatttcagttaagaaaggtgaaagaaacttctttaatctgtaatggaagaccttgtagcagaacaaaattgctaccaagaaagttgaaaagtagatatatataagaaaaatgtttttgtgacctggattcacaaagtctgggataatgttcttgctcaacaactatttaaattgggattccctgaaagcagagcctgagacaaagatttggatacaagtagtttatttgggaggtgattccagggagcataaacaagggtgtggtcaaatgaaatagaacagggaggaaagccaaaaagtacctaatgagtgggggtacactcatagacaactgaggctccaacctactgaaacctctgagagccccacatcagaattttcctctcaggtggcaggagaccaagagtaggtatatatccaccaaccccaggtccttgttgcttgagggttgcttctgtggtattgattccacctgttgtactatgatccttccacgtgtgctttaatccccagctcctcatttcttctctagagctaggttgattaccttcctctttttcactattgacttcaccctttccttccacagttgtttcccctttttactctatgaacaagcccaagtctattaaaccctagaaaattaaaatctctcttactcctgcctctagtaactttcctatttttctctccatttcaactatgcttattttttaagaagacagtccacactcactgattccacggtctctctttccatgaactcctcaattaaagccagtgacttctgactcctttactgcaattgcggctgcttacaagatgccacaacactcctcatggcagtttctcgctgaattctcaggctgctccttcttcctcaaaagttcttcttccacaggcttttataaaacccatccctcttagttctctgggcatcctccaagttttccatctttcctttatggagtattctttcctttttggtccattgaatgttagtgtttaacaactcccaaatatttcattccagctattacttctctctgtaactccagaagtgtttgtccagtagcctgttagctcagactaaatttattatagtctcttctcttcctcttccctccccttgggaagaaaggcttgccttcgaaagaagatagtgagttggcaaaaccagcatttactcacttcatttacccacttcaaaatcttgggattatcagagaacattcctcctcctcatcctgcatttccagttagtcaataagttctgctgattctaccttctaaatggtaaattctctccatcagcgccattgctgctgtcaccttaattcatgtgttcatcaccttggcataatctactggtatctcttagttgatcaatctgctcccagtttcttcctcatgcagaccatctgctacagagtataaaacattatcttgatgcaaaaaaagaccacattacttctctacttaaaaaggcttagaagttctccatcaagtcaacaatcaacaagctaaaatctgatttcttttatgtggtgatctagctagtcccagtgtcagtatccagaagccgctcaggtggtcccaatggctaaagccatcatgagccagccaacctggcatgtgtgggtgctttgaaatcaatggttaaaatctgagtgtgggaatggatcctgagaccttgtagccctaagtcagtattggcacagagccttctctgtaaacttaaattaagtgtcaacatttagaagtcacttactatgagccaggtactctctgaacacttcctatgtactaattcatgtaatctccagagtagccctttgagatatgtattattatttttaattcccattttcccagtgaggtgactgagacataaagagagcaagcaacttgcttaacatcatatatgccacgatttgacttgaagtagactgttctagaagcagggtcttatccatttgctatgggctttgttagctttacacagaggctgtggggttcccaggcttagaacataattccagcctgtgcagggatctagatgaatcagaggtgaagagtggaagaaagaagcagagtggaagcccaagccactgatggcaatctgaacttggagcgtaacatcaccaggagaatctttatctccacatcttcccaatcctctatagttctgtcatccaacacacacacagatacagacatacacacgcacacatagacacacacacaatccatgagaagctttcaccagatcagaagtggaattattgctgcagaaggtaatgatggatggccccagaccacatgagaatgtttttaaaaatgacaaaatattgggaatataacaaacaagcaaaaaaatgggacccatctagagagccacatgtggtctctaattcctccctgcactgtgggtttggaatgaacactggcccctaagaaccgagttagccatgccctgttcttctcttgaatataatgggaggggatgtcagggaaatggagatgtctcttctcacaatatctgctaatcaggattgttcagggccttgtgcaattaattttagctttcaaaaaagaaataatttctcagaactccatggtgaggaaataggtcatactcattagcatagtcatagaggaagaacagtgtttaataataggcctggctgaaataggctagcagtgaaactagaagggcaaaattattctgttaatgaagaattaatgaagattttcgagtttccttaggtaacccaagaagaaaggtgtgaaaaaggaaggagtgaatgagataagaatggggaggaggatgtgaggaaggaatacatcaagatgccagggagctgagcaagaggcagccagggagaagttctgggctatggccaaggatctttaaagagcaaggatctttaaatagtcagttttaagatgtttggtg

SEQ ID NO: 274 - DNA, 164976 bp, Homo sapiens
tttgaatcccaactctgacactcacaagctacgtgaccttgagcaagttcctcagtgtctgaggtctcagttttctcatctgaaaaatgggaataatcaaaatacttaccttggtggggttgtttttagcgctcagtgagttcatacatgggaagtaatcacaatagtctcaggccacgtagctgacgtctcagctgcctgctcctttatagacaagagggaaagtttgttttgttcctttgaagctgcattataaaaaaatttgactgctgctgtgctatcaaatgtagtttttttttgtttgtttgtttgtttttgagactaagcttcactcactctgttgcctgggctgaagtgcagtggtgcaatctcggctcactgcaacctccacctcctgggatcagtgattctcctgcctcagcctcccgagtttctgggactacaggcatgtgccaccacactcgactaatttttgtatttttagtagagatggggttcaccatgttggctagttggtctcgaactcctgacctcaggtgatatccccccacctctgcctcccaaagtgctgaaattacaggcataagtcactgcacccagcccaaatctagctttaagaacccagtctgggaggctaagcacattttaagggggaccatgggcccctcatggatgcacggctgggctctgtgctgggggatgagggtggaggaacaaacacgtgatgtttgaagatgatcaatgtcatgattatctattatgcaaatactctgcacagacacaatggacagtgcagaagcatttggttatattctgccaagatttgctcatgtatcagtgctaaggtgtcaagaaggctcatgttaaccttaagggaaaggtactatattgtccccattttatagataaagaaactgagtctcagaaacaggacatgacctacccaaggccgcagaatcattgagtggcagagctagcaatggaacccaggtggcccaactccatccctttaacacttctcccttccttttctttctttccttcctttttctttctttttcattctttctttctttttctttctttctttctttttctttctcttttttcttttttccttttctctttccttctttttcttctctttttctttttcctttccttccttcctttctttcttctttctttcctttctttctttttcttctctttccctccctccctcccttccttctctctctctctctctcctttctttttttttcccagaatctctctctgttgcccaggctggagtgcaatggcacgatctgggctcactacaacctctgcctcgtgggttcaagcgattctcctgcctcagcctcccgagaagctgggactacaggcgtgcgccaccacgcctggctaattttttaatttttagtagagatggggcttcacctcgttggccagtctggtctcgaactcctgacctcaagtgatccacctgccttggcctcccaaagtgctgggattacaggtgtgagccaccgtgcctggcccatttttaactgtatctgtctttctagcattttctgcacgttaaggaggccaccgatggcgaagctgggttttgatttcagaaacagtaaaatgtgaaaaaaatgcgcatcttagaattgaggagacgcaccctgccctggaggtgacgttctgtgtcttgtgtgctcactacaagaatggctcttggaggagtggactgaaaacttctgcactgtgctgcccacccggcggtgctgggggaggtgctcaggtatggctgggggagtcagggagcaggtgagatgggagctggtccctgaaagaagtttgggcggagcagtggtccaggagttgttctaactaaggaacatcaccaggaaaggcctaaggaaaagaggccctgggggaggcggttcctccaaggagagtcctgaggccttagcaactgtgagttgtgagacattggggcacaggacagaggcagaacctgagtttctggtttaaggcacgtgggtaggggctgttgctatttgtcgagacagagaaatacgagacaggcgtagtgtctcacacctgtaatcccagcactttgggaggctgaggtgggtggattgcttgagctcaggagttcaagaccagcctgggaaacagtgaaaccctgtctctactaaaaaatacaaaaattagccaggcatggtggctggtgcctgtggtccagcttcccacttggggaggctgaggcgggaggatcacttgagcctgggaggtagaggttgcaataagccgagatcgtgccgctgaactcccccctggggtacagagggaaaccctgtcttgaaagaaagaaaagaaaagaaaaaaaaacaagagaaagtgctttcggaacagagatgaattaaagtttggaaatggtgtgtgtgcgttgttttggggacactgtcatgctgtccagtcagcggaagttcatcttgtcttaaaatcattctatgtgggaactgtcatcacatacacagtaatgaatgtgattggtgtcggtcaggtttcctaggaacgtcagggagcagagaaggctgcccaggacacaggaaacatcagtgtttaagtcgtctcgcaagagacaaaggctgctctctgttcacccgcgccaggcacagggcgcggtacctcctcggcaagtctttggaatggatgaataatcggaaggttcatggtgttgggagggttgctgagcagggaagccttaaatccagaaagcctcatctgcttcacaatgaaacacagcacagaggaagcaacaaggaggcaacacacatttataagaagggtgaggccccaggccaggcaatgaggacacagtggctatgaagacactgctcctgctctcagggtatcatgttggatttcatcccacaacgacataacagaacaggaaaacccgaacctatagggtaaatacaataccatgtcactttaacagtttttcacaccaaaatatgtggtttaagggtgtgatattgcagtttggtagcctttttttttttcttcctttttttttcagagacagggtcttgctttgttacccaggctggagtgcagtggcatgatcacagctcactgtagtcttgacctcctgggctcaagcgatcctcccatctcagcctcccaagtagctaggactacagatgtgtgtcaccatgcctagctaactttttatatttgtagagatgggaggggtggtctcactatgttgcctaggcttgtcttgaactcaagcaatcctcccctctcagaatcccaaagtgctgggattataggtgtgagctactgcaccactgagccaaaaacctgccttggtagctttttattaattactcattattttattttattttttagatggagtctcactcacttttgtccaggctggagtgctgtggcatgatcttggctcactgcaacctctgcctcctgggttcaagtgattctcctgcctcagcctcccgagtagctgggactacaggcatgtgccaccacgcctggtcaatttttctatttttggtagagacggggtttcaccatgttggccaggctggtctcaaactcccgacctcaagtgatccacctgacttggcctcccaaagtgctgggattacaggtgtgagccactgcacccggcctccttggtagcttaagagagcaaatccagagtatttcaaaaatactatgagatgaaatcattagctctttttgtggaagcttgaaaggacagcttggaagaccaaggagagactttcaaacatcacagtaacaggctacatcctggatccgctctccttcagtgcctacaacacatccatatggtctgcccagaggcagggattccgtgaaaggcagatgtcacccgttctatacagatggtggctctttcctgacatgaccaaggcgaactgtgcataaatccagaaagcctcacctgcttcacaatgaaacacagcacagggtgcctctgagagaggaattagcaggaaatggacatgcgcctatcaaacaatggatcgattacattatcccacgtctccatccactgccctagcctcattggcctttccattccctccattctggtctctaaaaagaagggttcggctgggcatggaggctcacacctgtaatcccaacactttaggaagccaaggtgggtggatcacttgaggtcaggagttggagatatggctatgttgcccaggctgcagttctttatgtattttggatacaagccctttatctgataaatgtgctgcaatttatttttccagccttgcctcccattttctaatatcactgaagagcaaaatctttataataaagtccaatttagtaatattttgcttcgtgactcacgttttctgtttgttgagcatagagaatttaattttttaaaaaatttcacaaaatatgagaagttgttggctagcatttttccaaatttttgggggcccattctttctttcctttctggtactcatcacctgtactttagacttttgatatagggtcctgaagctttgcttaataaaatcctttttgtctttgtattttagaatgaatactttctactgatctgtcttcatgtttcctgactcttttctctcttctccattctgctattaagcccatccagtaagttttaaaatttcagatgttatatttttcagttctgaaattttcatttgattttttctatgttctaggagatatcatttcttttcattcatactaagtatattttcctttactttataaagctttgttataggagctgctctgttctcctgcagtgataattccaacatctggggcatcttaggactgttttatcctttgagagtgatgtattttcttttcttttttctgttgttgcttttgttgtatgtcaagcaattttgggttgtatgctggggattgtggatattacattgtggagaactaggattcagttatattcttctgaagaatgttgaggcttttgcaggcaattaacttgatcagactccagtggtaagctttctattgcttcctctgggcagtgattcaaatcttggttcaattctttaagcctctgttgccctgtctgtcctgctcatgcatgctttgggggtaagcaagagatctgtgtgacgctcatatacaaatcagaggcttcctatccctggcttgtctccctgctaggactcctcactccccagtgacccaggcttcttcctctggtatctctggtctaatacacagtgaatgttaggccaggcctggtggttcatgcctgttaacactagcactttgggaggccaaggcaggtgagtcacttgagcccagcagtttgaggccagcctgagcaacatggcgaaactccatctaccaaaaatacaaaaattagctgggtgtggtggtgcatgcctttggtcccagctacttgggaggccgaggcaggaggactgcttgaacctgggaggtggagattctcatgtgctgagattaagccactgcactccagcctggacaacagagcgggacctcgtgtcaaaaaaaaaaaaaaaaaagtgaattttgagaaaaactttattgacctctggtgtgctgctttgcaattgtggtttgccctcagaccagtgtggaggggaggagagactcaccaaggttttgagttccttgcatgtcttcactctgaatcgccaggtaggtcttttcgtctataaagttatctgtaggaagtttggactataggggcttaaaccactcaactccagctggagtcaattccttttttgttcagggtgcacaagcctggagttttcagattcccttttactccttctgtgacttccatctttcctgtctttctgtccttaggtatcttgcagtgctgctagattttcccaggaatcttattcattcccatgacgtccctgggctgcactcccatgatgcagttttcagtgtttcctgagtttcatgcctgtatttcaagccatctcttttacattcacatagaaccttcagtctagagtcactctcttgtctggctcacctgctttggttactgtacagtatttgttcagtgaactaggcttagaattactacaagtagaggatatttttgttatcacctccaatttcttcaccgagtgcactgaactaaagatgacaatgatgctgctagttattgatggaactactgagaatacttcactttgaggacaatcccacaaggactactaccaggcttaggaatatcacttccttccctttcttcctcccctatcgattgagtgttcatagtgataatcggtatagattactatgtgatcgccatagctatatagctttacccaccatccattgctgagtattctttgagcagcaactctatgcccttaggcacagttccagctgctggggatagagtggcaaatgggacagacatggtccctgctgtctggagcttgcattctggtgggtgggtgtggtgggttacacttcgagataattaagcaaggatatttctcagcgatgcgctatgaaaaaaacaagcaagggaacaagaatgcaatactgggacaaggagtgtaaccttagatagggtggagcagtgtattagtccactttcacactgctataaagaactgcctgagactgggtaatttacaaagaaaagagatttaatagactcacagttccgcatggctggggaggcctcaggaaacttacaatcctggtggaaggggaagcaggcatgtcttacatggcaacaggaaagaaagagtgtgaaggagctatcaaacacaaaaccatcagtgtcatgagaactcactatcacaagaatagcatgggagaaactgcctccatgatccaattacctcccaccaggtccgtcccttgacacatggggattatggggattacaattcgagatgagatttcagtggggacacagagccaaaccaatttgggtggagacacagagccaaaccatatcaagcaggaaggccactttcaggggtgagcgtttgagtggatgttgaaatgatgacaagaagccagtttctagagaggcacagtggctcactcattctaagtgtgctgcaaagcccctttagtgaagaaatctacttctcaaacataatggtcagaataatgaagggtaacatgattattcacatttaatcgacttcatttacatagataaagcctaaaggaaaaatccaatctgtatttatgtgcatgcactgatgtttaaaaatccactggaggaaaaggaaaatttagtcagcaaaatcttttctagataaatgctagaaatcattattccaagaaaagaatcctccacttttactatatgtgtgtgtgtgtgtgtgtgtgtgtgtgtgtgtgtgtactcattaaaaaatacataagagctcctccatggcttgagaatattttatgaagttataaaaatcagtattacctgtcaagtactatgttacatgtgcaatcaaaactgttgaggttacctgaataaaaaaaatccctgatgtctattacagaaagcttttaacagaacttgccttggcaatttactcctaaatcttctttttcctccagctcaatataatattgctacctaatattgtgactgcacaaaaccattttaggtaccacttgggaataagtattaagagttcaagtaaggctgggtacagtggccaacgcctgtaatcccaacactttgggaggccaaggtggaaggactgcttggggccaggagttcaagaccagcctgggtaacagagcaagaccttcaactccacaaatataaaaataaaaaattagatgtggtgacacgagcctatagtcccagctaatttgggaggctgaggtgggaaggttggttgagcccaagagttcaaggctgcagtgagctgtgatcacaccactgcactccagcctgggtgatagagcaagattctgtctaaaaaagggttcaagtaaatgcaaatgatgttttggcaaccttttctcaaaagattctgcattggaatacagactgtaatattaaactactatgtgtatattgtttctacagttgtatacaccgtagtgtcttttacaggtatataaggtcaatggccctagtctaattcagatttaaactagtgcttgccttgtaactctgcaagtgatcaataatctcttaatactgaaaatcacaaaataggataaaacgttctgttgctagtcccataaagcttactacattttttccccattctccccaaacttaggagaaacttgactaaagatgtgagataaaattatttattgtaaaaagtaaatgatcatctccccagccccattcccaaagtcacttgagcctttgcaatccaatttgagatcactttaaaaaaccttcccccgtaacatgtccttgtgtttttgttttttcctccaattaaagtgattaattggaaaggggagcattaggtgacattccttgccttgagacagctggtggtttcctacaccctgtggtggtaactccagacatggagcagctagagctgcggacagttactgctgcagacagggctgtgtcccgtgactcattatggttcagttcggtttctaaatctcccccagtaaaaatcctccccctggaaccatctgctctttggacaagcttctgccccctgaacctggtgcaatcagggtctggtctaggctttgcagagctgggaggaaatccctgggcctccagctaacgctgtccaaggtgctgaataccgtactcagtgtgttgccactggctgagctggtgcaacctttcacctctgagaaacgttttccaagacaggacagtgttatggagcatggactcaagccttgggccatctacatccgttctttctccaccaagatgagttaggcgaccttggccacgtgacccccacctttctgagccaaagcacttaaaacacataataaacattcaaaaccatagcacttagaatcaggaagtccttttatcgtttttcacagtataaggcacttattttttgatatcattctctttttttaaaggcaaaggaattacaagtgaacacactagtcatggcccatcagaatgatagatgcttatctacaaaaacatttcctgacttcttgctgaacctcttgcctctgggaaatactgctgtttgcttacttaaaaagtggtgagaaattaatatgattctctcttcccttttaaaaaattaaatttgtataaatataaggcgtacaagtgcagttttgttacacggatatattgcgaagtggtgaagtccaggcttttcctgcaaccaacaccagaaaagtgtacactgtacccatcaggtactttctcatcccttaccctcctcccacccttctgagtctccaatgtttgttccacactctatgttcatgggtacactttatgtagctcccatttatgagtgagaacatgaagtattcgactttctacttctaagttatttcacttaagataacagcctccagttccatccaggttgctgcaaaagacatggtttcattctttttagtggctgaatagtattccattatgtatacataccacatgttctttatccaatcatctgttgatgtgattcccttttctttgcatattcttggggtacttttgaatcagttcttttaagtttttggggaaggagatttggtttcattttcattactttcaattatctccattatccttctgcaaacccatgtgccacaattcagagcattgtgcatacgtaagaacagagtgagagctccttttcatttccccctggaggaacccccatcctggaatcgaagccctctgtttatgatccaagtgtcaccacatctcaagtctcaatgtgtgtgtgtgtggttttttttttttttttttgagacagagtcttgctctgttgcccaggctggagtgcagtggcatgatcttggctcactgcaacctctgcctcctgagttccagcgatctcctgcctcagcctcccgagtagctgggattacaggtgtgcaccagcatgcctggctaatttttgtatttttagtagagatggagtttcaccatgttggccaggctgttctcaaactcctgatctcaggtgatctgcccgtctcagcctcccaaagtgctgggattacaggcgtaagccactgtgcctggcccaatgtgtggttgttattagctatgccctttaccgaactccttttcttgacctcctatacctacacctgttgtaaagaaacaaatacaaaacaggatttcagcaaaacactaaaagaagagcgttctagttttttaaaaaatttaattttcttgtggcacataacaatgaactctggtgtcaccagcctattgtataattaacttctcgtcttttgttccttatgaatttacatatttaattatctttccatttaatttcccatggttttgctacgttgactaaactctgtaatgagaaagtcttttaatttaatagactttgcaggtcatgtgtaaccagctttggaaatcattttaggattactgagtgctgtttcataatgctgtatatttttcctgccaggatttggagtacctaggttatttgtccaccagaacaatggctgtaaaggagaaaattgagcagtggtcagaagctgctgagaagatgcggtaaaacaggttacataaaaaacaatgctggtttgaaataacctatgcgcttttgtcaagggattttgcattagtgcatttagtccaagtcagggccaattcagaggatgtggctgaaggcaccgttttggccttttttgtttcttttgagagctctgcatacattcccacttttcctgtcaaagtggacaaaatgaagagtctcatgagtggaggggcattctgatcccaagagaccacccatctgtggagtggctacacagccagaatgtggatgtgaaccaactcaacgtgctccccagagactgaagaagcggcgttttagagctttggtttcagtctcttggaggagattttcagaaatggccaatttatgtgcaaaggtgacttttctaggcacccaggaaggcaaatttaagctccgagctgtatcaactgcattctgttcctatcatcagaagtctcagaattgaacagtaaatggtgcctacttggctccttgtcaaaataagtctgcatggctctcacaacaagggagacagctgttcgttccgctggaaaggaaaggagatgaactttgttttgcctagcgttttgggaatcgtgaccacaatttaatacaatcaggtgtagtttgtttaaggaattatcaaagatcatacttggctgtcagattggaattgaggtcgataggcagactttgaccatatgctaaccagaatacaatccaattcaaaagtggagttgagaaacacagcattaggagaatttattcaaacatccatgcagagatagtctaatattttaaaaactgatttccaggatcattcgctccattttaaaggaaatgcagttctattttgaatataattcaggacagggccccagctctctgatttatgcaaaaggacataaattcacaaacctgcctgggctatttttatatttcagcaagaggttgtgtgcagctgctgtttctggcaaaataaaaaaatagtgcaagtgaaaagtgaacgggaacgggaaggagcgtcattttttcttgatcaaatccatgagatcgtcttctattcctttctcactcagctcatctagactgtagtatcggtgaacaattttctcggcggtgaccaccacgactcggagcccgtgggggtctctgcccagctggcatccaatggcagatgacaccaccatgtcgaggttctggtaggtacccccggcattcctgtggtagtggcctgagaacacgactttgacacctgcagagaagggaaaaagtcattagggggccgaggacttccattaggtaacctagggtctccagcattttattctgtgaacagtaatatattaaatatattattataccatcatgtagaattatcatattaaatgtataatattattctgtatataatcaacaaatagaaagcgtatgtgatgtccagaatctttgaaaggatacttcatatatataatatattattaacatgtttgtcataacttgtacaaagacgtactagggaagaaaatgagagaaggaagatgaagtgaatgactttgagaaaagacaaaggagactgaagaaaacagcctgagtcctatagaaatatccagatgacaaaagttatgtattttaaaaataacatttatggccagggatggtggctcatgcctgtaatcccagcactttgggaggccaagatgggtggatcacttgaggtcaggagttcgagaccagcctggccaacatgatgaaactctgtctctaccaaaaatataaaaaaaaatgaccaggtgtggtggctcacgcctgtaatcacagcactttgggaggccaaggtgggtggatcacaaggtcaggagtttgagaccagcgtggccaatatggtgaaatctcatactaaaaaatacaaaaattggctaggcgtggtggcaggtgcctgcagtcccagctacctgggaggctgagacaggagaatcacgtgaactcgggaggtggaggttgcagtgagccaagatcatgccactgcactctagcctaggcaacagagcgagactctgtctcaaaaataaacacataaaccaacaaataaataaatataaaaaaattaggagggcctggtggcgggcatctgtaatcccagctactcgggaggctgaggcaggttatcgcttgaacccaagaggcagaggttgcagtgagcctacatcgtgccaccgcactccagcctgggcgacaagagcaagactccatctcaaaataaataaataaaaataatgtttatggcattctaattaaggtagcagagcatgtctgacatatgatcaaccccctctgctccaaacagccgtagtggatgaaacgtaaaacagaaaacccaaggtcacaggtaggctcaaaaacaaaacaaatagctctacaggccagacacaaaacagagaggcaaagtcatgagtgggagtaaaatgtcaccgggagttcagctcttagaagatcatagagactgaaagcattttcaggggaaaatggggaaaataaagcctggctccctgctggaagaagggctgttgtgggtgcctccgtttacggaaggaggctgaagaacgctgctgctgcctggggctggggaagtggtaggctggtaaatgtttcacatgttattattttttttaaagacctgatttgtcacatttgtcaatttccatggtgtaaatacttccactgtggccgtggctgatttcaagttgccaaggtgatgtcactgaaccagatgtagaagagatgcccagtagtgcccattacatatacatcagatctgtttctaccatagagatacaagagctgccaacagcctcaagagcatggatgacagcaatatttagcaaaagaattacaaagtgatcagttttgagtatttattacctttgctttttaatataatctatttaatactgagtttatataattattaataatggccacttaacaaccagctcacaacattccttaaaatgtaatgattggtcctaatgagttagtaggagctgtcaccagtacaccactaggctaaggcttactgcaacctgagagtctaggaaggaaggagagacacaggttcaagtctaggaactgaaatgacttccccgatattaccatggggccctaaaccactattataaggcctggtcctgaacgggggtgggggtggaggtaatgaaaaccactagagagagagaagttagtcaagagagaaagaatgagggaaaaacaaaaaacaaaaaaaacaccccttactcacattgaccctgaaatgaaaaattctgctgcccatggagaaatcacgtggtaaaatagtctacaaacccttcaattgggaacacaaattcactccagatgaaattaattatttaagattgtctgacaaatatttcaaatcaatgtgtttaagatatcaaagggtccttaataaaggactaacacccataaaaagatgttatgaaacaacataggcataaattgaatgagaacaggaggtaatgaacatttagagatggtggacacaaaacatccattaaaatttaaaataaaaacaaccctcaataaatgagataggccaggcatggtggctcatgcctgtaatccctgtactttgagaggctgaggtgcaagaattgcttgatgccaggagtatgagatcagcctgggcaatgtagcaagaccccatctctataaaaaatagtaaaataaatgagatcaattctagacatcaatcaaagaggaaattagtgaactgagaggtaaaactgaggaaatgatccagaagacaatacagagacccagacacaagcaataggaacatgctcttgatttgagttctctgaattcaaaaattcaaaggatagattaagatcagcagaagtttagaggagctggtggaggagaaaggagaaaataatagtgagaagaatttgaagaaataacagaaattttccagaaagaaggaagacacaggtcctcagataaaaagtactacacaggaaacatgacagttaattcctactgacatatggtgcaataaaattgtggtacagcaaagacaaagagaaaaaccatagaaagaaccgcagtaaaaacattataaagaaatgataatcacacagatagcaggaatcttaacaataacagaatcaaagagtaatgccttctaaatgctgacagcaaataactatgaacctcaaattttattcctagctaaactatcatttaagtttgagggcaaaaaaaagacatgtttggaacataaaaactaaaagtttaccacgtctaaatcttcactgaatgaattgcttcagcaaaagaaaggatgaaatattaaaaaataatgatgaccaaacgccaatattttggtaaactgaattaactattgatttttttaaacctattttttaatgttaaaagtgaaactaaacatcaaaaatgtcaagataaggagtttggtggaaacttaaagcatatataagttattgccatgtttggaagggagataaaaatacggaataacctgatactttgcaagaaaaaaatgtatagttaccttatttctttaaaatgtttgggcatagcagtcaaactaaacttcatcaaaattaccaacttttgtgctcccaaaacattataaaaagtgaaaagacaacccatggaatgggcaaaaatatttgcaaatcatgtatctaataagggtctaatacccagaaaacataaagagcttttacaactcaaccaaaagacaacccaattaacaagcgggaaaggattttaacagacatttcttcaaaggagatacacaaatggccgataattacatgaaaagatgctcaacatcatttatctttagggaaatgcgattagcgacaatgagataaccacttcatagccactcggatggctgtgatgaaagagatggaaagcaacaagtgtttacagggatttggagaaattagaaccttcatacagtgctggtgggaaagtaaaatggtacagttcttttggaaaacattttggcaattcctcaaatgttaaacacgtatttaccataattgtgatatttcactcctaagtatgtatctaggagaaatgaaaacatttgcccatgcaaaaacttgtaggtgagtgttcctagcagcatttttcaaaagagcctaaaatacggaagcaacctaaatgtccatcagttgatgatggataaacaaaatgtggtctacccatacaatgggatgttattcaaccacgaaaaggaataaagtgttgatacaagctgcaatgtagatgcaccttaaaaatattaagctaagtgagataagccacttgcaaaaggccccatcttgtatgcttccatttatataaaatgtccagaatagctaaatccatagagaaagtagatcagtggttgctaggggctgagggaagggtggaacgggagagtgactgctgacaggtgcagggtttctttgtggaatggtaaaaatggtctgcaattagatcacggtgatacttgcacaaccttgtgaatatattaaaacgactaaatttgatacttcaaaagagtgcattttatggtatgtgaattatagctcaataaaaatgcaaaaaatttacaggaagaggaggaagctaaaatgatccatatcacaacaacggattagagttggagatatcagtggtaattcatgtttagcttaatattgctgtggtttcacatagaaatatttatagatgtgtatatacataggccagtacatagacattcgtttccttgctctgtcagctgagagcccctagaagtatgtactagcaatgagagcacctagcactcagatctggcttcctagtaaggattctctaataaaaggaactatggctccttggagaaatggctaccatagcattgagcaagaaatacagaagatgaacctggaacatcttgtgttgccagaaaggatagtggtgctcagaaacaaaaaccctgcaacgatggggtatggcaaatggactcaggaatcaagtgacaggattcccaatggccaaagcttaacaatctgagtagtgaaataaactagtgttgaattacaacccacagtataaaaaaatccacgaggcggccaggcacattgactcatgcctgcaatcccagcactttgggaggccaaggtgagaggatcgcttgaggccaggagttcgaccagcctgggcaacacagtgagatcccgtctctacaaaacattacaaaattagcaggtgtggtggctcatgcctgtggtcctagatctcaggaggctgaggtgggaggattgcttgagcctggaagtttgaagctacagtgagctatgaccgcaccattgcattccagtttgggtgacagagagaccttgtctctaaaaacaaacaaataaaaactttgcaagaccataataataaactactgaataaataaataaatggtagggggagaaacatctcctacacacagaagagtaacaaataaatgacacagacaccccaccctctaggaagtagtgcatctttcttcatcccttaggtgtgggctgtgcatcctgacttctgttcaaagagtatagtttaaagagaaggttaaaaaaaaaaagaatgtatttacagtgaagaaactggacaaacaccaaaagcgataagtcacatgattagtatgtgctcttgatatgaatgtgatagaaatggcacttcacctctgtggtcttcctctcccaaatccatcaccccagtctaatccagagaaaaacatcagacacattcccaagagagacacattgtatcaaatacctgaccagcactcctcaaaactgtcatcaaaaacaaggaatgagtgagaaactatcacagccaagaggaaccgaagcacatacgatgactaaatgtaaatgatccatgtgtttttatttttttaattatttatttatttttaatatattttttgaggtggagtctcactgtgacgcccatgctgaagtacagtggtgcgatctcggctcactgcaaactccgcctcccgggttcaagtgattctcctgcctcagcctcctgagtagctgggattacaggtgcctgccaccatgcccagctcacttttgtatttttagtagagattgggtttcaccatgttggccaggctggtctcaaactcttgacctcaagtgatccacctgccttggcctcccgaagtgctgggattacaggtgtgagccatcgcgtctggctgtatttttaaaagtatacttatcccctgtaccattttccccattcattaacatattatatcagaataatacatttgttacaattaatgaaccaatattgacatattaagattaattaaagcccatgattagattcccttagttttttcctaatgtcctttttctgttccaggatctgaatgatttttactagttccacactggggaacaggaaggaaacagagattgagaatggtggtaaagaggggtaagggaaagaaaatgaggagacaagagagcaaggggagagaaaaaaaaagggcatgaagggaatatgctgatagcctctgcttctggtgagtggggttctgggaggctgtaaagagagctcttgggactatagctacctgtgctggcaggaactggagattcacctgtgggcaggtgtggatcagctcaggtgcataaagtactcagccttccctacttaagacagccacaggtggagagaaacagctacagtcacgtgcagcacatggacattttggtcaatgatgaacgccatatatgaaggtggtcccataagattataatgctgtattttcactgtaccttctctatgtctagatacacaaatccctaccatggacgttttagtcaatgatggacgccatatatgaaggtggtcccataagattataatgctgtattttcactgtaccttctctatgtctagatacacaaatccctaccatggacgttttagtcagtgatggacgccatatatgaagggggtcccgtaagattataatgctgtattttcactgtaccttccctaggtctagatatacaaatccttaccattgtgttatggttgcctgcagtatccagtacagtaccatgctgcatggtttgcagtctaggagccatgggctatagcacacagcctaggtgtgcagtagactacaccatctaggtttgtgtaaggacactgtgatgtctgcaacactacaaaattgtgtaacaatgcatgactgcaattccattgacttcttattagaatttgaacagaaagaactcatgttaagggggcaatctagcaatactgtcgcacattttactgtacattcccttggcccaaaaaaaccattttggtagacagttatccttcagaaatccccagggaaaagcccaaagatgtatccgggctgtacctgtggacattaatatatggttcaatgtgcatcacagtaccgttagtaatgtttatttatggaagacctgttaaatgacattatgcgcattttttaaaaagaggtaatttacatgtactggcaccaaaaggtgccaaataccattaatatgtatagcacactgctgcaaaaacatcgtgtgatcctgtgtaaaataacgtatgccttagaaggtttgtgtgcatatacaggctcgtgtgcctatttgtgtatatgtatacctcagagggtatgtgtgcatagacattaaactgcttatagtggtggctccaggtgaggggtgtggggtgggattagtgagaggcacatcattctctcttattacagtagtgtaatgcttccaatgatcacgaattaatcgggtgattgggaatgaaatcccagcacttttggaggccgaggtgggcagatcagttgaggtcaggagttcgagaacagcctggccaagatggcaaaaccccatctctactaaaaatacaaaaactagccaggcgtggtggcaggcgcctgtaatcctagctacttgggaggctgaggcataagaatcgcttgaactcgggaggcggaggttgcagtgagctgagattgtgccactgcactccagcctgggtgagagcaagaccctgtctcaaaagaaaagaaaaaagaaaagagaaaaaaaaagaaaaagaaacattagggcaacatgaacagggcagggtggcgtgacagatgcagccactgccactccagggcacaaactgtgcagttctcaggttgcagctgggactgctgggttgggcgcctgatgggtccttgccataaatagacaactgaaaggctccaatcgtacagactgcaggggcggtggaaatgactgcctcctctgtggctctcctggggtttcacagccagtctgtagctcaaatgggaccgcgtaagatcagccctgcctgggggaacgctgaacggctggacagaaagcacttagcattattatttctttgcatgctaaattatgtttatgagatttggctcttcatgcctaactcatagttgcaaactgtactattctggaaagaatgtctggcaattttgaaagaagcttgcattagccataattagctgtaaaaactcatttatgtttaagtttcacaccatattgagtggcattaacagagaggggagcatttaatggtgattgttcaagtgcccagaggacctctcagagcgggtctccccagacccgtggacagctgttcctctctgtaatatgcatgtcctctccatctgcccctcagggctcaccaattattgttaacgtccgaagtcacagaaaatgtgaccaaacgaggattcttaagagtagcaaagatgctgcaagaggactagcaataaagatgaggccgggtgcggtggctcccacttgtaatcccagcattttgggaggccgaggttagaggatcgcttggggccaggagttggagaccagcctcggcaacatcataagaccctgtctctacaaaaaaatttatcaaatcagccaggcatggaggtgcatgcctgtagttccagctactcgggaggctgagaagggaggattgcttgagctcaggagttggaggttgcagtgggctatggttgcaccactgcactccagcttgggcaacagagcaagaccctgtctcaaaataataataataaaaaataacgatgagagaaactactagtgagcaaagcagttgtgttcaaaaccttctccttctggtaaaagagagtcctcccccaattccaatgaggaacttggccttctgaggtcctgcatgaaaaaaatgaagcaatgactatgtgatgagtttacaaagagacggtcaggcaggggacgaaagtctgtctcagaagcaggaagatgtgactaactccgtcctcctgggttctgatgctgagttcaaggctctggcatgttcctggctggctcaaggagtctgaaacgaggaatgagatgttgagctggaaaatgggggaaacacttcttgggttggagccaggtccagaagaagcctggtgagtttccagacgtgggggtttctgagtctatttctcagctccagggaggcccggaagttctgaacccgaaatatttctcctagttccacctccagtaagggcaaccgctccaggtggagtgaaaggaggcggggcctggaagggggtggcacagtggcggggcactctgtatccttcatcctgttttactgaatcctcccaatgcacctctgtcctagggactcacatcgtctccattttacagatgagaaaactgaggcccagagaagttaagaaacaaacacaaagccacacagctagacaacagggcatccaggatcagaactcagggtactcagacatcagagcccattctgctttgggaccttggacccattactgacctctgtgagttggcatttcctcttttgtaccatgaattaaaatgacagcccatatcatgggtggcagaggtctgggggggagcatgggtgtcagtaccaagctcctcatcgccccacccaggaggctttctccagggcagggccagcttctcactgctggaggggggcacacagcatggcagtccagctctgcaacacgcagcctctctccgagttataatcctgtccctttcatgccgacaggccacaaggacctataagaagttttacccatctcagctttctattagcttttgatagggaagcactgattcacaactcgatggaggtaaggaatgtattaataaatcttggtttccctgacggggtattgattttagtgatgttttcaagagctgggcagaatttccactcagcctgggcatcagtcatctgtggctgacatgcctctatggttccttaattgagtattatgtatagattgtttttgaattatgaactgctgtaaggagatgacaggcatctttttaaattactgccagaagaatttccagcaaaggcagccactgcatcaacagaggatgatttctgtggcattagcttcatatgttttttttctccacggtatcaagtcatgaagacgctataaaagctatttttaagctatcttgattcaagttcatttcaaatcaatcagaggattgggacacagtcactgtataatgtaatattctaacattggaaacctgcttcaaatcaatcaggaaattgagatgcaacccagtacaattctgatactaaacactggccttctttaatgccttggtgttggggcttagacctggaaagtgtaaacacattccaactggacagcctttacttttatcctgcatgagactatatttgtgaaaatgtgatccagctttacgttgccagctataacagtgaaaactgcattgcaaaccatcactcacactgaatttattctgcctcagtggtagggaaaaatgtgacacaaataaaaaagagggagagaaatggaaagttaaaaaaggttgggtgtgaatgtacagaaagtaggtataaataatccctcctgccggtaaagaatttccttagcaggctttgagataagagattctggccagggggcaaaggggaagcgacagatgtttcttaagtgggtttgggaggtgcagattgaatatgaagtcatggttaagccccacctgactcattcaggaagaggttcttcacttttcgtcgtcaattggggaattctagattccagcatatttgctcactctcatcagaatttccctggtatatatcttccccagtgacccaatgcctgtggcccaggactgccaggggacatggtggaagggatccgggtaaggtgggaggctgcttcttcagttagcttgagacaataaacatctgttgagctccctcttggtgccaggtattaaggagtgtggtgggatcaaccattcccagcaatcaacaactcaaggtctatagccaggcagtcagagaaagagctactcataacaaaatgcagaaatcgacatcactcagcagcgttttattcgctggacatctacgacctgcattttgcacctgcatcatctcactcaagcctaatgaggacgctgaccaggaagatatcatccccttttgcagatgagggaatgaggcgaggacaggttaagtgacttgcctggattcacatagctaagatgtatacttggataaggccaattcagaagcacaggctctgtccaccatctgagaggtgcaaagtgccaaagatcaccgtgccataggccctgtaagaaggcttcctggagggggtggctctgacctaaacacatccttaatttctcctagttctctgctcatgtctgacctgaggcctgagggggcatcatattatggtggtaataataataatgatgataataatatttatggagtgttcattatctgtctagacattgttctaggcacttcacttgtttttagctcatttaattcccacaattcctccatgaaggaggcatggttattacctgtgattttattatacgatttagagatgttcagtagtttgcctaactcagcctgtaagtgttgaagcaggatctgaacccaggagtctgtccccagagtcagcactaaaacacctgccaagtagaggtaaagacacatcaggtgaggggaatatcacgagcgagtgaagagagtcaagtgtgtctaggaagcagcaggcaccaaacgtaaaggctcctgcagactggcacctgctgggcatccgaatttcctcttcagcatttttaatccttctgacacccaacatcaagaaactcctgcacatttcccagaggacacgactgaaggtcagctggtgggtggtaccagaattccagttcagattctggcttggctagaggataggcgagggcggggaaaggcggggccagagggctgcatggggctatagactggctgaaatggaatgacttacaaaaaattccaaggttggctgggcgcggtggcttatgcctgtaatcccagcactttgggaggccgaggcgtgcagatcacttgaggctaggagtttgagaccagcctggccaacatggcaaaaccctgtctctactaaaaatacagaaatgtggatgtggatgtggtggtgggcgtcagtaatcccagctacttgggaggctgaggcacgagaatcacttgaacctgggaggcagaggctgcagtgagctgagctcgtgccactgcactccagtttggtggcagagcgagactctgtctcaaaaaaagaaaaaaggaagtgccacggtcgtgtatgtgtcttccttcttgtggtaagcatcaaagcatcccatcacttccggcttcagcctttcattgattcaaaccctctcatccccaaatcctgttaactagcatggcatcttaaagacattttcatggaacttcttttgaggatcacttggaacttaattgacctgggtcagcaaacattttccagaaaggtctggacagtaaatattttcgcctttgtgggccatgtggtctctgtcacgactactcaactccgccttcctttgtagcgtgaaaacagccatagaaagtatataagcttgtgggcatggctgtgatccaataaaactttatttacaaaaataggaggaaggccaccctcactaataaagcataccattaaaaagaatacacttgggtaaagttcagccaagagttcttgattcttcaaaagtctgaaagtttctgtgcttctcaaaaataaaaatcaaaaaacagtgacaacaaaggaaagagtaatttgtagtttcatttataaaaccatgaatgccatttcaaataagggaggcaagtgaattgtgttagtgaacacaaaaaaggtcaactattctataagtaagagcatctgtcctgacggtcagaaagagacttctatatctactttaaaagtgtccacatccttccatctaaaaaagtaactcagatctaattcaactgttttggccattataggtaccttgcatttccacggaaattttacaatcagtatgctgatttctacaaataataaaactgctataattttgattgggattttgttgaatctgtcgctcaatcgggggggaaatgccgtattaacattggccctgcaatccatgaacatggtctacttttccatttactcaggtcttttaaaattactttcagcaatgttttgtaaaggtagaggtcttggacatcctttgctattcctaggtatttcatgttttatggtgctattgtaaattgaattatttttgtaatttcacttaacaattgcttgctgatagtatataaaaatacaattatttttgtctattaaccttgtatcctgagaccttgctaaattcatttattcattctagtaattattttgtagattcctgggattttctaagttaaaaaaaatcgtatcatctgcaaataggccattttacttcctatctttatgtttcttatttctttctcttgctttttgcaatagttaggatctccaatacaatgttaaaaagtattggtgaaaatactctttttcttgttggttataaatttagttttcatattcctattttttagacttttgatatgactgctaaattattcttcagaaaaacataatcaatttaaatacccaacaaggatttgagagtttgatcagtgaaagctcattctttggtgatctcacaaaagccttgcaaagattaaaagggaaactcctcaggaggacctaaagtaaatatttgtttatccagaacttctgagtaactgctatcctccccattcgtttttcatgctggataatccctttcatcttcctctgaacaaagcaggttcacggacttactatggttggacgtgtgtgtaaagagtaggtggatattctttttactattccttttcttgcatcttttctgtaagcttgaaaatatttccaaataaaatgtaaaacaaaaacaaaaacaaaaacaatgcatacttgttaaattaaacccaaatgttgtaaaaatacagaatatcaaacaaaagaaagtgggaggagggaaatttcttgaaatccctattcctgttttaggagtttagtgtgtattttccagataatttaaatgtgtatactactatatatgttagatatagatctaaagaaacatatatacatacacaaaatttcacaaaaatggaataggctacatacagatttgcaacttgcttttatatattcgacaatgtatcttttacttattccattcaggatatgctgccctattttagagctactcactaacatcctgaaaactgtatttctgatgttggggctcagaaatggtaccccaaaacatggcactttgacacgctaaactaaagcagcagcctcaaggtctctctgaccttccctccccaagagcagtgacagactgtctctggaatttccttatctgactaaggagatgtctttctaaaagaaatgcaattatcttaagaatccctccctaggaatctcatcaaataaccgagaaagattagccaatggaaaagagaagagactaaaagtcatcaccatgcccagacagacttttcttccattcttctgagagtagctccaagagattacctgggagactttatctacataataagacaacctttgttcacaatgcagttctgcctcttaccttcccataacttactggtcccattcagtttcctaaaaaaatcatttagaaggtaatgtctgcttcctaggcccattcaattcccctaaaaatcatttatgactgctcaaaattgcctgcatttctcccatctccctctcccctatgaatagggtatataagcttcaaccatttgccccgagtcttatatattgtatggctctcaagttcagcacattaataaatctgtatgcattttttcctgttcacctgtttattgtcagttcatttcgacagtgaaccttcagaaggtggaacaaaagctttccctctgcccccacactgctatgtaaaatctaggttgccggatgatcaatctgtatcttaataataaaaatactgtaaactgggaggtcaggagagttcagagcctttcagccctctaaggactactcacatgcatggggacacacatagttactacagcttctcagagagcatccagattcagggggcagagacagcccccagggaagaaggagtcttgtctgcacagcccctctgatctgggtcttgggggagaagcccaactactcctgcttgctgtatcatcagcatgagaagagagacactctcaggttacggagtgcctaagccaagcagctctgcccctgtgagacctggggtgggctgtaggggcaatatctccttctggagctaagcctctcaaaggtttcactgtgatgggtccacgtgctcctgggctgaaccctgctggaaacctgggttcaagcctcatctcctctgatgcatgtgacattaacacctatacacttggtcatttcaggcatttgttcacatgtctggtccatgtgatataaagcatctggtttatcttaggattcatagcctcctcttgagattctcttcctctttctttctttttaatgttttgcttgggtaggaagcaatggcccagttgtcaaaatgacctttacctaaagccagctcatactctaaaacctgaagagatttctttgctttaaggattcctcccccgacccccgtttccccccgtaaagaatagccatgcgttattatttcaatgtgccccccaacgtttaagtgttataaacttaatccccagggtaacagcgttgggagatggacctttaagagatgattaggtcacgggggctctgccctcaagaatgcattaatgctgttatcagagaagtggcttcctgattttaaaacaaggatgaatttggccaggcccctttcctcctcactcttgccagggatgccccaacaagaaggccctcaccagatacagccccttgaccttggacttcccaacccccagaactgtaaaaaatcaatctctgttctttataaattacccaggctcaggtattctgttatagcagcacaaaacgaactaagacaccatgtaaattacacttttcatacctcacctgattaacgattcacaaaaattatattcttcccttttcaaagctcctcttaattaaaactaagaatgtgggagatggggatggcacagaagtggcctagaaaacacctagggctgtgcattctcggcttcattaggatgtaagtagttctgcagcaaaaggtttgagaaagagtggatggaagaggttcagtggtcacagttatcacaccaacacctggaggcagctgaggggggcccacattcccgttcataaaatgacgtttcccacttccacccaccgcatctgcatccgacttagaatcagaaaggacatggggatgtgctctcacactccagggcaaagagcagaattgggaaataattactctccaggggctagaggtggctggctgcccacttgagtccacagccttgagagtgtgattacagcatagcatcacttccctatcctggactcgaggattagttatgctcctccaacccccagactcactgccgtttattacttttttgagacagtgtctctctcggtcgcctatgttggagtgcagtggcgcgatcttggctcactgcaacttgcgtatcctgggttcaagcagttctccctgcctcagcctcccgagtagctgagattacaggttcccgctaccatgcccagctaatttttgtgtctttagtagagacaggattttacgatgttggccaggctgatctcaaactcctgaactcaggtgatcgacccactttggtctcccaaaagtgctgagattacagacacgagccaccgcgcccagcccctttattacttttctacatggggggctatgctcaactttttattttttccccttcctgatgacttacagattcaaaacctgtagaatatgcaagaggagggctgtatttttttaatactaatatttggttgtcagaaaagcagtggcagcctggggtgggagctaggggttgggagactcaggcgtgaacctcagttctgctgttgctgagctgtgtaggtgtggcatgggcagcaacatatctgaactcctcatttggaaggcaagactagtatcaaccatccccagggccactgggaagataagtgagaatcagggacacgccctgggtggcacagcaggaagctgcgtgtcttgtactcaggcagcactcaataattatactttcctctcatccttctctaagtatctgatcagaagatctttttcttttcatttgcacaaattacatctttctcactattcataatttcctctttatttttaaaagaagatggcagcttgcgtgtgaaatggagcgtggggcccacattaaggtttcaatccagaatggacaattttctagatttccatgctctatcttaaacacagctgtcaggacaagaggctcattaaaaagattgttttgactgacagaatgttcgtgtatcaaattggaaatccatccaaaaatactcgagggaggtagacagacgtggcggccagccacggaaggaaaatgttttgcagaatttgttcaagatgaaatttgctagggagaaagtgccctgcctctgacttgagccagggaaagccaagaagggggtactgcatccatcaaaacgtaaggaccttgggtaagtgagattccgtttgaataactgggccaagaaaaattctgatcaggcgatgatcccttaaagaacacacattaactaaatttgtgcacttttccttacccctgggcttcgaggcacttcctcctccagttaacagcttattcttcctgcatacatctccggcttccacaagccctttcaatggtggccttccccaggctctgtccattccccttctctcgtccctttccctctcactgatgaccaccggttctgttataacctgaaccaactccacctgccaaaaattcagaatcatttcccagccaacaatcggttcctaggcttcgtggacctctcttctggacatccttgcaagctctgcaaactcaacccgcttacttcttttgccccaatgcacacccctcctcgtgtgggtttaactggagcaccatgcagtcatccaacccaggcatgtgggagtcaccccgagactcccttcctccgcctggtccatgcgtcctgttgacctgtctgcctgaacacgcttacccccatctcctctccatcctcagtgtgatcttcctggttgcctgatctcctgtatgatattcagctgtcagtggctatggtggcttaaaaaagtaaaggctgtatttgtgcttaactatgatttatctaccccgtaaaaagaggaggtgagcagtccagggagggcgcagcctctccaggatttcaataaggatccagcctccttccatctttctgttttgccttcctcagtttgtagcttccatcctcaagatcgcaagatggctgcagggcttccgggcactgggtccaagttccaaggcggaagaagaggtaagggccaacgaaaagcctttctggaagccccacttgctaaacccctgaacctaggtcatgcagccacacacagctgcatgggggtctggagacggagtgtttcagcctgccatgctagtgccctgaacaaaacctgctctgttaggaaggaacgcagagaaaatgcatcccggtaaactgagcagagccatctttctcaaatgcaaaacctgggcacagtggctcatgcctgtaatcccagcactttgggaggctgaggttggaggatcacctaagcccaggagtttgggaccagcctgggcaacaaaatgagaccccatctctacaatttcttttttaaagcaaaaccacttgggccacttcgtcaagtaaaatttgagggttctccatcaccttaggatcctgatcaaacacaatgtctccatttgagcctactccactcactgagcaactccagtgccagtgccagtacaggacgagctattttgtggctccagcctctgcccatgttgtgccctctttctgcccaggtctgcctgatgtgcacttattcatccttcaagaccctgctcattcgtttcctccaatgggaaaacatccctggtgaaggtgcacagggctgcttcttcttcatcctctcccttgcaaattcttttacttttgccctgatttctggctcccaccttggtttcccctactggtctatgagctccttaagggcagaggccacgtgtgtttaactgaatactcatccccaggatgaatagcagagagcggccgctctgtgactgctggataaatgaatgaatggagagatggatggatggatgcacagtgaatgaataaatgaaacttgtggcaactcagaagctatactttagtaggtatcctggaggagaaacccaaatctccccttcgttgatattatcaaagggaagggagagttcccgtatttcctgattttacaaaagaactgccatgttccttacagaaggaggccttactcacgacagggtggaaactggagacagtggaacgagcaccgactctggatcctgtctgttacttaaatgtcaaatgacaagcgactgcacctcgctgtacattgtttcttcaattttaaaaaggggacaataatagatccctcagccaggtgcggcggctcacgcctgcaatcccagcactttgggaggctgagtggacagatcacctgaggtcaggagtttgagaccagcctggccaacatggtgaaaccccatctctaccaaaaatacaaaaattagccaggtgtggtggtggccacctgtaatcccagctactcaggaggctgaggcaagagaattgcttgaacccaggaggcggaggttgcagtgagccgagatcatgccactgcactccagcctgggtgacagagcgagatttcatctcaaaaaataaataaatgaataaaatgataataatagcaataataatagcctcacgaggctgttaggagtttcagacgtaatgcgtttaaacccctggcacactgtctactgcatgccggggacctgatgcttcttgggaccgtgtttgaaacatagtgtggacaaggacatttttcttccttgcctttggagacagtgctggttgcctctcactatccacaccctcccttttcctcctgattttgttctgggcaatgtcctcctcagggaggccaccagcttcattccccaaaccaggatggatgcagctgtgacaattctcctaccacggccacccagggtctgggcaggaacccaggtctggatatggagatttgggaggaaaccacgggggtgtctgagaaaggttatgtttcttttaaaaagtccccctttcttcctctggggttgtcaatgtgaatgaatgtgacgtgcagaattgcatcagccagctgagaagtccagcctaaggaatgggtcatgacagggagaagcacagcgggtgtgcagagagatcctgctcatgcattcagccaggccgagtgcctgagccacccgtggccctctgtccacacagagaacttccttattctctgagctggggtgatgggagtttcctgttctgtacagcccaaaggaacagatgctattgatactatcctatacttgttagaacagtcactctccttttggggtggccagtaatccatttgttttgaagattgcttgtttattaattgtatatatatatatatttttttttttgagatggggtcttgctatgttgcccaggctggtcatgaactcctgggctcaagtgatcttcctccctcagcttccccagtagctgggactacaggcatgagccaccatgtccacgaatccatttgtgaacaaatactatgtaagttggtctttggaaactcctacaaaataacagagttcccctgctgtccaagaggccgcagagggtttctttgtcagggtgggattcagtgagactccattagaatacagttttgtcaataaacttcttgtatcatttctattcctgtgaaattgctttcccaaccctcttgccttcagtaggaccaaagcatgcacaggtccaaaggcagtgagtgctgtggcacattcctcatcagagaggggaggatgctgggatgggaaaggtggcttagtaaccctggcccatgtctgtatgacaacttggaggcaatttggaaatgagaaccagacgacagacatgagaggcagagtgtcagttactaaaacacccaaaatgttggcaactgaaaacaaagacaatctcttcctccctttgatttagattgtgaccttttacttgtggctgaagagatttaagtgcagaaaatgtaaagtggcataattttttttttgaaaagaactgatggctctgtaactatgatccttaaatataagcatcagtggtgactgattcagtacgtacaccaggggttggaaactaaagcccattgcccgctttctgatggggcctgtgagctaagaatgcttcttacatttctatcataaatggctgcatttaggatgtaagcacttgtatcataatctcaattttgcctcttgtcccacaaaacctaaactatttaatcatgctctttacagaaaccgtttgccaactcttgacctatactcactccactacaggcatccttcttataatattattattttttcatgttttgagaaatttaaaagatacggtgactacaaaagaataatgtaacattcgtaatgccaccacccagagataataaatattaacatcttgtaagatctgtctttacattttttaaaaaaagaaatgaaatattacaatgatatcccaagtcccctttaactgctccccactgcaccagagggtcttagctttacttttaagcaatgtgcaccttcttgggatagggcttggccagggatttggccatagtgtcagtgacctcaacaagattaagaatggttattcctaggccaggcacacctgcaatcccagcactttgggaggctgaggtgggcagatcacttgacatcaggaatttgaggccagcctggccaacatggtgaaaccccatctctactaaaaatacaaaaactagctaggcgtggtggcgagcacctataatcccagctactcggaaggctgaggttgcagtaagcaagaaaatggttattccacaaccctgactggaatagaggaaagagaggcaccaggtcacaatactcctgtgtattgatggattaatcacataaaaaagctttctttgggcttggcatagagtagtcaatccccaaatttatactcaattaattgaacagatgccccaaaagcaggcacttaactgagtgattttatgaagacagtaataacgtaaacattttataaattaaaggaataacaacaacaaaagaatgaaggaagaaggagggaaggaagaagaaggaggaatggaatgtcactaacatgaaagtcacaaggccagcaggtgccacgcaactcacactatttttttttttttttgagacagggtcttactctgtctcccaggctacactgcagtggtgcgatcatggtttactgcagcctcgaccaccccaggctcaggtggttctcctgcctcagccttcggggtagctgggactacaggtgcacaccacaacactcacacaatcttaagaggaaccacacccctatccaataggtagaaagcaaagtacttgcacatcttcacatgtgacttatggggagagaaatttaagtaataagaaacaactctaaagtgtcctagaatcctactccaggattttttttttttttttttttgagatggagtttcgctctgtcacccaggctggagtgcagtggcaaaattttcgctcattgcaacctccacctcttcctgggttgaagtgattattctcctgcctcagcttcccgagtagctgagattacaggcagccgccaccacacctggctaacttttgtatttttagtagagatggagttttgccatgttggccaggctggtctcgaactccgacctcaggtgatctgctgcctcggcctcccaaagtactgggattacaggcctgattcatcgcgcccagcccctactccacgacttctgcattaagtgtaattctctggtttctttcctgacttttctccaagactctgagcttcttgagggcagggccgatgcttactccacctcatgtgtttcccttgtctccaaggaacacgtgggaacatgcagagaacatgtgctgtcaaagttaaaagatgtaaagacaaatataacactaagcaaaatacctgaccccaatgtcaagagctccagtcagaatgctacatgtcttcagcaaaacacgacacacagtcacatgtggccttacttaccaagactgattgcaggcatttgttctacaaatatgaaaatgcacaagcatttttatgttaagatttgggtctgtttatgcatgaagaagttcaagatgttattatgtatgacaaagaacaagtggaaacaacctcagtgtccaacaatgacaagagttaaatgaacgtggtatgtctacagagtacaatgagctgtggtctgggtttttaatgacatgagataatgctttgtatgacatcatcttatgcttcctaaatgcccatatatgatcagctatatgaaaagagggcttttttttttttttttttttttttaaagacacagggtctcactctgtcctccagactggagttcagtggtgcaatcttggctcattgcaacctcgaatttatgggctcaagagatcctcccacctcagcctcccaagtagctagaaccacaggtgcacaccaccatgcctggctaattaaaaaagtatattttgtagagatggggtcttgctatgttgcccaggctggtctcaaactcctggcctcaactgatcctcccaccttggcctcccaaatcactgggattacacgtgagagccaccacacccagccagtatttcttcttaacaagaaactgttcatgaatggactgcttataaaccaagcccacacccccaatcccccaagctgtgcaacaagagtgcacctgtatgtgagaccacaaaccacactaaagatgcaggatttcacaaagccgaaggaaacgacactggggaagtcatcggcaaataaggctctcacagagaaaacatacatgcccacattagctcctgagaagccaatcatcagattactgatggattcagaaacagactcttatgaagattgataaaatctgaaaagaacccacagtgatgctcctgccaatgtcaaatgtaaagtacaggatgctgtcaaaagaatttttttcagaccatttactccaaggaaaccaagtcgacacttgattacctctctgttcatcctgagttgctgcatactggcagtaacaaccattttatcaaacacaagttgaaattaactgattgccataatttgtctcttttctcaagacaatgtttcaaaccaacctttatttttattttattgccattttctgtagctacggtctgcattttaagtgagctttttttttggcagccataatctttagataatgagcccacctgggcttgaactggtgaggggctggccagagtctgcgggggtgggtacagatccctccctgtttcatgaaagacaccatcaagaaggccaagtgtggtggctcatgcgtataaccacagcactttgggaggccaaggcaggcagactgcttgagctcaggagttctccagaccaacttgggcaacacggtgaaacccagtctttattgaaaatacaaaaattagccaggcgtggtggggagcacccatagtcctggctatttgggaggctgaggcaggagaatcacttgaacccaggaggcagaggttgcagtgagctgaggtcatgccactgcactccagcctgggcaatagcgcaagactccttctcaagaaagaaagaaaaaaaaaaggccaggtgtggtggctcatgcctgtaatccaagcactttgggaggccgaggtaggtggattgcttgagctcaggagttcgagaccagcttgggcaaaatagtgaaacagtgagatctagtttctaccaaaaaaaaaaaaaaaaaaagacaccatcaagagcatctttgtctgcagaaggcacaattcacatactcaagatgaacggatgaacggagaggcttactatgaaagaaaaattcctgcttgttgaggccaaaggggaattccacacccctgtattccacaccaagtaggctccacggaccctcacttggcagatccctttggatatcccagtgctgagcctctgtggttgcagcaccagctcctttcctgaggcagcccctgtagaggagcaggtgaagaatgggcaggagggtgagcaggtgggaccctgccccacacgggtatcccggctcctctctacttgccatcagcacccgtgcccacggtgcattctgctcatcaacatgctctggggcacccaacagcaatgtcgttgagaacacaggacccagggccactgcccaggccccaagcaattagtgtcacccaccactttgcagctggttgatgctggggaagccgatttgtctccccacgctgcagtttccttgtctacaaaatcagagcaagagtccctgtggtgtactatttattaagcagtcattattactattttactagtatagtgtcctgtgtgtgttttctttctttctttttttgagacgtagtctcactctgtcacccaggctagtggcgtaatcttggctcactgcaacctctgcctcctgggttcaagtgattctcctgcctcagcctctcaagtagctaggattgaaggcatgaagtagaaacacaatttgacccagccgtcccattactgggtatatacccaaaggattataaaacatgctgctataaagacacatgcacacatatgtttattgcggcattattcacaatagcaaagacttggaaccaacccaaatgtccaacaatcatagactggattaagaaaatgtggcacatatacagcatggaatactatgcagccataaaaaatgatgagttcatgtcctttgtaggacacggatgaagctggaacccatcattctcagcaaactatcgcaaggacaaaagaccaaacaccgcatgttctcactcataggtgggaattgaacagtgagaacacatggacacaggaaggggaacatcacacgctggggactgttgtggggtggggggagggggggagggatagcattaggagacatgcctaatgttaaatgatgagttaatgggtgcagcacaccaacatggcacatgtatacgtatgtaacaaacctgcacattgttcacatgtaccctaaaacttaaagtgtaatacaaaataaaaaaaaaacaaaaacaacataaaggcatgcaccaccatgcctggataatttttgtatttttagtagctatggggttttgccatgtttgccaggctagtcttgaactcctgacctcaagtgatctgcctgcctcggcctcccaaagtgctaggattacaggcatgagccactgtgcccggccgtgtccattgcattttaaatgaccaatggagtcacactgaccctcgaggaaggtggtttttaatacccactggtggcacttcacagagccatctcagagacaggctaactttaatttgtccccggtgtggtgaacagaacaaacactgccaggaagactttggttcccactctggcaacactcggcagtgggtcaggggtaccaattcaagggatatcagaaactgtgtcccttacacatccttttcacgtccagtcatttaaaacatttttcaataaccatgatgataagaatagaggttcgctatcactgagcacctaccaggagccagacactgtctcaaggtactggattatttcatctgatccccacaaaacccaccgcacctgcttcatagctttgtgatctgaatggatgactctgcctctaggacctgaatatgtctgtcggcaaaacggaaaaaataccagtaccttgtggggttgcggtggaggtttgccacaccatgggagcagccgctgacaataatgtgaataaaaataaaagtgaacactgaccatgtctctcaagaagcctgttcatctcctgcacttttcgggagagaaattgctctattaggtgccttcagtggcaccatggaggagtgagatcagagaatactatagtccccagggagaaagagcacgcagcatagggccccacctggcagggcggccccagaggaggctcagtggctgaaagaacatcacaactgcctgacatggccccttctatctggacaatgttactgcagggaatagtaccctcacctggacttccaactgcacacagcacagtgcttacagaagggagacgtgtgaggaaaaaagatttcctttcctcttaccgtgcctatgaaatttaaaatagattcaagagttagagggcctctgctccttacaactgacgtgctcagtttccacacctgtgccgaagacctggagaaggcacctttaaggtcctgatagaggggctcccaggacaatgtctggcacccaggaggcttcacctaaatgagtggtatttgcttttgagagtctcactctgtcacccaggctggagtgcagtggtgcaatcatggatcactgcaacttcaacattcaggctcaggcgatcctcccacctcagcctcccatgtagctgggcgtgcaccacaatgcctggactcattttttgtgtttttttgtagagacaggtttcaccatgttgcctaggctggtctcgaagtcctgggctcaagcgacccgcccacctcggcttcctaaagtgctggaattacaggggtgagtctctgtgcctggccatgctattttttttttactttcaactcaatcaattcatatgcaaacatttttaagtaaaatttaaaaggcaatgaaatcaaagcatttttgaacttattttacaaagcaatgttgtagatttgtacttacactgtgggaaatagggaaaatgtcttttaagtgaaggcaagtgcagtaaataaaaaataacttgaactagtagacggaatgagcgtttcactaagctggagatactggaattttacaaaggaatctcactgctaatttcaaaatgacactaattgctatttttgaaacatgatctcaaaggagaagatataatattttgacttcataaacttcaacagacactgctgttccccatgttctgggggctcctttttgaaatgttgtgatgaaattaaaaaattaaatcatttttacttggccggctgtgttggctcatgcctgtaatcccagcactttaggaggggctgaggtgggcgggtcacctgaggtcaggagttagagaccagcctggccaacatggtgaaaccctatagcttctaaaaatacaaaaattagccaagtgtggtggcgggtacctgtagtcccagctacttgggaggctgaggcaggagaatcacttgaacctgggaggtggaggttgcaatgagccgagattgcgccactgcactccagcctcggtgacagagtgagaccctctcacaaaaaacaaaagaacagaaaaacccagacatttttagttgaagagcaatctacaacctcagagaagaaacttctctgttttgttcatccctccatcctcagtgcctagcgtgggatccatgctatttgctgaatggataaacgttgatttaactttaggaatcagcagcatacatttacacacgccagattctcaatttataaatatttaccatcaggacttgatttcaactttaattagcccaactgttaaggatacctccaaagtgagaaatctaatccatcactttacaccagatgtagctttggcagttagtcttttatctaggtttatagtgaatgagaatcagacattaaatgactagtgtgtgatgttttgcggtgaactgattggaacctaaaaaataggccaaacgtgggaaaatgaattcaagactaaatctgaggaaataaaacaaagagggtaaacttcctctagctgataaggtcccacaaactctggattctatggatgcttaaaaaaaggtgggggggggggcgggggcatgagtgtgagatagttttttaaaaacccccccctttttttttttgagatggagttttgctctcgttacccaggctagagtgcagtggcacgatccctgttcactgcaacctccgcctcccagcttcaagcgattctcctgcttcagcctctggagtagctgtgattacaggtgtgcgccaccacaccctgctaatttttatatttttagtagagacagggtttcaccatgttggccaggctggtcttgaactcctgacctcaggtgatccaccgacctcgccctcccaaaggactggtattacaggcatgagccaccacactcagcctaaaaatttcattttaaatgggagggcactgtaacatgattgtcactgccctgtggacaggtttgctgcatttgtaaaaaaatctgactatgaaattatacattcaaaggtgtgtttactaacacttaattggtgaggtatgttaaattaagttgaggctcaagctgcctccttacatattttatttttatttacttatttttttgagacaggatcttgctctgttgcccaggatagagtacagtggtgcaatcacagctcactgcagacttggcttccggggctcaagcgatcctcccacctcagccttctgagtagctgagaccacaggtgcatactattatgcctggttagttaaaaaaaaaatccttttcgcaaagacagagtctcactatgttgcctgggctagtctcgaactcttaggatcaagcgatcctcctacttcggcctcccatagtgctgggattacaggtgtgagccaccatgcccagccttctttatacattttaatttcagccaaaggtttctctgtatacacagtgaactggatgtgtaaacagaatagaacatactcttgccaatctccggttttggccaatcacaggcagtcaactgttcaaactgtgttcaaataaggcaaatgctgagttgtaacccatctggctgtttttgtacctcactttccactttcctttttctgcccacaaatctctcaccatttggctgtgctcgagtctttctgagcctctattctggttcagggtctgcctgatttacgaattattctttgctcaactaaactgtgaactttaatttgtctaaggttttttcttttgaaacaggtgtgtgctttaaaaaataaacaaaggatcaaattttatcactacattctgtaagaatttttcatctacttcagcgactaccatccttttaaaccagtacccccttttgttaaaattaaaagtagcatgccttcctcatctaccctgaaaactctcagactggctgtaatcgtctatcttcccgcatatcccaggagccaagagaattttgtctagctttacttcctatagtttgcattttgaacagagttgatcattattttccctttcaaatctacacagctatatcagcaggcagcaggcatgtccccaaaccaggtccgcctgtcctggagattctcaagaacgcccgcaagaaggacgccagcaccccaggggtgagaagcatgccggtctagctaatggataaagcacatttgcctgctgtggggtccccaaacggttcgggatcatacagaacaacaaacacgcccttagtgagtgctcactatgagccagacatggtgctaagtgactttcttttttttttttttttttttgagatggagtgtcactcagtcgcccagggtggaatgcagtggcgtgatctcggctcactgcaacctccgccttcccaggttcaagtgattctcgtgcctcagcctcctgagtagctgggattacaggcactcaccaccacgctccactaattttttgtatttttagtagagatggggtttcaccatgttggccaggctggtctcgaactcctgacctcaggtgatccacctgcctcagcctgccaaagtgctgggattacaggtgtgagccgctgcgcctggcctgacttgtctttttgattttatatatgactctccttaagggatacaccaacttgacaaggttggggtgagtaccctctttttacaagtgggaaaactaaggcagagaaatgtttagtggcttatcccaagcaacttaagaagccaaatcctgtctgttcacctgccatgttataggaccccctgcccaccggcccagacgctaattccccctgtacaaacctccaagttttgccttatctgcacagtactcatactactatttactgaatcattttctttatttttattttttattttttgagtcagaatcttgctctgttgcccagattggagtgcagtggcgcaatctcagctcactgtaacctctgcctcccaggttcaagccaatgtcctgccttagcctcccaagtagctaggactacaagtgtgtgccatcacgcttggctaatttttgtatttttagtagagatggggtttctccatgttggccaggctggtctcgaactcctgagctcaggtgataattaaatcattttctttaaattgataagctagttctatttttttctaatacatgtgaagctgatcacccaattattagacatcttacatgcaccatggaccctcttgtctgcaatccatcacatcctggtcttcaggggaacatgtgcctcacccaggcacgccctccactgaagaccttcaggaggcttgttctgggcagacctttctgtcagtcaggcagttgttacaatggggtcgtcagatgcatcctaaacttagacacatacagaatgtggacaaggttctggggagagcaagagcgtcaccctgtaatgggaacatttctctaagccaagagttggaaaattatcaccggcaggcctaccacctgtttctggaaataaagttttattggaacactgcactgtctgtggctgctctcttgttatgaaggcagagttgagtagttgctacagagaccatagagccacaaagcccaaaatatttactatctgaccctttaccgaaaagttctattgacccctctaggcgaagcatttcccatacaaaagtcagcttgtggcctgggtgcagtggctcatgcctgtaatcttagcactttgggaggccaaggtgagcggatcacttgaggtcaggagtttgcgaccagcctggccaatacagtgaaactatctcttctaaaaatacaaaaattagccagatgtggtggcgtgtgcctgtaatcccagctacttgggaggctgagtcaggagaattgcttgaacctgggaggcggaagttgcagtgagtcaagatggcaccactgcactccagcctgggtgacagagtgagactctgaccccaacccccaccaaaaaaaagtcagttcatgaaaaccaactcacaagtgatacggatattacctgctgataagtagacttgaatcacgcttaattcaattccattgaccactattcacctattggggggctactatatgacagtctcagctaggggctggccttacagaggtgaataaggctgggcttctgtttcctggaggaatcaggatctaaacagtgactgcaatacagcgcaaaggatgtcagagcaggatttgatgttttatcttcctataaagtaaatcctgggaacctgatctttttgttctttaaaactttgaattttttttatttatttttgagacacagtcttgctctgttgcccagattggcatgcagtggcgtaatcttggctcaccgcaacctccgcctccagggttcaagcgattcttctgcctcagcctcccaagtagctgggactacaggtgcctgccaccatgcccggctaatttctatattttagtagagatggagtttcaccatgttgcccaggctggtcttgaattcctgacttcaagtgatccacccacctcggcctcccaaagtgccgggattacaggtgtgagccactgcacctgccaaaactttgaaatcttaaaactataaccatggactaagatttatcttctctctctctcattttctaaaaaagcataaatactagaaatgaaactctaattctgtgaaatgactcattaacttttgcggggaagatcaacttattggaatttttcataattgccaaatttgctctgggctctctaacacacagttctaatctctcttcggagaatggaaaaaaagaaaaggtatcgagacatcaagggaaacatggtcagttaaagatctagcttttgttttttaagactgagcttctaaattggaatcaatattaaatgggtcatatattaaccctctgctgaaagaggcataaaggaccgagaaaatgtctaggttcaaccaaaatttcattatctactatctgtctttgctactccaactaggtatcaggtgaataaagcggaaaaccaatttctacatcccttggatgtgatgaaattgattatcctcacgcaggtgaaatgaagacagaaaataacaggtgctgcttcacactggtatatctgtcctgacctgataactgtttatttgtaccggctattgacaatgtttttgtatcatacaaagacggtttttcactgagcttcaaaagtagaaacaggatgcatctgtttctagggaaacctgcacttggaggctggcaggcttcgattcacacagcacacccctccactcccggtggtccactgcacagtgacaccctcctcctcgtttatctcatcccatttttaaaaattaatgcaacaatgagagatgattgttgatgctcattattaaatcatttattcatcccacacaatgattcagaattattcatcaagcttgctggaaggaagctgggttttacctccacggtggtttggggagagatgtgctctttaaaagggtattttataacaacacaattatcataattaaaagttaccctgatattctgatgagcttttgacatatttttgagtactggcatttcagcacaaggagataaatgagactgagacagtagtagggaataatattgccatggggggaagaaaacaaaggcaatattaaataccagctgccatcgtcacccccaattttatcccagcctttaagttaatgaattttacaaaatatcacttgaacttctggctctccaaaatgagttccaattatgttgttgtgacctgagccgctttctgcataactgagtcatggatgcgtacagccaagagcgcccacctacatgagcttccaagcccagcaagtctatctgcctgcagcggagagcctccacatccgactcatatttccttctgatgttgcctaagatttgttctgtgtttggaaggtcattcagcaaaaggcctggtttggcaggccacggaaactgacagggaatttcgggaagggctctcatctctctggccttctctgtgaagcaggtttaggtgaagacccttaggccagtggccaagaagaggtaggtgcctttgtatacctgcaggtggtgcctggaggaagcagtgggagggggtgcttgggaagagaaagactgctgagtgactttggagagccagcctggggaccagagcagagagaggcacaagtggcttccctaagaccaaaggccacagaggccacgtgttgaacacagaggtctgaacatgctctgttgcccaaggtggagtgcagtggcatgatctcggctcattgcaatctccacctcccaggtacaagcaattctcctgcctcagcctccgcagtagctgggattacaggtgggcaccaccaggcctggttaattattgcatttttcagtagagacagggtttcgccctgctggccaggctggtcttgaactcctgacttcaggtgatccacctgccttggcctcccaaagtgctaggattacaggtgtgaactaccacacctggcccaaagactttcattcattcattccacaaatactgataaaacatttattatgagctaatatctgagccaggtctcccaactgcatagctgaatatgaccctgtccctgccctcagggagctgagagtttagcggggattcagacaagtcaacacttgcaaatccacctgacaagtgctgggataagagaagctgaagaacctggggtggggaggaggggagagccttatacagaagatgtcaaagttgagtgggaggcgggatgtggtgtctcatgcctgtaatcctagcactttgggataccccggcgggagggtcacttgaggccaggaatttgatatcagcctgggcaacacagtgagacctccatctctgcaaaaaataaaaaaattagccaggcatcgtggcactcccctgtagtcccagctacttagggggctgaggtgggaggatcacttgagcccaggaatccagggctgcagtgagctatgatcacatcactgcactccagcctgagtgacatagtaagactccatctcaagaaaaaaaaaatgttgaggccgggtgtggtggctcacacccgtaattccagcactttgggaggctgaggcgggcagatcacttgaggtcagtcaggagttcaagaccatcctggccaacatggtgaaaccccatctctactaaaaatgcaaaaattagccaggcatggtggtgcgcgcctgtaatcccagttactcgggaggctgaggcaggagaatcacttgaacttgggaggtggaggaggtggtagtgacccgagatcatgccactgcactacagcctgggtgacagagtgagaatgtctcagcaaacaaaaaattgttgagtgggcctaggcaggtgaaccagaagaggctggaggggaaggcagatgtgactgagaagggccctggacactgcagtgaagagctgggccggacctgggggtggagggaagcctcatgctttgcagtcagttacacacccatcttgctgttaggtgcagaatgaactagaatgggtaagagcagagtggggagcacagtgcagagctgctgctaagacccagatgagacagtggacaggctacagagacacgaaggaggtagaattaaagggacatgaaataaccaagtgccttcagctagcgagctcctccggagatggagccattggattccagcgcctgatgtcactgagagtggaataaggcagctaacccccctgttttctcatgcctaccaagcagcctcctgattataattgggcttcccatgtagctctgcctacgggaagagaaagcaccgctggggtggaggccagggctgcggtcttgctctaaattaatcaactgccattctggtttgtagctatcagtctctgggagctgggataattggagacacagaccagctcttggtttgccagcaactctggttcctgtgcttgaggggttgcagatctgagtgggcagggggctggggcatcatggatatgatgccaccctgtagggcccttggtgggtggtcaacaggcttctcccaagggtgccctgttagagctcacacctgtaatttaaactcttcggggggccaaggcagggggatcatttgaggccaggagttaaagcccagtgaggtgcaacacagtcagaccccgtttctacaaataattaaaaaaattagctgggcatggtggtgtgtgcctatagtcccaggttctcagaaggtagaggtgggaagattgtttaagcctaggaggtcgaggctgcagtgagccatgatcacgccactgcacgccagcctgggtgacaaagcaagactctcaatcaatcaatcaatcaatcaatagaaaaaattagaactgtgagtcttctcagtatctgggggtgctctgtcctacaaggggaaaaccacagaactacataccactcaggaatgtggtcaacaagaacaagaacaaagaactcagggcagtcatgggctttacatcatctaacattagatctggccagctgcggtggctcacacctgtaatcccagcactttgggaggccgaggtgggtggatcacctgacgtcagaagtttcgagaccagcctggccaacatggtgaaactaaacctggccaaactgtctctactaaaaatacaaaaactagctggacatggtgatgggtgcctgtaatcccaggtactcagcagtctgaggcagaaaaattgctttaacccaggagacagaggttgcagtgagccgagatggtgccactgcactccagcctgggtgacaagagcgggactccgtctcaaaaaaaaaaaaaaaagaaataccattggatatgaaaggaatcacttcaatggcattaaatgttctctctggctttattctccactacagaatagtctccatggtggtgctcatgccgccttgacgctttgtttccttgtcatcaagacagttttctgcaccaactcaagcatggcatgaaatttcaaacgacttaatagaagttttctaactttatctccatggaacagctggaaaacatctccaattatgtgagcttattgcaaaatgtcttgaaaatacaaaatgttccgctgggtggggtggctcacacctgtaatcccagcactgtattcccagatgggactaaatccgttactctctccggattctggaggagaacttaatccacctcaccagaggaaaactgatcacgtcccgtggccttgggaagccaaggtgggtgaatcacttggggtcaggagtttggaaccagcctggacaacatggtgaaaccccatctctactaaaagtacaaaaattagccaggcgtggtggtcagcgtttgtaatcccagctacttgggaggctgaggcatgagaatcacttgaacctgggaggcggaggttgcagtgagccgagattttgccactgcactccagcctgggcaacagaacaagactttgtctcaaaaaaaaaaaaaaaaaaaaagtaagccctggtgaaaggaagaacgaggacaaagagaagagacacaacagttgtcaaaactggaatttgccaaatcactggtaacccagggaatctgcctagaacagactgtttctcttgaaaggcccatggcaggtgctaccagaaagataaaggaggtgggtgggctagtgccttagagtgccatcagaaattgaggtgtgacctccagaaatggagggtcttcattctgtgcgtgcacgtgtctgtcacatatatcactggcagcaaaagatgggactaaatccgttactctctcctgattctggaggagaacttaatctaccttggcagaggaaaactgatcaggccccaggaactgtccgctaaagccacatcccaggatttcctgagtcacagctgatgaatactggagggcagcttgactcttaaagatcgtctgcccttgagcaaggtgcctgcttcccagagaagtgaaagcagatgtccctggcatcttgccttctcccaaggcacatgcaagccacattcacacccacctgcactacccagtctacttcccccaataaacccctcctgccacttccagaactccaatcttcaactgtgagcagctatggcacactgagtacttaggctagggtctgttctccatgtcttggaggcctttctcatttaatccttgacaccatcctgcaataaggctactattactattcctgttttatagacgaggaaactgaggcacaggaggattaactagccagacatgcagtctgcaagtccaagagctggtatcagaactcccggcctagtcctctctccctttttgacacattgcagagagacgggagaaagatctggaaatgccctctctagacttgtccttcctccctgaaacccgtggcccggggcctctacctgcgtggatgaacttgtctgccaacttcttccgagtggacttgctgaggttgaagtagtagtcgtcgtcctcgtcgatgctctccaggaacagcgggatgtgctggaagacgatggcatgctggcagtgccgctgcctcgcgatgctcagctgctcgtccagccactggtcctgagcctgcttcaggctggggcatttggaggggttctcgtagaactgggagttgaggaccaggaacaggacgcccccgacccagaagctgaagtagtcatctccccaagtccggcagaactcctcgacggtctcggccgtgggggtgttgccaatgtcatggttgccgctgacaaggaccagtgggatggccctgtccactgccctaagcactcgcttcaggtcctccgtctgctccgtccgccacggcttccctggaagagtgagggtcacgtcctgagaaagccaggggcttattcacttgaaataactaacttaagtacttactaacataaaatttaaaaaaagagtaatctggaaatccactccacctagcacatggaaactgcaaaatgcagtcacgtgctaaaagcaaaccaacaagtccgacgggggcctctgcccatccttccccaggataccttagaaattccatgactacatggccccctgccctatgttgctgagtgatggtgtgaagtcaatcctgagattaaatattagtggactgggtacagtggctcacacctgtaataccaacacttggggaggctgaggtgggagggatcacttgagcccaggaattatgagacaaacctgggcactacagtgagaccctgtcttcataaaaaagaaaattaggctgggcgtggtggctcatgcctgtaatcccagcacttagggaggccgaggcacgtggatcacctgaggtcaggagttcgagaccagcctggacaacatggtgaaaccccgtctctactaaaaatacaaaaattagctgggcatgggcacgggcacctgtaatcccagctactcggcagggtgaggcaggagaatcgcttgaactcgggaggcagaggttgcagtaagccaagatcacgccattgcactccagcctgggcaacaagagcgaatctctgccttagcctcccaaagtgttgggattacaggcgtaagccaccgcgccgggcagaacatgcgttctttcactgttgaataccaagttcctcatatttctactcaatcaaactcattaatggtgtggttcaaattttctgtgtcattatccttttctttcggcctgttgatgtatatttgtttctgagagacttggttaagttgtcgctgtaactgtggattgatctgtctctttctgtaattctgccaaggttcacgtcatttacttttagttacattgttagacgtgtaagagttcagaatttcaatatctcactgcaatagttttatatttaaccctaatgaaataaataaatatcaagataagaaacaggcgatctatattaatgctatgagaaaatctttaatatatagtaagttaataatataaggcacagaggaataaaatcacacacaaatttttaaaagcctcacatgtattcatgtattatggataaaatgtcccccaagattcaaagaaaactgttaactctggttaaatccaggaaacagaagcagagagggagggagtcttacacttggtttaaaaccctttatattaggttggtgcaaaagtaattgcagtttttgccactgaaagtaatgacaaaaattgcaattacttttgcaccaacctaaatactttctttctttccctgcctctctcccttccttccttccttcctttcctttctcccttcctttccttcctcccttccttctttccttcctcccttttcccaagcttatgtataattttcaccgaaaaaaaaaaaaaaaaaaaactcaaagattttgactccatggttctggggcttaaagaagattgaggaagccagccaggtggctggaatgaatgtttggactggcagccccagggccagcctggatcaactcagaccagccatgaggccaatgtggactgcagacaaaccctagcacccctggaagagaggactctcggtccctggagcaggcacgacctgcttccacaggaggctgagcagactgggcttcagaccccaactcctgctgcaggggtcagccagcctttcccgagcccattccactggtgtccagaggtgagaggtggctgcacggcctgaagcctagtggagggagccttagggagaagcaggttctgcctgcaccagaaaccaggaggcctctctctcaggggtgctgggggttcattcacctaccgtctgcatcgaaggtgccattgattgacattgcttctttagccgaacccggactgcaggcatctgtgctgacttacatgatcctctctaagactccagtgtctggttcttttcccatgccagtttaggaaagacaagtcctttgtagctttgaacacaacaaactctctcaaagcgacccttgtggtccaaggctgattcattaccactttcctcactggattttctcaaagacctcaaagccgcccctctcacttcttcttctttctgttcacactgacttggggattttgggatattcaatcactgacaatacttcttagcacttcctacaggccaggcactgttctcagagctgtgtgtgcaccgacttgcttcctctggacacccagtggaggagtggggatttgaacttggtggtctggctcaaggtgctgtctacagtgtcctggtcacaaactaaggtcgttgctctcaggatgacttctcctggctgccctgagacacaggatgaggactttataatacactggggtgcagagcatctcctgttcttgattttcaaagtcattaagtatggcccctcacatgctaactgaggcaggtatggaaaaatgtccgaatccctaatgaccataaacagaaaagttaagaaggggcagttcaaaagaaaggctgacttgggaaggaaaccttgtctaggaagcaaccaacaaggaagagctgggaattacacacagtaatgtgatgtgtgtttccaaacaaagagggatgctgcttttggggaaaccaccaatatcccccagtaatctgttaaaaaaaaaacgcagctcatcttccctaaatttccttcagcaaaaatgagcctcttggcagggcgtactgatgcatgcctataatcccagcactttgggaggcctaggcgggcagacaacttgaggtcaagagttcaacaccaacctggccaacatggtgaaaccccaactctgctaaaaatagaaaaattacccaggcatggtggcatacacctgttgtcccagctactcgggaggctgaggcaggagaatcgcttgaacccgggaggcagaggttgcagtgagctgagaccgtgccactgcactccagcctgggcaacagagtgagattctgtctcaaaaaaattatttatttatttattgttggaaaaaaaaaagatgagcctctttcttgtgtagcttttccaacactttctatacctcttgcatggagtcacaggtgctgaggtggagtgagtgtgccctggggttggtctcttgccccttacaagctgcatggccttaggtaagtcccttggttcctctgagtcttggtttcatcgtgtatgaaatggggatgataattcccatacctcaggaatggctgtaagaattcctactaagataatgatgtctagagtctggtacaaacaagaatgcaaagctgtcagctgtctgctttccacatcccatccccctaaatgtaataaattcttccatttttatcagcgacccactgtgtgtgcataacaaccagtaaatcgtttcagaaggaatgaaaatcttccccagggacagaaatagtttttagttaagaatctggaaataaaagagtaaatcctagattacaaaaacccaagttgaatgccaacatttgcatgatctttaacaagctctcatttgcatgtaacagaatctctgtagggttacgtactatattaacaacaacttagtattaacaaagatcatagcacaacttagcagagcttcctgaaaaatagtcccattgtggctgggtgcagtggctcatgcctgtactcccaggactttgggaggctgaggcaggaggatcatttgaggtcaggagtttgagaccagcctggctaacatgacaaaaccccatctctactaaaaatacaaaaattagctgggcatggtggcatgggcctgtaatcccagctactcaggaggctgagacaggagaattgcttgaacccgggaggcagaggttgcagtgagccaatatcgcactattgcattccagcctgggtgacaagagcaaaactctgtctcaaaaatgtcccattatatatgagaacccaaagcccaaagccaacctcaccagcatcatgaacagaaaaaacagaaacctgcccaaggacacagagcttcaatgagtttcctgtctcacgcagggttctatgttcacaaaaagaatgtatataaaggacaggaagaaaggcagggaaacaaggggaaagactctgaaaaatggcaagacatgactcagaagaggggcagagaaggattgttctggggtctccaaggtggataagaggtatctgctgagaagtgggtgccaagagtacagggaccccaatgtcagcacacacctgacccccacggagaggagccctgggtgggaatggcgagagcagtgtagaaagctgcaaagcgtttaaaacacttaaaaaaattttaatgcaattggtcaaaataaaactaggaggtaaaaagcatgataacgataattacaaaattcttatttgtatcagtggtactgtgagaggtatgatttatttttgtccatattcattaaggcagacattagtatcttggttgttttccaaatagccttaaaatacattgtctaataaaatctctttgtgagttaggaagagaaataaacatccttaactggataaaggacatctgtaaacaagtatagctatgatcataggtaatggtgaaagactgactgccttcctccaagatcaggaacaagacaaggaagtctgctctcacactctcactgaacatcatactagaaatcctagccagtgcaataggcaggcaggcaggcagtcagggaaggaagggaaggaagggaaagacggggggaaggaagggaaggaagggaaggaagggaaggaagggaggaaggaaagaagggaaggaaggcaaggaaggaaggaagggaagagaagagaaggaaggaagggaaggaagggagggaaggaaaggaaagggcatacagattagaaagaaagaaatcagtcaattctcagaagactgtctccacagaaaatcccaaataatctacaaaaaacaaaagaacaaaacatcaaagactcttagcactaataagagaaattagcttggatgcaaagtaaatatataaaaatcaacagtatttctacatcctaacataatataaaaattagaggtttaacaagaaggatttaagagatatttgggaggtagaactgacaggaatcctcattgtactggttacaggaaggactcaaaattaattcccagacatctgagcaactgggaggctggtcatgttgtttactgtcagggaaaagactaggagagaaataggttacaggtagaaatcaaaaggtcattttgaatataaaatttgatgtattgttacaggccaaaaaaaaaaaaaggagggggggaacagacaaattggacctcatgaaaatgcaaaacgtttgtgcatcaaaagacactatcaacagagaaaaaagtgcaaaccacagaatgggagaaaatattctcaaattaaatatctgatagggaatgaatatcagagtatatggagaactcctaaaactcaacaaccactaaaacaacctaactcaaaagttggcaaaggattgaacagacatttctccaaagaggatatataaatggccaataaggacattaaaaaggtgcccaacacgactacttattaaagaaatgcaaatcaaaaccacaatgagacgccacttcatacccatgaggatagctactatcaaagagacagaaaataacaggtattggtgaggatgtggagaaaatggaaacctggtgcattgttgatgggaatgaaaaatggtgtagccactgtggaaaacaatatggtggctcccccaaaaattaaacgtaggattaccagataatccaacaattctatatctgagtccccaaaataactgaaagcagggtctcaaagagatgtttgtacacctatgctcacagtagcattattcacaatagcttaaacatggaagcaacccaaatatccactgacagatgaatggataagcgaactgtggtatatccatacaacgaaatattattcaaccataataaagaagggaattctgacacatgctacaacatggatgaacctttaggatatatgctaagtgaaataagtcatgcagaaaaaacaaatactgtttgatgtcacttatatgaggcacttagagtggtcaaattcagaggcagaaagtagaatggtggttgccaggactttcaggagggaaggatggtgagttattgtttaatgggcacagagtttccattttgcaagataaaaagagccatggagacagatggtgatgatggttgcacaacaaataggaatatacttcatgccactgaacggtacacttaaaatggttaaggtggtacatgtaacgttacgtatattctgccatgctaaaagaaaagagaagaaaccaccaaagttatcaatatactcatgatccctccaggttgggctgttgagagggcagctgggtctaggagtctggagttcagtggagggtggggctggaagcagacacattcaccatcattctaataggagcccccatgatggtgcccttggggttggcttttcaaggggatccataagtgggctccagattcagaggacctgaggttgctctttattaggggtgtcctctggggatgttgccctctgagcctgtcttctagaccctaaaatgaaaatattatcacctcctttatggaaattctgtgagataaatgagatcatgtatttaaagtgtccagtatgtagtatgtgcataccttcctttcccctctttctaacagccccctacccagggaagagacaggggaggagggaggcaggtctcaggtgttcagagatctccctcccattttcctcattctcagggagcttagcccccagtgccgctgctactgtccctgagaaatgcaggaaagaacacacatgtctgcatgttgacatcctagcccagagctcacgtttacctgacaactcgtttactgtggtgcctggaggccacacctgtcctgcagacagatggatacatggatgagacagtgcttaggcccttgcacagaaagggaagcatgccaaggacaagaatttccagagacagccctaagaggtccctggaaacagagtcgatggggctccgtccctacctgcaggttggaaacggaatagtcaagccagggcatcaactatatggttaagatcatagctcagtaattaaaactcctttcagggggcaagtagaactcctttcaggggggaattggaaatatccatttaaactttaataacttcatgatattgagtgagccagcagttccatttatcagcctttatcctacagacacatacacaagtgtgcaaaacataactattccttgtagcaacaattgagaagatataaacatttaaattggcttaaatgtttattaataaggaatagataatatgtatagagtaataaacaggcatcacaaagaatgaaggagatccgaatttagtggccacggatatatagaaaaggtgcactgttaaggtttggggagcaagggttggctggcagtgggggacagtaagtgaaaacaggaagttattagagctagtagtacgacacaattttattaaaaataaatctacgagttggtatattcagagataaaaatatctagaaaaacatggcaaaactgttaatagtacctgtctgtggggaagtggaaggacagaaaacatttcagtttcctgaaaaacttaattttttatgagcataagttactttcattatagaaaaataatcaagacattaaaaaatcacagatgcactaaaattagatcttgttaagtaaacaagtatacatttaaataaaatgggaacaaatgtaaaacaagtgacaaggccaattgtgtaagtactgttctttactctcagaaagagagaaaatggggaaaagagagtaccagaaaggtatttcgaaataagttcttaaaaaaaaaaatcgcagtgggtaaattcaatttaaaaaaatgtataaaaaattgtgctcaggacgaattgtgttctttctgaatctgaataattacattttcaaaaagagagttttcttctagagcagatgactttaaacgtcaacacctagtgagtatcagaggcagcacaatgtctctgctactattttgatatctgaatgaaatagcatcaaaggagaaggtggttgtcctggtcttttaaatctagtttcttcttttttattttttattttttttgagatggagtctcgctctgtcacgcaggctggagtgcagtggcgcaatctcggcttgctgcaatctctgcctcctgggttcatgcgattctcctgcctcaacctcctgagtagctgggattacaggcatgtgccacaacacccagccaatttttgtacttttagtagagacggggtttcatcatactggccagtcttgaactcctgatctcaggtgatctgcctgcctcagcctcttaaagtgctagaattacaggtgtgagccaccacacctggctataaatctcgtttcttcaatcttactaaaatatgatatgtgtttctcaatttttttttcattattgctgcccccaggagacccaaaattagactttttcctaatctcccctccactaataacagcttgagatataaatacacaaacaatataattcatcctctgaaggtatgtttttagaatattcaaagagttgtggactgtcatgaaaatcaattgtgggacattctcaccaccccaaaatgaactttcacccattagcagcccttccccattgccccccaactcccaccaccctaattctaagcaatcactaatctaccttctatagatttctccactccaggcatttcatagaaatagaatcatataaaatgtaggcttttgttactgatctttcactttgcatgatgttttcaaggttcatctattttgtagcctatgttagtgcttcattctttaattgctgaatactattctactgtatgaatatatcatcatattttgtttatccattcatctactgatggacgtttgggttgtttctactttctggctattatgaattatgctgctataaaaatccacgtgcaagtttttcacatgtgaaaagatgtgtggatatctttcatctctcttgagtgtatacctaggagtgaaactctgagttacatggtaactatatgtgtttacttctttaagaagctagcagactgtcttccaaagcaccatcctacattcctaccagcaatgtatgagggtcccaatgtttccacatcctcaacacttgttatttttcacccttttaattgtagccatcttagtaggtgtgaggtaaaatttcattgtggtttctatttgcatttacataatgactaatgatgctaaacatttgttgttgtgcttactggcaatttttatatcttctttggagaaatgtctattcagatactttgcccatttttcagttgggttatttgtcttttcattattaatatttagttgtaagagttctttacatattatgaataccagatctttatcagatacaggatttgcaagtattccctcccatttggtgggctgtcttttcacttttttgataatgtcctttgaggtacaaaatattcaagtttcataaagtccaatttatctattttctgttttgtcacctgtgcttttagcgttatatctaagaaatcactttccaatagaggatcacaaagatttctgcctatgctttcttctaacagttttctagttttagctcttctttgggctttgatccattttgagttcatttttttttttaatatggtgtgaggtaggggtccaaattcactcttttgcatgtggatatccagatgtccctgcaccatttgttgaaaagactaccctttccccattgaattgtcttggcgcccttgtcaaaaatccattgaccctaaatgtgaggatttctggattctcaattctaatccattaatctctatgtttatcttcatgccagtaccatagtgttttgatgactgcaggcttctagtaagtttgaaatcagaaactgtgagtcttccaactttattcttccttttcaaggttgttttcgctattctgggcccacataattttcatataaaatttaggatcagcttgtggtaactgtgtaatcaaggagaaataagatcaaggtccaacacttaagcagcttatagcttttaggctgggtgtggaggctcacgtctgtaatcccagcactctgggaggctgaggtgggcagatcacttgaggtcaagagttcgagactagcctggccaacatgttgaaaccccatctctactaaaagtacaaaaattaggcaggcatggtggcacacatctgtaaccccagctactcgggaggctgaggcaggaaaattgcttgaactggggaggtggaggttgcagtgagctaagatcatgccactgcactccagcctgagcaacagagcgagactccatctcaaacaaacaaaaaaagctaagctatcttccagataattttgtacttttagtagagacggagtttctccatgttggtcaggctggtctcgaacccccgacctcaggtgatcctccagcttcaccgtcccaaagtgccgggattacaggcatgagccaccactctcagccccaatgggatggttttaaggaagcttgtccaacctgcagcccgtatgcagcccaggatggctctgaatgtattttatgtgtggcccaagacaattcttcttgtaaagtggcccagggaagccaaaagactggacacccctggtttagagggaagagagtagagggagaagggttggcaaggtagtgattttatggtttttagccaagaagtaacatggactgaacagaactatgataccgggcacagaaaagaagacaaccatctacatatgtgtaagctttattctgcttaaatgaaaaaccatgaaagagaaaaatatgtaattgtgaatgtcactggacatgttacttctggtcaaggtcttccataaattatttttcctccaaagtgatcacctctcctgtatttaccttctttagcgctaacgctggtgctgctataaggtatgtacacacttaatcatagaatattccatttaacaaattgcttctgggcacttggtacacatgaggcattgctcaaggctaatgatgcacaatgtgatatccagggacgaagaagttccaggacaattacatgcagattcactactgccaagtcccttcgctggaaggaaagagcacaattcatttctgtttagagattctggggtgtcagatccacgaacaagtcttatttagaatgactgcctttttttactttaagattccatgctacagtctgaactcaggtgtttgtggctacgcccctaaaacttcagtcctatttgggattttaaatacgcaacctaatgaaaagtcaattaagagttttacagttaaactccatatatagatactgctctttcaaagccagaggcagaatctgagcaggcttagtcattacagggctagaaacataaaaattatttgtcttcaggtaggcatttattcaatgcacccctgctacccactgtgtgctaggtaacagcatgactgagacagtgtctttgttctcaatggcccaagttctagggaggggcccagacatgggaacaggcaatgaccttgtggtgttgcatgagttatgaagttacgacacggaagcactgggtgccgtggaagctcagggtgggggtaactaagccagttgggaggcaccccagagctttcccagaagaagcaacattcccaccaaacatcacagggcttaggtggaactagggcctgctgaacagggggaaagaaggtggggagggggctttcctaaccaaaggtaatagtagggtgaggggggagaggtttaaaaaaaagaccagggagccttttggaaagtggggcagtaaagagtaaacaaatcagagtaataaaaagaacttgggtttctgaagcaccaactatgtaccaggctaagtactctacacagattatctcatctgaatctataagaatcctattgggatctttttttctttgaggcggagtctcgctttgtcgcccaggctggagtgcagcggcgccatctcggctcactgcaagctgcgcctcccaggttcgcgccattctcctgcctcagtctcccgagtagctgggactacaggcgcccgccactgcgcctggctaatttttttgtatttttagtacagacagggtttcaccgtgttagccaggatggtctcaatctcctgacctcgtgacctgcctgcttcggcctcccaaagtgctaggattacaggcgtgagccaccgtgcccggctgggatcattttttagtgtaactatattccaggcaatacttgtgttgaaatagagacagacagacacacacacacataataataattattatttttgagacagagtctcgctctgttgcacaggcgggagtacagaggcacaaatcttggctccctacaacctccacctcctgggttcaagtgattctcttgcctcagcctcccaagtagctgggattacaggagcctgtcaccatgcccagctaatttttgtacttttagtagaggcagggtttcaccatgttggccaggctagtctcgaactcctgacctcaagtgatctgctcacctccgcctctcaaagtgctgtgattacaggcgtgagccactgcacccgacttgttcctatatttttcttatcaaatttacccttcgtaaactcaagtcccatctgggttaacccagtctgactccagagctggtgttttcagctaagaatgggaaagactacactgtctcctggtcagcaccaccagtagatacagcaagaactctgtcaggggaagagaagagagctacagttagctccatgaatttcaatgttgagatacaagattatgacttcaggtccaatcccttaagcagtgagtcagcttggccacgtttttcttgatgtgatatctatcacactggcaacaatcaaaaactgtagattggccaggcgcagtggcttatgtctgtaatcctagcactttggcaggccaaggcgggcggatcatttgaggtcaggagttcgagaccagcttggccaacatggtgaaaccttgtctctattaaaaatacaaaaactagctgggcctggtggcaggtgcctatagtcccagctacttgagaggctgaggctggaggatcacttgaacctgggaggccgaggttgtagtgagccgaaattgtgccactgcattgcagcctgggtgacagagcaagactctgtcttaaaaaaaaaaaaaaaaaaagaaagaaaaaaaaggtgttgataatacgatttgttggtgagagcatggggatacagggattctcttatatggctggctgggatgtaaatggtttcttttattcaaatctgaaaatgcacattcagctgggagcggtggctcacgcctgtaattccaacaccttgggaggctgaggtgggcagatcacttgaggtcaggagttcaagaccagcctggccaatatggtgaaaccctgtctctactaaaaatacaaaaaatagctgggcgtagtggcatgcaccaataatagcagctatttggtaggctgaggcaggagaatcatttgaacccaggaggggtaggttgcagtgagctgagatccttccactgcactccagcctgggtggcagcgcaagattcttaagcaaaaaagtttcacgggctaatagtttcatgtggctggggaggcctcacaatcatggcagaaggtgaaaggcatgtcttacatggcggcaggcaagggagaatgagaaccaagagaaaagggaaaaaccccttataaaaccatcagatctcctgagacttattcactaccataagaacagtatggactgggaggctgaggtgggcggatcacaaggtcaggagatcgagaccatcctggctaacacggtgaaaccccgactctactaaaaacacaaaaaattagccaggtgcggtggcgggcgcctgtagtcccagctactcgggaagctgaggcaggagaatggcgtgaacccaggaggcggagcttgcagtgagccgagatagcgccactgcatgctggcctgggcgaaagagcgagactgcgtctcaaaaaaaaaaaaaaaagaacagtatggaggaaaccgcccccatgattcaattatgtccacctagcaccacctccttgacacgtggggattatgcaaatatgcctagaaatgtctcttggaaagatacccaagaaactggatgtggtctccaggagcgaagacggaaagattgacttaccatgtccttatataccttacctatatataggatttgatttttccctccatacgcacaaatgaccttaaaaattaaacacctttaggccaggcgcggtcactcacgcctgtaatcccagcactttggaaggccaaggcatgtggatcacctgagatcaggagttcaagaccagcctggccaacacggcaaaagcctgtctctactaaaaatacaaaaattagccgggcgtggtggcacagtcctgtaagtcccagctactctggagggtgaggcaggagaattgcttgaacccaggaggcagaggttgcagtgagctgagatcatgccactgtactccagcctaggcgacaagagcaaaactccatcacagaaaaaaaaaaaatttaaacacctatataaatacgtgtacgttaattatatgtccattacactatgtgcacacacacacacacatacacacacacctatctgtttttatcaggccattattaaaactgaacaaaactggatgacttcatatagttctggacaggcctagacaggagagcacagatgccttcacaccgatcctgtcttcccgagagagatacgctcttggtttggtgagtgtgtggcaatggttttctccccaggagatggcaccccagataaatcaatcagagcagtgtgggaccaggcctttttcagccttggagaaagaagcctttgccctaaaaatacaaaagtgtcagcttctcttctgtgttctttgtagctgtacctgaaaccaagcacctgtttgtgacttggcttcagttactagcaagcttttcctaaagaggtgttcaaatcccgcacaccaaaggatttgtgcttcagtgaaggaaacttcttgttttctgtacctttacctttgatattaacaaagtgttttattattttatttattatttattttgagactgagtcttgctctattgcccaggctggagtgcactggcgcaatcttggctcactgaaacctctgcctcctggattcaagcgattctcctgactcagcctcctgagtatctggtactacaggtgtgcaccaccacacttggctaatttttgtatttttagtggagacagggtttcaccatgttggccaggctggttgacctcaggtgatctgcccgtcttggccttcaaaagtgctgggattacaggcgtgcgccatcgtgcccagcccaaactgttttattttatacaaattctgtgcaaagcttagtttacagctcaacacaaataaacaaaattatatgttattaggataaaaatcccatgcccaattcatttatccctcagttaaactgttttggcatgggggactaaaagtaaacaagatttggaatgtccctaggatggctatgaatggcatgttgccatagtatttcagaagccactggtaaagccctagatggataggatgagctcttggccacaaagcttttcttaggattttaatatactacaatttatcgtttactgggaacccaggtggagtgacttcatttccaagaacataggtgtccacgttaccacgattatttttttcagattaaggctctatcttctgaagggaaaatgaccactatgcttcactgaaagtccatctcaatcagaaagacaggcagataccacggaaacttagtacttacctgccaagcccaagacatcaagatgatacacattttgtgtttctctctgagggtaaaagaagaaggaaactgctgcaaagtaccaaggaatataacccggttataaaacagacagaacgagaaacaaatggcaaacccaagtgttgaccttcccattcaaccagaccacccctctgcttgctggaactaggagtagagaaaaaatacaaaaaaaggaggccggggctgggcaggatggcttacgcctgtaatgccagcactttgggaggctgaggcaggcgcatctcctgaggtcaggagttccagaccagcctgaccaacatggtgaaacctcgtccctactaaaaataaaaaaattagccgggcatggtagcgggcacctgtagtcccagctacttgtgaggctgtggcgggagaatccacttgaacctgggagacgaaggttgcagtgagccaagatcacaccactgcactctagcctgggtgacagagcaagattccgtcttaaaaaaaaaaaaaaggcaaaataaataaataaataaataacaaccagaccatcccagccagcaatatgcagagctgctaagattctactagcaaataatttttaaaaaccaaccacctctgagaccttcaaaatattttctctccgctatggaggttgtctaaataacagattctgtgaatagacttcaactgtgttatgaatccatttactgtcttagtaagaatgtttttttttcccagcaagaacaagcaaaccaatgttctctgaggcaaacagacaagaaaagatgctgcttagttaaagaaaataagacctcgctaatccctattccctgaaggcacggcaactcaaaggagaactgatgatgatacactcagccactgctggaaaattttaaattaaatagcaggacaaccttagtaagcggagaaacagtcaggtgatgtaacaggccactaatggagccttttactcattcggggtggcagcgagtggacttcccagctcaatataagcagcagccaaaagaacaacaaaatcaatatcgccctcaggtaagtagatgccgagcagttagttgcaaaccaaatgatttctccagctgaggcaggctgcagggcagccagacgaatgacagtttgcaatgaggaagaatttcctgctggaaagactgctgccatactttgtcaaatcctttcccagctgggcgcggtggctcacgcctgtaatcccagcactttgggaggccaaggaaagcggatcgctggagccccagagttcagaccagcctgggcaacacggcgagaccctgtctctacaaaaatacaaaaattagttaggtgtggtggtgtgcacctgtagtcccagcgtgaggcaggaggctcacctgagcctggggaggtcaagtctgcagtgagctgtcattgcaccactggactccaacctggatgacagaatgaagccctgtctcaagaaaaaaaaatcccttcccaccagcatagtttcctcagcctgccctggctttcaggggtttctttctcccagggattctagccactggctttcccacggaccccaaggctgggtggtgcagtaagatgcaggctccagtgtattttcattgcacaataaagatgctcagtagatgtgtgtgggttggtctaatgtgaaatgagctgagggcagaaattaacaggaagacatcgggatacccacttcttgactctcctcacccctatttcaggagtgggttatcagcggggctctctcagaatccttcctcatcagtccaggctttctgatgagaacaggagggtcggcaacgtctccacccggctcccatctaacttccgtatgtgcgcacacacaccgcacatgcacacgcatgtacacaatgcacacatatagtgcacacatacacatgcacacagggtgtcattcctttgtcttctatagcctcttcccctaacagagcagtgggcgagccttaggcaattacaggtgtgacttctggcttactgcaatctgtgaagctgcaatgggcaggatatgcctgttctggatgaactatgtccctgaaaattcctatttgaagtcctgaccccagtacctcatcatatgactgcaactggacacggggtctccaacaaggtaagtaagttaaagtgaggtcgttagggtgagccttagttcagcctgactggagttgttataagacaaggggattaatgagaacacagctgcagagaggaagaccatgtgaggatacagggagaagtcggccatctgcaaggcaaggagagaggcctcggaaggaatcgatctaccaacactttggtctcaggcttccagcttccagaacggtgagaaagcaaatttctgctgtgtatacccccaatcctgtggtccttccagccttacagaaaaggaattcactcccagggagggacgacagtgaggtgtggtcggagcagctgtgcttctcttacctgaagcctcctgatgctctgggagaaggaatgctctttggaaaattctgccagctgccatgggataggacgtgggtttgtagcatgcctcacttctccccactggtttctgcccatgccactgcctccaccacacggggaaaagctgccatccacccagctgcctgactcagagatctgatccctgaccactcccttcctgccaccctcatacccagccaccaccatgtcttggggatcacacttcccaaacgtctctcaagcccttcatggtgcatggtttcctttgcctaaatcagagcatacttccccaaataacttgtgatgtatgcaaaccaccccccactccggcccccaggttccctctggggcttcctccaggtcaggaatgacaaggaaggggtcacagacacctcctgtgttcacagtggtggcggcctggatggcagacaagaagaggcatgctcagtgctaagacgtccccgaactcacagactctgggggtcccactgacttactacccaggtcctaccccagtgagctcaccctctgtcctctgcttcaattcctcacacactttacccatccctcttgccttgcagaactggcaagagcacactccttctcccggggctacagctcactgccggggaaacaataacctcctgaccagcctgtcacttccatgagtggcccgtgcaatccattatcgcgcagctgccagcagtggctctttcagctgtcaccagcctggcctcttccaatcacaaacggcttacagcttcccgcactcatctcatcttcagatcccttatcccactgacaccttacatcatcccttccctggtgctgtagatggacttgtggtatcttatgcaagagatccttctggaaaaccttgcccatttcaaggcttgaacatttcaagactaattctgcaacagaagggtgtatttccgttaccagctgaagtgtccatgccattttgcaagagaatggaaagcgttttgcatctactcattaccagctctgaaatgacacgattctttttctttttttttgagacggagtgtcactctgtcacccagactagagtgcagtggcgtgatctcggctcaccgcaagctcagcctctcgggttcacgccattctcctgcctcagcctcccgagtagctgggactacaggcacctgccaccacgcccggctaattttttgtatttttagtagagacggggttgcactgtgttagccaggatagtctcgatctcctgacctcgtgatccacctgccttggcctcccaaagtgctgggattacaggtgtgacttactgcgcctggccaacatgattctttttgttttgtttgagatggagtcttactctgtcacccaggctagagtgcagtgtggtgtgatctcagctcactgcagcatctgcctctcaggttcaagtgattctcgtgcctcagcctcccaagtagctgggattacaggcatgtgccaccacacctggctaatttttgtatttttagtagagatgggggttttgccatgttggccagggtggtctcgaactcctgacctcaagtgatctggctaactgtaatcccaaagtgttgggattacaggcataagccactgtgcccagccaacatgattcttgacaagtgtttactttgaagggacttgtaagtgaagatcacttacaagataggcttttatttttttcacactactttggattcacgcagcatcaatccctttattccaccacaaccatttacggatgagaaaactgaggcttagtgcagtcatatggggagaggggagggaggaatgaggactcagggttcagctgcagggggtccagcacagccacagaaggtcagcctgggaactgatttgtcaaaaggaccacaggtagagacggggggaagtgtggagacctcgtgttcaaatctctctcagtgaccactagctgtaatcttgtgtgccacaatgaatgaaaacacgtcttagatatctttagcgagtgcttccatctgccagggcaccaaggccaagtatttcacatatatttcatcttgacaatacctctgtcactttgacaccacctcttacctagctgtgtgctgtcttaatttctctaggtataaagcagcaataggtcagctacagtggctcatgcctataatcccagcactgaggctggggaggctgaggcaggaggatggcttgagcccaggagttcaagaccagccagggcaacatagggagatcccatctctaaaaaagaaaaaatcattttttttttatgagatgaagtctcactctgtcgcccaagctggagtgcaatggcacaatcttggcttaccacaacctctgcctcctgggttcaaacgatcctcctgcctcagcctcccgagtagctgggattacaggtgcacgtcaccatgcccagataatttttgtatttttagtagagatggggtatcactgtgttggccaagctggtcttgaactcctgacctcgtgatttgcccgcctcagcctcccaaagtgctgggataacaggtgtgagccactgcacccagcccttttttttttttttttttttaatacagagtctcactctgttgcccaggctggagtgcagtggggtgatctcagctcactacaatctctacctcctgggttcaagcgattctcctacctcagcctcccaagtagctgagaccacaggcacatatcaccacacccagctaatttttgaatttttagtagagacggggtttcaccctgttgggcaggctggtcttgaactcctgacctcaagtgatctgcccacctcggcctctcaaagtgctaggattacaggcgtaagccactgcaccaggcctacaaaaaatttaaaaattagccaggtgtggtggggcatgcctgtggttccagctactcgggaggctgaggtgggaggatggcttgaacgcaggatgttgaggctgcagttagctgtgttggcaccactgtactccagcctgggtgacagagcaagaccctgtctcaaaataaataaataaataaataaaataaaaataaagcagcaatagtgtactttatcttcaaagaatagaggaaaaaaatggtgttagtgtacggggctaggtgcctgggagagggtggtgaatgggatgctcaccatgcctgtgaagctcagaatgtgcacatgaggcttatgccagagctgtcaggggaaggacgctgcccctcatttctaaggaccatcctcacagcacctgtcaaggaaccgttgactaagtgatgatgaagagcaaataactctcgcaggctttagaccatatacaactggagccctgcgttggccacattcagttcagtagagtacaaccaaatgtgtgtccagtatagaggggttttagacactgttggaatgtctccagtttaattatccagataggcattctggctggtggcaacaggcattctggctggtggcgacagggaaaacagtaacactcaatgatcaaatcccagaggttatcaaggaggtccctagaactgtaggggagagtctggatatcaaagccttttgtttctttgtttgttgagatacaatcttgctctgctgcccaggctggagtgcagtggcatgaccataattcactacagactcgacctcctgggatcaagccatcctcccacctcagcctctcgagtagctgagaccacaggcgtataccaccacatctggctaattgttaaaagttttgtagagatggggtctatgttgctcaggttggtcttgaactcctgggcttgagtgatcctcacactttggcctcccaaagtgtagggattacaggcatgaaccaccatgcctgaccgaaagccatctgaattcaaacattttaatctgatggagtaatgttaattcctcaaataatgacaaggctatacaacttctgaatccatcataaccctgcactaaagaacattacaacacggacttatgaacacacagttcgtaaattatccccccttgcagcagccagtagtattaaaaagcaaagacaccagaattataacatactattattctcctacagtcatcttcaccttacaaatgtatggtatgcaaaaatttgttcataaactggctgcctggaatgcaactatgttttgtcatagagatcacgttataactgatggtgagatctcaggctaactcatacaaactgaattaattcacaatgcagatgaatacactaattcaacttcatttacaatcacgcttccttcccttgctgcatggtttactttcccagcgaaatatttgcaatttctgttattattgctggattttgtgtctttttccgcttttcaaaattgctcttatcagcaagtataaaaacctaactgctatttatacccacaggtgtaatagcaatgatcataagggaattcagtgtaagagaggggagaaatgtattacgtacagtaataagcatattaaatgcctttgattagagggtccgtagaggtataattatgtgattatctatactgagaaatactatttgttatattaatagaaataaaatatactgaattcgtagatttaggataacatatccctgatacataaaaaagcaaaagagatgaagaaaggattacaggttgcttataatcttgagatcccccgagaaagattgagaggagccaattacaatttgggtgtgaccaagtgaagcaaaacatttcctgagctgcccagaaagtcactctacagaataaatcatgaatatactagcgatcactcatgaaactcttaccacatggcaggcactgagcactttacttgcatgattgcaaccttcctagcctgttactctacaacaagatgctacattcctggctgaccaggtggctggggcctctccttgtgctaatactattttaatgagtacaacgacatcaaatgaagtgagctataaccagggaggagcagtgaggcctggccagttctgtgaggcaagagggttctgtgaggcgagaggcaaggcccaggagttcgagcccagcttgggcaacatacggagaccctgtctcttcaaaaagtgttcaaagaattgaagcagaggacaaacggtgagctcactggggcgggacctggatagtaagtgaatgggaccccctgtctgtgagcttaggagcatcttggcactaagtatacttgttctctgctggtgaggtcaccatcactggaaacatgggtgtctgtgagtcctccttgcaatttctgatctgcctgtcaccatctctgtgctggaggaagccccagagggagccctggggtgagaggtgtggagagtccagcatatatcattagttctttgggaaaacctgatctgacatccaactcaggtctctagaagttcagctgtgcctcctagccctggcataccctaaccaaaatagtgaagatggctccaagggccaggggaatacctgggacccagggatattattaatattacaaggttaatttggggacattacaaggtttaaggttaagacgtttttatttgcctggacttgaagaacgtgatcagcttaaatgtccatataattgtatacaaagatttttgcaaactcaagaaaaaaacatttaagagaaagcatcccacagactgtaccttcagtttgaactgtttattaatcattctatctaataaagatgtggaatcagaatcgtgttgtcatcttgttggcaatgcagactgcagaaaacgacgtctggagtactggtgagaggcggaggcattaaaattttgtttttataaagccactgagcagaaatgactcagaggaaacacaagggtattctgtctggggagactgagagagctaaaaagccatcttaaagtcataataaaggtttccagttaaatatagtagattgaaaacacattcagctttgttccttccacaaatcccactgtaaaggcaggaaactctcaaggacaaacaggagagaacagccacagaatttggaaactggaaagtacatggacaagtagcaatgggcttagctgagttattattgcttcttttgagatgggagtctcactctgttgccgaggctggagtacagcggcgtgaccacagctcactgcaacctcaacctcctgggctcaagttatcctcccagctcagcctcccaaggttctgggactatagacacatgccaccatgcctggctgattttcaaattttgtgtagagatggggccttgctatgttgcccaggctggtttcaaactcttggcctgaagcaatcctcttgccttagcctcccgagttgctgggattacacgtgtgagccaccacggccagctaattttttttaaaatttttttggagagaaagggtcttcctatgttgccctggctagtcttgaactatgagcctcaagcaatcctcccaccttggcctcccaaagtgttcggattacaggtgtaagccactgtgccaagctgcagctgacttagtttaagttaaatattcagctggcagcgagaaaagtcaagaatcaactggctttggaaaactctcaggcagtatttgccaaagacaaacccacatcttcccgatgacccagtaattccactccttggaatatacccagagaaatgagggtgttggtctattaaaagataggaaccagaatgctcttggcagctttattcacaatagcccccaagtagaaataacctagagatccattagcagtggagtgggtaaataatttgtgatctgttcattagatggtatactacatggctataacacagaaccaattgctgctacatgtaataacacagatgaatctcagacatcacatacagcgaaagaagccagaagacacaagagtcaataccgcatgatttcatttttatgaagctcaagaacaagcaaacccaactagtcctggtgacagaacgttgactgacagagaaggcgcacgagggagccttctggagtctggcaaatgttccacatctcaactcgagtggtggggaaaggatgagttcacatgctccagctctttacttcacattacccgcattttagttcctgagaaacctcaatttttagctatccttgggtataggaataaaaagagagctaaaacagaaagatggcttgaaactgcatgaagcttgaccactgtccttctcaccctggcagaagatgggacttttagtctttataaagagtaaacaaaggtcccagcactttggaaggccaaggtgggaggatcacttgagcccaggagttcgagaccagcctgggcaacatatggagaccctgtctcttcaaaaaaaaaaattttttttttttttttgaggcagagtcttgctctgtctcccaggctggagtgcagtggcgcgatctcggctcactgcaagctccaccccccgggttcatgccattcccctgcctcagcctcccgagtagctgggaccacaggcacccgccaccacgcctggctgattttttgtattgttagtagagacggggtttcactgcattagaaaaattttttttaattaaaaaaaaaaaagagtaaacaaagaagttctgagaggcagcagagactgctggggcatgggtcccccggggaaaacaaggggataaagatgaaagttttaccctggatttcaggatggagtcttttccttccatttggctcctagaacacttagagcgaaagaagccaggcagagccctccaacaggagtggtctctggggaatctgagagccaaaaagaaacaaccaaaagccaccgataatacggaaatggggagccttcatcacgcgatggtgaaggccgtgggcgagaaggcctccctcccccgcatttgtcagtttttctgtgctgtactctttttcattcttttttttttttaaattgcacttttaaatggaagcaggcagccaaggaccattagatgtatgagcaatgtgtctaatatgaaaaaaaagaacaaaacaaccccaatggtaagaaacagaggcgatatggggaggaggaaaaaaaaaaccattagcaggctgggtgtggtggctcacgcttgtaatactagcactttgggaggccaaggtgggtggatcacctgaggtcaggtgttggagaccagcctggccaaaagggcaaaacccggtctctactaaaaatacaaaaagtagctgggcgtagtggcacacgcctgtaatcccagctactcaggaggctggggcagtagaatcgcctggggggcagaggttgcagtgagccgaaatcgcactccagcctggatgacaaacgtgaaacccgtcaaaaaaaaaaaatcattagcattctcagacagagaagatactgcattaatcaaccaattacaggatgctattttgaaaaggaataatgaaaaaaaaaaaagctcttgaaaattaaaactatggtagcaaaaatgaaaagctcggtagaaggcttagaagataaggtgaggaatcatctcaaaaagtagagtgagcaaggaagtgaaaaaaaaaaaaggaaataatatttgaggaccagaacaagaggtccaatatttgtagactatgagtaccacagtataggggagctcccctgcccacacacaacacacacacacacaaacacacaaacacacacacacacagatggagagagagagagagagagagagacagagagagaggatgaaataattcaaaaggacttccgagaacaaaagggcatgagtttaaacggactcataccaaagtccctcacagtattattgtagaaccctggatgcaaagagaagatcctatgtgtttctggtttcatataaaagatcaacaatcaaaataaaattgaacttcttaaaatccatactgaaagaacaaaggcaaggagacaaagccttcaaaattctgagagaaaaataactcctcacctatcattctatacccagccaaactatcaaactatcactttaatgtgagggtggaatgaagacatttttggtgcaatttcttctccagaagctactggacaataggatccatctaaaaaggaggcaaaggtagatccaacatgagagagaagcacagatggttcctagactagacacagaaatcctaagatcacagctgttagcaggcctacagagcaagcaatcaggaaatagctccaggagaaatttcaccaaaaagctgagattggttattattttaaatttattgacgggaaattggtaagctcagacttttggaagaagagtctgaggttgaattagcactcttcaaaaacttaaagcaattttaaaaccacaacaaataaagcatgcaggaaaaataaccatgcctacaatgtggctctgttgtgaatgatgtttaaaataacatatgtacaggcaagatattataaatactaaatgctgatacgacccgaattaggaattttttttttttttttttgagacagagtcttgtactgtcacccaggctggaatgcagtggcacaatctcggctcactgcaacctctgcctcccagattcgagagattctcatgcctcagtctcctgagtagttaggattacaggcgcccgccaccacattcggctaatttttgtatttttagtagagacagggtttcagcatgttggccaggctggtcttgaacttgtgacctcaggtgatccgcccgccttggcctcccaaagtgctgggattacaggtgtgaggcactgcatgcagccaaccaaattaggatttaacgacactggaaagacacggggaagaaatgtgggagtgggatggagagaaggacagagctaaatcctcattctccaggacacaaattcaatacataacagtaagtaagatctagaaacatcaacacaagcatgttgtttagaacaatggaagtgaatatccacaaaattagctcaactcacgagggtggctgcctctagaagtgagcaacaggccaatgaggagttgtgcactgctgctttgtaaaacttgctgggtacagctacttgacttcttaatctgcatgcatttataacgtgaataaagacagaaaacaaaatgaaaaaaaaactaaatcataacctcgtttttgcttcctataaaacagcaattccataacctgtagaaagcattacacaattaattgcttctagttggcaataattacaggacaataatttgtctttgtctctgttttcaaattacacgttttttttttttttttttttttttttttttgagacgagtcatgctctgtcacccaggctggagtgcagtggcacgatctcgggtcactgcaacctctgcttcccgggttcaagcgattctcctgcctccgccttccaagttgctgggattacaagcatgcaccaccatgcccagctaatttttgtatatttagtagaaacggggctttgcgatgttggccagcctgatctcgaactcctggcctcaagtgatctgcccacctcggcctcctgaagtgctggaattacaggcatgagtcactgcacctggccacacaataattttttttttttgtttttgagacggagtctcgctcttgtcgcccaggctggagtgcagtggtgctatctcagctcactgcaagctccgcctcctgggttcacaccattctcctgcctcagcctcccaagtagctgggactacgggcgccagccactgtccccggctaattttctggatttttagtagagacggggtttcaccgtgttagccaggatggtcttgatctcctgacctcatgatccgcccacgtcggcctcccaaagtgctgggaataattttttaactagcaaataattttcctcttccccaaaggtatttaaatgtctggcctcaggatgtggttccactcccctatgagtctacagggttcccatggcatcactcatcagagagatgagtcctctcatggtctccccacaggaacacaggacaccatgaatcaggacttgcaccccacaaaaatcacaatccaagtgcaagcctcgaggaacacagggatgaacctgggtcaggtggtaaagggatcctgtcttacctagcactccccagctctcccatgcccatcaccagactgcagagaccaggcaaggcagggaggctcaagacagatcttgggtcaaagccagggcaatagggtgaaccccaccaacaggcagagaagcagccgggagtactatctggagggtcaccagcagcagagagctagggaaggcttgtgttgccactgtcccaagtgcacggatgtccaggtgatatcgggtacaaattcccttttatggacctgaaaatctgctcccaacatactccatggaccaatgattatttttgcctttctcttgggaaaagagaatgggatgagtagactatgacaataaagtattttgcaccaagatccaatggccccttccccaaaaatatatatattttttttagatggagtcttgctctgttgcccaggctagagcacagtggcatgatctcggctcactgcaaactccacctcctgggttcaactgattctcccgccttagcgttccgcctcagcctcctgagtagatgggattacaggcgcacattaccgtccctggctaatttttgtatttttattacaggcgaggtttcaccatgttggccaggctggcctcaaactcttgacctcaagtgatcagcccaccttgcatcccaaagtgctgggattacaggcacgagccaccgtgcctggcaccctaaagataaattacacttagtgtaacaatatgtataactataccacctgcttcataggattgttatgaagattcagtaagttcgtctctgcaaagagcttagaacaatgcctggaacacagcaagccctatataaatgttagttattacaaataaaataaatcaggggaagagaacatgacttgtttgcaaaggtgccgtgagaagtctctctctgtccagacattatgctcacatgctgtttaaatgttttgcatgagactaaaaagaggcctgcatccccagtgccccagtaaggaaagaaagttatatttaaactgcccctaatggtggaagagggttacacctggagaccattatgggccgtcactttagtccagtgcataaagggatcaggtcacctcccacctaggaagcaagatcccctgggccctggagcctgacggagcttggtgcctggcacttctgtattctgttctgactttgtaagggtgagcagggcatggggcagtccttatatctagggaagcttgggccttcagaggagccccaaactcagaagtgggctgtagactgtgtagatcatatgcaagtattactaaactccatcagcagatgaagaaaaggttaaacacctttggattttttttttttttttgagatggagtctcactctgatgcccaggctggagtgcaatggcatgatcttggctcactgcaacctccacctcccaggttcgagtgattctcatacctcccgggtagctaagattacaggcacataccaccatgcctggctaatttttgtatttttagtagagacaggttttgccatgttggctaggctggtctcaagctcctggcctcatgtgatctacctgcctcggcctcccaaagggctgggattataggtgtgagccaccgcacctggcctggattttggctttcattgtctggaaacttctagctgttgtgttgaagggaatcaaagtaaattctagcccatagaagtgaatacaaagaaaagggaggaggagagacttagattcagtattcttccatttgcttaaccattatttacagaatgctaggcaatctaaacactaagattctaggcactaagaatacaacaaaagtgtctgccttcatggagcttatgttttaatggagaaagatggatgatcagtgcagctaataggtaaagcaggcagtatattagatggtgctaagtgttacggagggaaaccaagtgggaaggcagtggggaggggaagagctgcaactctaaaatcagagatcatcagatgggtgcggtggctcacccctgtaatcccagcaccttgggaggcccaggtgggtggatcacttgaggtcaggagtttcagaccagcctggctaacatggtaaaaccctgtctctactaaaaatacaaaaattagctgggtgcgatggcgcacacctgcagtcccagctactcaggaggctgaggcaggagaatctcttgaacccgggaggtggaggttgcagtgagctgagattgtgccattgcactccagtctgggcgagagagtgagaccatgtctcaaaaaaataataataataataataaaaaaaatcagagatcatttcaatgaaaaggtaacatttgagcaacaacttgaaggtgtagggcaacaaagatctgaaggacaagcaggcagtccaaattcatgggaagaaggagaagaagggagagcaggcagagggaacagtgtgtaggaagagggaacagaatgtgaaaaggacacagaggaaccaaaaagcaccccttacaggtggggcccagagtgacaggagatacagcaggcagggccagatcaggcagagccttgtggttcccatgcagggacctgtctggattctcagagcaaccggcagcccctggagggttttaagcaggcaagggcatactcagggctgagcgtttgaataacctctctggctacaatgcttttattggccacaatattttggaagactgaagttaacacatggtctgagcagcttactcttgcccccctgaagaattctaggaactgtgtgaggctgcagtggtcagaggggctgctgagccatgagaagaaaagggacactggagctgcgcagcaaaagggctctgaggtcgccagagtggctgccagataaggaacagtgggagggagcggctggagggaacatttgagcaattttctctctctcttcttggtcttcttggcattcatcttccctgtgtcaggggacccctgcctgcaaaaccgaggaatccggtcattttttaaagtataaaaattgccagcatcctgttctaccaggacaaagtcatcatggaaatgataatgactgacgccttcctggggataagtggttaacacggtacccgacgcaggtagagggcctgttggcagatgcgtcgtggcttggattattctttctttagaaaatgttaagaattcatgtatccgggagataatccgaatgtgcatcacgagaagagcagcccagtaaaggattgttgtgttcttaatgaaaggacattacgcagccgttcacaatgatgcttgtaataataaggaggttgttgatattatatgaaaaattgcagcacacaaaaccgcaaataatgtaggaactcagctatgcaaaaaaaatttttaaaaattaggaaggaaatatgccaacaatgttaatagttattacctctgggtggtacagaattacgagtgattttcctctcttcttccaaaatgtcttttgattgcatatctattacttttataatcacacacacacactcgcgcacacacacacacctgcttattattaaaaaaaatgttgcagagatgaaatgtctctgaatattttagttcacaaatgtgtaactgtaagctgtggacatgaatacagatgaccactgattcatttattcagaagcaagaatgctgagatttttcaggaataagaaagtaaaagcaaaatctcctagcaaagtgccttacctacttaaacaggaaaaaaattattcaaattatttagagagtttatgggtatggactaacctctgggtaatttagtagcctaccatacaaggtcctgctaaaaattataaccctactcataaaacgaatgtcatctagttaggccccaaatataaaatcaccccaaattacagattcaatatattttgttcagttgcaatattattagcaaactgttttgccaaaacatgtttaatgtagcagctaaaccctggcaggctaatgatcattacctcctggtagagaaaagttaaatgaaggagttttcctactctgatcccaggatcagcagtgcttgctcagggaggttagcaccacacggtgaagggtgagtgggtttgggagggaggcggctttcgcattgagtcttgggtctgctgcttaccgagctgtgtaaccttaagtaaggtattgattcttcctgagattgtttctaatcccaaaataaaaatagtagcgcctcactggacagaatggtcatgagaataagaaagtgtgcatgtagaataagtagtagagagactggcttgccctggacactaaatgaatggataaatgaatggacaaacagtccaagcaagtgagttttttctacctgtccattaataccaaagtgctggccaggcacagtggctcacgcctgtaatcacagcactttgggaggctgaggcgggtggatcacctgaggtcaggagttcaagaccaggttggccaacatggtgaaactctgtctctactaaaaatacaaaatattagttgggcatggtggcaggcgcctgtaatcccagctactcaggaggctgaggcaggagaatcacttgaacctgggaggcggaggttacagtgagccaagatcacaccattgccctccagtctggacaacaagagcaaaactccatttcaaaaaaaaaagtgcttgttcgagtaaacactggggctgcaagagtggggcagattgctacgagtaggctaacctctctctcatttcctcctttttctcccatttttgcctctagtatagaggatgccaaagcaacaacatggttcgcagcctcctctctagttagaggtggccaagtggcaaggagacatgaggagaaattggctgggggattccagggaaacttttggtttcttgataaaagggttaggtgtcagtggtactgcctcccttcctgccttcttctcttaaacagtgaggtgatggctgggctacagcagccattttgcaaccatgaggaaaataacaagaaattggcagagacactggtcatgacagtgtaaaccaaataagtcaatggtcggagctgcctagccttgttattatgtggaaagaaagacgaaagaaagaaaagaaaagaaaagaaaagaaaaggaaggagaaaagaaaaaaagaaaggaaagaaaggaaaggaaggaaaggaaggaaaggaaagaaaggaaagaaagagcgagccagccctgctttatttaagatactttttaggccgggcgcagtggctcatggctgtaatcccagcattttgggaggctgaggtgggcgggtacctgaggtcaggagttcaacaccagcctggccaacatggtgaaaccccatctctacaaaaatacaaaaattagccgggcatgacggcaggcacctgtagtcccagctactcaggaggctgaggtgggagaatctcttgaacctgggaggcagaggttgcagtgagcagagattgcaccactgcacaccaacctgggcaacagaacgagactctgcctcaaaaaaaaaaaaaaaagctactttttaaaaacccgtagccaaaagtattcctagtgcataccaatcatgactaattaggtctggtccttgcactcatggagtttaccgtctactggggatgaggacaatagaagggcctcacagctaaatgtcaaattagaatatattattagcgttacaaagaagggagtgcttggcccactcctttatatagcaggggttttcagccagctgcaggggcaagggcagctttcctcagtgggtgatgagaatgctgggggagcaggggtgaaggagagaatccctagcagagtgaacagcaggtgcaaggccctgtggcaggaaaggagagcacagagtgtgagaatctgtcagaaggttagaaagcccctggtccgggagggtgctgctgggctgctgcaccatgtcccctactgctttcagctcccaatactgggtggcttgttacctgcaggcaaacactctcctaagtgatccaccagctttcccggctgatcacaagagaaaaggatgagtccacaactatttaacaggcttagcaagtcatttaatccacatctctaaggagccagcattgcactagataacagtgccctttctaaaacaggaaaactgcccgacatagcaatataatggggcccaattatgacaaaatatcatagtaactccaggccaactaggatagtacttaaaatatagtgggcaggacggcagagagagtaaatcatcagaaagaatggttctgcctcataaatggcaccagagacactcagaatggtttcacatcagacttttaaaaatcagcagaaaaaaataaatcctcctctggctgccctttttttttttttttttgtagaataaatgaaccgagacagacttgtttatcgagagctgaggaggctcacatgtgagtggagagagatgtcagagtcattagcggtgataaagggacgccattcactgtgggtatgatttaaggcaggaagctcaaccaagagcagtttttgcaatgggcctgatgatttgctttcccccagtggggaaggaattagatggacaccattaatctgttcacacaggccatcagagaaaaatcatggttgaagagtaggttgggtacatgaatttctatgggacagaagcccctttatggacaaatgagacatctgttagggtttgatgagatggctcacagttaactgcgctacactttgcactttccagtatatgatggtaatcaccatagtctatgtgcgtgcctctctcctctcaaagacaacagtatttaaaacactgcaaaactgacctggcgtggtggttcacgcccgtaatcccagttctttgggaggccgaggcaggtggatcacttgaggtcaggagttcgaaaccaggagttcgaaaccagcatcgccaacatggtgaaatcctgtctctactaaaaatacaaaaaattagcagggcttcgtggcacatgactgtaatcccaatgacttgggaggatgaggcgggacaatcgcttgaacctgggagggggaggtcacagtgagtcgagatcagaccactgcactccagcctaggtgacagaacaaggctccgtttcagaaaataaaataaaataaataaataaataaaatactgcaaaaatagatatattcttacaaatacatgaatagagaaatatgtggaaatgaccatgatactcagagaaacggcattttacataactacagacctgtctttaacacactgtaatcacataaccaataataagctattacctaaagaaacactctacaagtaaaagcaactggttgcatagcgtgacatgttagaaatcacacaggcaggtatgaggagcccgtgaaataactgtgggattttaaactatcggacaagatgaggaaggtagaaaattcctaactaaacatattaaaggaattacaaatgttccaagatgataaaaagataatgattgccaaccttaaatagatatgggaaaatttatttcactcattgcaaaaacataaaatctatctgctcaaaagagttaccgctgaatgcctgccaccttcctccaaaccaccgtggagctttcactgttcctttcctatggtgatcaatgaccatttattgggtgatacaggatatgcaccctgcactgaaaaatcaggggtagtagatggatgttcagatgaagacatgaatgttcaagggtagttcagaacattgcccaatagctgcttctcagttattttattatcagtggggaaacgacagttgttggggatcccaaagatcacccccagattgaactgtttgttaggaggactcacaggaccccgcatattgtcatactcctggctgtgatttatctcagcaaaaggacaaaaaacgagatcagcaaagggactggaggcgtgggacgaatacacagggaaccaggcaccagtttcctctcccagtgcagtcacacaggatgtgctaactcctccagcaataagctgtgacaacatgtgtggcattttgtctatgggtcatgagtgacccagcacccagggctgttgttgaagctggtcacttaggcagcctctgtccaacatatacccaaattccagactcccagaaggaaaggtgggtgttcagcatacaccacattataggaaccaccccaaaatccaggttctcagatgcacgccaagtgctagccttgtgaatggggccttttgaagggtaagtctcaggacttctctgctagtgaagtcttttctgcacagaaagactattcaaaaaatggaaatggggccactggcataaccaagtggaaaaaaaatgaaataaaattgtgatccttatccccaccacacaaaagccaatcccaaataaattaaatataaaacaccttttcagctcttaaaagaaaatacagtagactatctttatgacctcaggataaagaacgatttcttaaacaagaccctaaaatgcaccggtcataaagaaaatggacaaagtggactacgttaaaacttaaaaattctgttcattgaaacaatgtaatttttaaaatgaaaagaaaaatctaagaaaagatagcagcaactgatataagttgataagggattaacctgtaaatacacaaagtactctaagttaccaagaaaaagtcatttatctcaatggaacaaacaggctgagatgaacagagaatgcagagaaatggaaatccacgtgctcagaaaacatacgaaagacactcggctgagcacggtggctcacacctgtaattccagcactttaggaggtcaaggcaggtggatcacttgagcccaggagtttgagagcagtctgggcagcacgatgaaaccccatctctacaaaaaaatacaaacattacccaggagtggtggctcacacctgtggtctcagctacttgggaggctgaggtgggaggttcacgtgagccagggcgacagagcaagaccctgtctcaaacaacaaacaaaaaccaaaaagaaagaaagaaagatgtggctgggcgtggtggctcacacctgtaatctcagcactttgggaggctgaggcgggtggatcacgaggtcaggagattgagaccatcctggctaacatggtgaaaccctgtctctactaaaaatacaaaaaattagccgggcgtggtggcaggtgcctgttgtcccagctatttgggaggctgaggcaggagaatggcgtgaacccaggaggcggagcttgcagtgagattgtgccactgcactccagcctgggcgacagagcaagactctgtgaaagagagagagagagagagagagagagaaagcaagcaagcaagcaagcaagcaagcaagcaagcaagcaagcaagctcaacttctctaagaattataaaaaggaaattaataccacagtgaggacttatttcttcttctagccaaggaggaggaacacacactgggtttaccctcctgcctggaagaattaaaaaactggacaagaaacacgaagccacagtacttgagacatggactagcaggctacggcagccagtgacccgtaagagacaggacgctagtgagacaggccctacaggcgtcggactgcaggatttctaggccatgctacagagaggggaacacaggaagggtctgacagtctccctgagatgagaaaatagagctgggagtgcaggcatcaaagcattaagagtttgaaggacagaagccaggcgtggtgactcacacctgtaatcccagtactttgggaggccgaggcaggcagactgcttgagctcacaagttcaagaccagcctcctgggcaacatggcaaaacaccatctccacaaaaaatacaaaaataagccaggcatcgtggcacatgcctataatcccagctacttggaaggctgagagtatgggaggatgacttgagcccaggaggttgaggttgcagtgagctgagatcacactactgaactccagccttgggcaatagagccagaccttgtctcaaaaatacaaaagtaaaaataacagattagacactacaaaaggaaagatcaatgaacttaaaggcagtccaaaaggaaatatagagggggaaaagagacaaaaacagtaacaaacactctcggagtatcagtgagctgtgggacaacttcaagcaggctaataagtgtgcaacagaaatccctcaaacagaggtggggacagaaaaaatacgtgaagaaaggcgggctgaaatctcttcaaatatgatgcgagttatgaattcacagactaagaacctcaatgaactctgaatgaaagaaacataaagaagacccagcaatcccattaccaggtacatacccagaggaatataaagcattctaccataaagtcacatgcatgcgaatgtgcactgcagcactgttcacaatagaaaagacatggagtcaacctaaatgcccaccaacgacagattggataaagaaaatgtggtccatatacaccatggaacactacacagctataaaaaaaggaacgagatcatgtcttttgcaggaacatgggtggaactggaggctattatctttagcaaattaacccaggaacagaaaaccaaataccgcatgttctcacttataagtgggaattaaatgataagaacttatgtgtacaaagaaggaaacaacagacactggggtccgcttaaggcgggagggtgggaggagagagaggagcagaaaagataaccattgggtactgagctgaatacctgggtgatgtcataatatgtatagcaaacctgttactgtggaagttaaaatatgcaacaatagcacaagttacctatgtaataaaccttcacatgtatccctaaacctaaaataaagatgaaaaacagaagaaacataaaatgacaccaaggcatattataatcaaattgcttaaaaccaacgataaagagaaaatctgaaaagcagccagacagaaaaaacacattatacagaggaaaaggtaagaattgtagcagtttcttcttggaagtactgcaagccagaagaaaaaaaaaaatttaggtactgaaaaatcaatacaaaacaaaattgtcacgctacaattctatgtcccggcagggtgtggtggctcacgcctgtaatcccaacactttgggagactgaggtgggcagatcacctgaagtcaggagttcgagaccagcctggccaacatggaaaaacctcgtctctactaaaaatacaaaaatgacctgggtgtggtggcacacacctgtaatcccagctacttgggaggctgaagcaggaaaattgcttgagccttggaggcagagttacagtgagctgagagtgtaccactgcactcccgcctaggcgacagagcaagactctgactcaaaaaaaaaaaaaaaaaaaaaattcgatgtccagtgagacaaactttccaaaacaaaggtaacataaaaactttcacagacatcctgaaaaagtacatcatcagcagcctggggctggttacaaaaagaagggttaaaggaaggctggaagcagaagaaagccaataccagatgcggctctggatctagacaaaggcacgaagcccaccagaaatggcaactatgtgggcaaacacagaatcctttttttttcttataatttaaatttctttgaaaggaaattgtctttgtaaaagaaaaaaaatcacgacagcatatggcagggtttttagcatttatttgtggaagtaaaatatgtgacacccatagcacaaagcacaggaatggaggaatgggtgtctattgttatcagggtcttatgtaatacgcaaagtggggtgatatcgcttgcaggtggactgtgagaagttaaagatgtacactgtgcacgctaatgcaacctcgaaaatgctacaataaagggttatagctaatgggccaggtggaactcaagtgggatcaggaaaaataatctaaaagaagtgaggaaaagaggaaaaaggggaacagacaacatatagaaaaatgggaagtagtgttacaactcttttggaatccaggctttccagagtttactcccaaaaaataaaaaaaaaattaaaaaaaaaaagaagaagaatgggaaataaatggcaacatggtaggtttgaattctaccaatagaaatatcaataaggccgggcatggtggctcatgtctgtaatcccagcattttgggagactgaggtgggcggattgcttgagcccaggaatataagaccagcctgggcaacatggcaaaatcccacctctctataaaaagtacacaaatttgccaggcacaatgactggcatctgtagtcccagctactcaggaggctgaggtaggaggattgattgagcctgacagggtgatgctgcagggagccatgattgcaccactgcattccagcctggacgaaaagggggactctgttttaaaaataaataaataaataaataaataaataaataaataatcacattccatagaaaaggaaaaaaatccctctataggcacatcatactgaaaaatcactcatggaaaaatacatcacctgaatagccttgtagctattaaataaattaaatgtgtaaaaacctacacacaacgaaaactccaggcccatgttgcctgtctggtctcaaactcctgggctcaggcaatctgcccgcctcagcctcccaaagtgctagaattacaggcatgagccaccgcgcccggccttaacgaggaaactttgggcgtgacacgtgcactcattattgtgattgtagtttcacaggtatatacatatgtcaacatttattaaattgcacacttcaaacgtgtgcagttcattgcatgttaaatataacatataacccaataaagctactgaaaaactgttcactgtgtgcgcatttttaaatgtctgccaattatatctccataaacctaaaagaggaacaccacgcagtgcccgtctcacacccaagagactggtcaaaattagaagcccaacaactgaaagtgtcggtgaggaaacagccagtggacattcgcacacatttctgctatgcgtataaattaacataccatttcgtagacaaaatctagcaatatcctggaatgctgaagtgattattccagaatctcttgcatatgggcacagtaacaaaggagaaagctcactcatagtggcataatttgtggtagcaaaaggctgaaaacaacctatgcccaaacacagcacaatggttaactaaattgtgttatactcatatatggtaatactctacaacaatgaaaataaatgaactagaatgatccatatgaatgatccatatgaatacagaaggctttctaacatacagggaaacaaatctgtaaaagaaaatatgtgagatacgataccatttacacacagtttaaaaacatgtgaaataagcttatatatttctgaggaatacatacaaatattaaaagcatacctcagagatattgcagattcagttccaggccacgacaataaagtatctcaataaagcaagtcacacaaattctttggtttcccagtgcatataaaagttatatttacactccgctgtagtctattaagtatgcaagactggccgggcgcggtggctcatgcctgtaatcccagcactttggaaggctgaggtgggcggatcatgaggtcaagagttctagaccagcctgaccaacatggtgaaactctgtctctattaaaaataaaaaattagccggttgtggtggtgcacgcctataatcccagctactcaggaggctgaggtaggagaatcacttgaacccaggaggcagaggctgcagtgagcagagatctcaccactgaactccagcctggacaacagagcgagactccatctcaaaaaaaaaaaaaagtatgcaatagcattatgtctaaaaaaaatacataccttaattaaaaatactttattgctaaaaaaaaaaatgctagcaatcatctgagccttcagtgaatcacaatctttttgctagtagagggccttgccttgatgttcatgacctctgactgatgaggacgctagctgctgaaaggtggggtggctggggcaatttcttaaaataagacaaccatgaagttgtctgtatcaactgactcttccttccatgaaagatttctctgtagcatgtaaagctgttttgtttaatagcatttcatctacagaatgtccttccaaattgcagtgaattatctgaaacaatgccactgcattgtgagtttatggaatactctaaattctttgttgtcatttcagcaatgttcgcagcatcttcaccaagagtagattccatcccaataaaccactctctttcttcattccataagacgcaactcctcatctgttcaagttttgatcatgagattgcaattcagtcacatcttcagactccacttttaattccagctgtcttgctatctctaccacatctgcagttctgtcttctactgaagtcttaaacccttcgaagtcatccatgatgactggaatcgacttcttccaaactcctgttaatgttaatattttaacctcctcccacgaatcacaaattttgtttgtttgtttgttttagatggagtctcactctacacccaggctagagtgtagtggtgcaatctcagctcactgcaacctccgcctcccaggttcaagtgattctcctctcagcctcccaagtagcttgaattacaggcatccgccaccatacctggctaatttttgtatttttagtagagacgggggatttcatcatgttgaccaggctggtcttgaacccctgacctcaaatgagctgcctgccttgggcttccaaagtgctgggattacatgcatgaggcaccgcgcctggcagaatcacgaatgttcttaatggcatctagaatggtgaatcctttccagaaggttttcagtttactttgcccagatccatccaaggagtcactatctatggcagctacagctttatgaaacgtatttcttaaatacattaaacgtttctgttgtggagatggcttctttccttaaacctcgtgaaccttagactttggcttaagggaatgttgtggctggtttgatcttccatcccgaccactaaaactttctccatatcagcaataaggctgtttcactttcttatcatttatgtgtttagaggaatcgctagcacttgttagtttcctttaagaacttttcctttgcaaccacaacctggctgtttggcacaagaagcctagctttcagcctctctcagtttctgacatacctttctcactaagcttaatcatttctagctttctatttaaggcaaaggatgtatgactcttcctttcatttgaacgcttagaagccagtatagggttagtaagtgacctaatttcattattagtgtgattcaggaaataaggaggccccaaaagagggagagagacagggaaatggccactcagtggagcagtcagaacacacccatttatctattatatttgccaccttaaatggacatggtttgtggcaccccagaatgatcacaccatcaaagatcaccgatcacagatcaccataacagatatagtaaagaagaaaaagttcaaaatattgcaagaattaccaagatgtaagaatatgctgttgaaaaaatgatgctaacagaggccgggcgcagtggctcacgcctatagtcccagtactttgggaggctgaggtgggcggatcacttgcggtcaggagtttaagaccagccaggccaacatggtgaaatcctgtctctactaaaagtacaaaaattagccaggcgtggtgcctcatgtctataccagctactcgggaggctgaggcaggagaaatccttgaacttgagaggtggaggttgcagcgagccaagactgtgccactgcactccagcctgggtgacagagcaagactctgtctcaaaaaaggaaaaacaaacaaacaaacaacaacaacaaaaaaaacagaaaaaatgatgctggatgcatggttgccacaaaccttcaatatgtaaaaaaacacagtatctataaagtacaatcaagagaagcccaataaaataaggtatgcctgtaataaaaatatagagagatacaatcaaaaacccaaaactcttaaagataatacttacctctggagggaagcagaggaatgttctcagggagaggtggctaccttcctatctaataacccttctttttgttggcagcaagtgttccagcagagtgttcttaaggaaattaacagtgctactccagtaaacacacaaatgataggaaagtgaaacagccttatggctgatatgaagaaagttttagtgatcaggatagaagatccaaccagccacaacatgaaaatatattacatttttcagtacaattctggtctctagagtaaaagtcattggatagacctccttgaaaagtccttttgctactgacctttcctccttcgtagaatacagatgtgatggctgcagctcctgcagccattttgtaagcacaaagacaacagccataccctaaagatgaaggagcagaaagctaggaagtcccgggtcccaggaacccatgtctccaaatgtctcattacctgagagaaaaataaactcttaacatatgccactgttctttgcattttcttgtcacatgcccttatccctaactaaaactggcacacaggaggcttaaataggactgataatgttttacttctgaagctggctagggatgcatgtgtatgcgttatattaatctttagactatttttggtgtttttttatgcttttcagtttttctaagatgctgaaacatttaaaacttaaaaagaaattgtagcccaatacctaatcctcagtaagattttcaggactcagtgataaaataaatgagaaatgtctgtgctaggaagctctgaataggaagtaaaaagcaagcttcctagagccaccaaagtcatagaattcaaacccagttttgtctgactccccaggtcaaagcatttcccactctatcccaaattactgagcacaactttgctttgaagattaaagcttcctcgtaataaactagttctggtttataaacttaaacacaatgagaatagagcagaggttaaagtgctgtttgaatataaaaaggctcctgctttctttaagaaagtctattaaaaaaacatcacaggctgtaactggattttggtgtgaaaagcatcttctggctcttaaaaagcctaattgatgttagtttatgacataaactggctcctgaatcactgttaggggtttaatgagttgtcatgcttgataagaaactcttatgttatctcctactctaccacacgaaatatggaagctttgtttaatcttgacagccctcacttaattctctctaacggccttctgttcaaccacagttgcctttagattgttgggaataaatcaatctgtgtcagctctgagtagatcaaatttattaaattctgaaaatcagttagaagtctatcctggcaggtaaacaaatgaataaaaagacagtatgtaatggtatgaaaatttatatatatagtatatatatttatattatatattatgtatatgtttatatattatatgatatataatatatatttatatatataaaatcttgcaaactaaaacacatgccaaaaatgaagtgctttcaaaaactgcaccagaataaaataaaaacaaagaaaaacatttggagctagtagaaattatctattaaaattcatctctggcaagacattacataacatatattaattagattatgtattatatactagctgtactatttattaatataatatataattacatattaataacattatataatatataaatatgtcaatatattaatgacatatatctatttccgcctctctagccataaactccaaactctcttgcctttcagattcataaactgaagaccgatagcaaaatgatgttcagttaagcaaattcaacatgtctgaaccttcataaattcggtatagtgtgaatttatgatctaaatttttttttactatcctattattctattcactgtgaaaaatatttctttgaaaagttactggatttctttacacactgctatggactgaatgtttgtgtcactcccaaattcgcatgttgaaatcctagcccccagtgatgctgtcctgcagtgtgatcctggcctcgggagacgtctgtccccagcagagctaatcacctttactctttgggtgaaattgaaactgataatattttgatgtcaacgcatctcattcaagagctgagctgtgaaatcctacgaagccatggcaggggtaggtcccgtgcgtgccccaaaaccaagaaagccaggctttggcaaaggaacaaacaaaagcagcagcagcagcagagaacagaaggccatgcggtcccagtgatggcaaaagtcactgatcgccacccttcctggtcagatggccacctttcctggtcactgatctccatgcctagaccctcccctcctcctccaggtctgactactcttcctgtccctggattctcaatcttcccaagtctcaacaaccccagccacctcatacattcataaattcccccttcctcagaatccatgtgtctacccgccctcctgcccctaatgtgaacacacttcccgttttccacagggagcctgtggttctttatttggttcttctccctacaggagccccctctcatttatttttttaacgtctccctttcataaagtgtagctttctgaggttatccaatcctatctggtgaccgatccaggaaaagaggaaatgaagctggccctcctgtgtggcttggggagaacctaggtaagaatgacaggctgggtaatgaatggcagctctggttgcttgcaagggtgatcctggtcattgcatcacgagaaagtcagtctcacgggggtcttggtagccctcctttccagctgacagccctctgaggctctgcacgcagagtttttcatttctttgtacaccattgctttttcaggtagaagaaaacagagacgcttagtccctaaactgcatctcagtgatggaggggcacactcgggttcactgtggcttttgaacccacccatttgagggtttagaggctctgtttgatgacagatgaaataatattgattttaaaaccagctccacctctagaacatttcgacagagtgttttcaagccaaaccaaacaccagatgaagccctcttagttcaaggcaactttatttcaccagcagctgcttgttagctgtggatctgctgtggtgaacacacacaggggcgcctgtctttccccatcatgagacgggccccccatgctaaaagcagtcacatttaatacactcagggaaggggggcccaatttctaaacctgatgtctacaaatctgattaaacaaattaaaggggcatgtgcacattataagcaggttcttcatcttacaaaagcatccagtgcagagtccctctaaggtcctcctgcatagtctatttataaaaatccaatttcacaggaccttctccacagctgacaggcagaggccaaaagggagaataccagcttttctttggccccacaatggacccaactgaaaaaaatgttaaagtgtagcataggcaggtgctgtggctcacacctgtaatcccagcactttgggaggccaaggcgggaggatcacctgaaaccaggagttcgagaccagcctgggcgacacagtgagacctctgtctctattaaaattaaaaaaaaaattctttaaattaggccggcatggtggtgtgtacttgtagtcccagctattcaggagctgaggtgggaggatggcttgagcacaggagttagaagctgtagtgagccgtgactacagcactgcactctagcctgggcaacagagagatctgttgtacaaaaaatgtgtagctagcagaaaaaggtaagtcagattcactggaaaacatctgctcccaggaagctgcaggcaaatgtggcttattcaagactaaggtgaacagtttcctcctggacataaagtggcaaaaatggggtcaaatcatctctgatgggtcccttctggcattggaattgcatcatttttatgacgagcataccagtgatgctcatgtattaatcactgacattctctcagggtaaccttctcacaagcatacagtatgcattcttttttttttttttttttgagacaaggtctccctctgttgcccaggctgcagttcagtggcacgatcatagctcactgcagccttgacctcccaggctcaagcaatcctcctacctcagcctcctgagtagctgggactacaggtgcatgccaccatgcctggctaatttttgtattttttgtagagatggggtctcactatgtggctgaggctggtgtatgaactcctggcctcaagcaatcctcccacctcagcctctcaacatgctaggattacaggcatgaactaccacaccctgcctcaatatgtatctttatgtgtctacttgttaggatgttagggcatttttgtgatagatataaatactttccagaaggctaatacgcatacaataaagttaatttactcatttgcttcatcataggaaaacagctagacacattcagcaaatttagaagatatgtttgggacagcgtcatgtgaaatccaagttatgtggcatatatgaaatttgcatggcaggggcgtggtgggggcactctgcaagatgcctcaaagaatcagaagttgctgggtacggtggctcacgcctgtaaacccagcactttgggaggtcaaggcgggcggatcacctgaggtcaggagatgaccatcctggctaacacggtgaaaacctgtctccaataaaaacacaaaaaattagccgggcgtggtcgcgggcacctgtagtcccagctactcgggaggctgaggcaggagaatggcgtgaacccaggaggcggagcttgcagtgagccaagatcgcgctactgcactccagcctgggcaacagagcgaaactccgtcaaaaaaaacaaaaaaaaatcggaagttggttcagctctaggccagctgaaactcatataatgacacgtccacaagactggcaatttgggaaggacacgctgtccatactgagaagctgtggatgtagtcagttatcgtcttaaataagagtctcaaactgaaattcacaagggcaaaatgctgcaaattatgggagtgatctgcaacaatgctgcatctcacgtgggcagttccacgcaaactactctggggctgtggcagcagagatgcatttaagaacagtgagccaggtgcggtggctcatgtctgtaattccagcattctgtgaggctgaggagggaggaccacttgaggtcagttcgagaccagctggctaacatggcaaaaccctgtgtctactaaaaatacaaaaaaattagctgggtgtgatggcacaggcatggtggagcacacctgtcatcccagttacttgggaggctgaggcacgagaatcacttgaacccaggaggcagaggttgcagtgagccgagataccactgcaccccagcctgggcaacagagcaagactctgtctaaaaaattaaaaaaataaaattaaaacagtgagtgattcccttgacacatgccaggaaagccagccagcaaaatgataaatcagacaaaactaagcaattaagggtccctatggaagtttatgataccaatttaacccttgagatcaaagttatagacacctacagtgctctcccaaaagtgtttccccctagagagtattaaacatccatgttaaatgatgtcaacaactttccacatcttacttctaaaatttttagattcaatcccgtgaaaaaacgtttatcttcacaaactagaatcagggtaagtaaggtaggaccctattatagcacctcgaggtgaccaactaagttatagcacctcgaggatgaccaactaagttacagcaccttgagggtgaccaactaagttacagcacctcgagggtgaccaattaagttatagcacctcgagggtgaccaactaagttatagcacctcgagggtgaccaacaaagttatagcccagggctgaggggtttcccaggatgtgggacttttcagtgctaaaaccagaacagtcctgggcaaaccaggctggttggtcaccctaatttggaagaagacagattccaaagcataactacaagcattactacaaatttgaagggcccaatataatgcagtcggcctacagggtttgcctaccagaactgcacagggggatcttacttacatggggaaaataaaacccacaaaattgaatgtctctactggcttccctttgaatgttttgtattttacagatagagcctcagatcctgggcatcgatattccacatggatcctgtttgtacctcttgtattcacaccggggaaactgcaaagggaagactgctaagtaatgtaagggggcccgtgcctgcacaaattcttcctagcaggcacactgggggccttagcagcgtatgtgttgtgagcgagtaacactttgcatccgcaacggacttcatgcctttcagacaatctgccagaccagtcctaatggcaaccttttaaaaaaggatgacaagtccttctagcaggctgtcacatgttgccagattaaaacattgtgtaattatttacaggagacggtggggtgtcagatcatttggctggaaagaccatgtttccaaataaatttgagagatagctacagctgctctaaaacagagcaaaatatatggcaacaaaaggaagaagaacacattattgaggcaaatcatgcaattaagtatccactctttgtcatagggcattttggctgtccctgcttctccaggcaagcttttggaatattctgaataagagctggagagtcaaagaaagagaaaacaaagcccctttctatctcccatacttttccttcctgcaggaaaagggacacagtaccatgcagttgaacaccatgtcaagtgaggataaaggaaaacagccatgacatcactccattactgccacccccagtgtgcctcacaggccctgcaatttataatcttgtttaatcctccaagcaaccgaggaatacagatatcatcgcccctgctgtacagataaggaagcagaggctcattggggtccaggagcatgcctgtggacaaatagctcctaaatgacattgagttttaaacccaatctccaaaaagcctgtatgttttgagcgcctatgatgtgtcatcagacagtgaggcaggtacttgggatacaatcagataaatggcagagaacctatccaagaagcccacaagctggaagcgaatacaagaaacgccatcactcatagccatgacaattactgagtgcctgtcacatgcctggcattgttcccattcatgacttcagttcagcctcccaccagcccactgaccaaggcactattttccatgatgtcttcactttctgactttaaaacccagactcttcaccattagatcatgtgcctgagatcaatggcaagagatgaaagcctggccaaagcactgtgttaataaagtaggctgattatacagtttactacaagtagaaggaattgccacaaactggtacttctggagcagtgttcaggaagaaggcaggaactgcagctgaatctagtaataagacacgatgatgatgatgatgatgacagcaatgacaacagcaacaacaaaaatagaggctgggtgtggtggctcatgcttgtaattccagcactctgggaggcagaggcaggaggatcgcttgagcccaggagtctgagaccagtctgggcaacacggcaagaccccatccctacaaaaaattttaaaattagctggacatggtggcatgtatctgcagtcccagctactcagggggctagggtagcaggatcacttgagcccaagaagtagaggctacagtgaggtatgatcacaccactgcactccagcttgggcaacagacgaagactctgtctctaaaaaaaaaaaaaaaaaaaaaaagacaaaaaaaaagtgctagagaaccagatttaaagcagaagcagtccggaaatcacatgcaaaactgctcccagggagaaacgcaagcccaggcacagagccccgcttgatggcaggtgctggacaataacaatgctgggatccccgcctctgctgccactttcctcaccagcatggatcctgccctctcctttgtgtcactcactaaaggctcaaagtctggttcaaggtgagtctgagtactagggcctgggatacatgcctgtgtcctaactgcaaagaaagcagagaggccatcaggccatctagctttcatcatgcaggtggtttataccacaaagcaggtgaatatattcaaggggtgatacggtttgtctctgtgttctcacctaaatctcatctcaaattgtaacccccgtgtgtcaagggagggacctggtgggaagtgattggatcatggggtcggggggtggtgtggttaccccatgctgttctcatgacagtgcgtgagttctcacaagacctgatggtttaaaagtgttgggcagttgccccttgtgctctctctcctgacgccttgtgaaaaaggtgcttgcttctcctttgccttccatcttgactgtaagtttcctgaggctccccagccatgtggaactgtgagacaattaaacccgtatcaggtggtatccttatatcagtgtgaaaacagactaatactggggcaaactctccaaaagtcagaagggaataccaaagtactgggaggtcagaaaggacaaatggacaaccactgaaagctccttgttctgtcttttctaaatgaagtcatccttccaatggcagctgtgggttccacgtctgtggattcaactgctgattgaaaatattcagaaaaaaaattccgtgatgtttcaaaaagcagaacttgaacttgctgtgtgctgagtatgacgctgaatccgtaagaataaagtgatgtgtagcactgtattgggtacaggtaatctatagatgatttagagtatacaggagagtgtgcataggttatatgcaaataccacactattttatatcagggacctgaggactggtggatcttggtatccttgggagggtcctggaaccaatcctccatggataccaaaggatgatgataattgattgctaactttgcccttcacaggtagaaacaattttacgtgtctcagaaagaacaaagagtttaagatggtgatgctgagattctggacaagatggacatggtgatctctactggaatccggggactgctgtactacggtcatatactactgctgggggcctggtgttcccggggtgcactgggggccttgctgtactgatatggtcatatgctactgggggcctgctgttgctgaggtacattgtcagcaggcctaggcatcgaaaatgacacaactgtctcctgttcagaagcacttagaatctcctgcatcgtgtaacaagtgtttagagatccctagatcagggactctggggacagtttttaatttactgataagtaaagttttaaaatgtgacatctttgagtactgctgccctagtctattaaacaaagagaagcaattcccaggccaggatcatcctactaacccaaacctgataatgctgatgtggcccagggctggcaggatggcctggactgtaactaggcatcccctgcttccatttgcagacatgtggctttgccctgatggagacatagtgacagatcattttgtactacgtaggtacagatccaaagggcatcttaggctggctgtcattaagttccagtgaggaacacctgtcttcttcagttcctgtttctccagtttgcatgcagcctcagcccatcagaaggcagcggataagagttcccccttggatggctttaagttggcaaacaggggtagaaaagaggccaagctgcgtggtggcaggcacctgtaatcccagctacttgggaggccgaggcaggagaattgcttgaacccgggtggcggaggttgcagtgagccgagattgcgccaccgcactccagcctgggagacagagccagactctgtctcaaaaaaaaaaaaaaaaagaaaaagaaaaagaaaaaaaaagaaaagaaaagaggagaagttctgagtttctgagatgggctggaagcacatggtcactacccatcagctgggcggtgctgggcaagttgtttgacctgacagtttggtcatctgcaaaaagggataaaagtacaactatttcataataaaacagcaatctttgtggctctatactatgacgagtactattatttacattagtaacaagctcttctcaatttctagtagccgcttaggtttacccaatgataatgaatcaatcaggaaaaatggtgtccctgtgaagagactagttaaccagaaataaataaaagctatggataccagcaatggaactacactagtaaaatcgcttcctattttccaaaagtttgggcttaatcttcagacaacatgttctggataaaaaatgtgagccagggacagtggctcatagtataataccaacactttgggaggccgaggcgggcggatcacttgaaatcaggagttcgagaccagcttggccaacatggcaaaaccttacctctactaaaaatacaaaaagtagccgggcatggtggcacgtgcctgtaattccagctactcactcgggaggctgaggcatgagaatcacttgaacacatgaggtggaggttgcagtgagctgagattgcaccactgtactccagcctaggcagcaaagcaagactctgtctccaaaaaaaaaaaagtgaacaatgtcagcaccataggaaaggtaaattttttttttaaatgggaacaatggaaagaagagttacagtcttaaaataaacatatcctcggctaattgagaggacagcctggggtctgcccaagggcagggaactgggcctccctcttctgcttagtcccctgggacttaaatttccacattaaaaatactctctcatttatttttacttctttgtcgggggaagagggtaacgccacggagatggtgaattcaatttcttggaccactagggatattatttagtaatggaggtaaaaatatgatattgtactagttatgctgtatgtcagggcaagaatctaatttccactttccttaatgttatcatctgaataaagtgattcaaattaatcaacaatctgcttctaagaatttatctcatagtataataaaaagtagtagcagtagatagataaaatgtggtatatccatatggtagaatattattcaacaacagctacaacatggataaaccctgaaaacatcatggtaagtgaaagaagtcgatcccaaggcgccgcatactgtatatttcatttatatgaaatatccagaataggcaaatctacacacggacagtggattagtggctgcctagggctggagtcggaggtgaagggaaatagggaatgacagctaacagggacggagtttctttctgggttgataaaaatgttttgttttgttttgagacagtgttccactctgtcctccaggctggagtgcagtggcacaatatcagctaactgcaacctctgcctcctggactcaggcaatcctcccacctcagcctcccaagtggctgggactacaggtacacaccaccacacccagctaattaaaaaaaaaaaatttttgtagaaatgaagtcttgcgccgggcacggtggctcacgcctgtaatcccagcactttgggaggccaaggtgggtggatcacttgaagttgggagttcaagaccagcctggccaacatggtaaaaccccatctctattctaaaaaatacaaaaattagccgggtgtggtggtggatgcctgtaattccagctacttgggaggctgaggcaggagaattgcttaaacctgggaggcggagggtgcagtgagccgagatggtgccattgcactccagcctgggcaacaagagcaagactccaccttgaaaaaaaaaaaaaagaaatgaggtctcactatgttgcccaggctggtctcaaactcctgcgttcaggctatcctcccgaggcctgcctcagcctcccaaagtgctgggattacaggcatgagcccaccatggctcgccttggtaaaaatgttttaatactgattttggtgatcattacacaactcagcaaatacacaaaagaccaatgaatggaaatggatgagtggcatggtatggaattcaatctcaatagagtcattattaaaaatagaagtaatcgtagttattgggctgtattaaatgccagccaatattctaagcacttttatagattatttcatttaagtcttatgagaaacctatgatgcgagtaccattattatctgcattttacagataaggaaattcagctacagagagattagataacttgcccaaagctatttggccaggaaacaagagagccaggatctgaatttaagccatctgacatcacaggccagttctcaactgctgcccatgtacacaaacgtatggactccaggaggggccctgcagtgctggttctggcaggacttcggacacagtctgagcctcaaatactaaactggtgccaaagtaattgcagtttctgccattgaaagtaatggcaaaactgccattacttgagcaccaacctaatacaagctggtattttgtccactgaaaaaagtgaaacaaatctgcatatcctgctatggaaagaccaggacaacaacaaggtatttaaacattgtgtcttttttgctcccatttgcatttttttttttttttttacaaaaagctacacatgcaagtgtacccatacttgacaagtttccataatttttcatgaaaaagcattaactgtagctttctctgagaagcaggtcaatggtgacagggacattaaggttttttctggataccttttggtactgtttgattttaatttttttttttttcttttgagacagagtttcgctctgtcgcccaggccagagtgcagtggtgcgatctcagcttactgcaacctccacttcccaagttcaagcgattctcgtgcctcagcctcccaagtagctgcgataacatgcacatgccaccacacccagctaattcttgtattttttgtagagaggggtttcaccatgctggccaggctggtctcgaattcctgagctcaagtgatctgcccaccttggcctctcaaagtgctgagattacaggcgtgagccaccacacctggccaaatttttgaatttttttgtagagttggagttttgccatgttgcccaggctggtctcaaactcctgacctaagtgatccttctgcctcagcctcccaaagtgctgagattacaggcatgagccactgcgcctggcctgatttgaatttttaataaaccatgagcctggtgggagccacccagtcgtgctccagtttcaacggagccttctctaactcaaccacctcccaccctcttgggtatcacaggctcagagccaccattttgttttatttgtacctcttgatgcctcatgactctgcctgtctagcctgtaagtgtcctgaggacagacaccgtatttgtttcttgctaagcaggggcaaacacataggcagatcccctcggttcccatcagagaaacaaatgagtaaatgaattaaagtcaaacaacttgacctcacctgccagcctcaaggtcatgagcagtgactggtggaacagaagagtgtcacgctgtaaaccatgtctgtcatatgaactatgtccccgctagcactgggaacactgtgacctaagaagtctggagtggaactcaagtaaatgatttattcctttgattaaacacatttactttcatctagtcccagagaatttatggagccataatcccttccatctctaatgctgttcattatctcttcctaattaatgaaggtatgtaaattcattgatctaaaactttgcaggcataaacgttactcaggtagtgatccagccccacactgctaacagctcaagcttcatcacgttctaccagtttttaaattacacatgttatcagacaagattcatttaattttgcagctaacagctacagctgattatgctggctgctagatatttatagcaactcttgttgaatctgtactgttaacctgcttaggatataattaataaaagagatttaactgtctgacataataggcagctttgtatgatataaaatatgctttaatgtgctttcgggaaaaaaaacattaagaaaggtatattatccaagtgaaatttgttacattgctaccttgcagatcaatacaaaatttcttcacaagaatatttatggatgatgacagtggtatttcactcaaataatatataaagaaagaagggaatggtaaattttttctacaaaccaaataatacatattgaatagaacctaccatggctttccaataaactacttaggaactggggaaaaaccatacagaatttgaaacatgcaggtgactttctaaattctgggttcgcgaaatatatgtcctcacccgttctggcattcaaatgcgccattttccaacctctcattattttttttcattccacattctgatcacttgaccaattacctgataattgaacccctttgggatcatgctccttttcagtgcttcatttcgttgcagaaaataggcccatcaaggaggcaaaatgttctaactccaggaaatgagtgtttagagcaaaaacaatgaaaaagaagatgtaaataatccagtcagctaagcacaagctagaaagacactcgctttgtctatggcatgttgatttgccaggggattgtgcaaacttctgcagaaggcgttcattagctccagaaaaccccaaagggaggcagaggcgggtgcatcaccttaggtcaggagttcgagaccagcctggccaacatggtgaaaccccatctctacaaaaaaaatacaaatatatatatatatagagagagagagagagagagggagagagagagagagaaagagagagagagagagctgggtattgtattagtacatttttgtgctgctgataaagacatacctcagactgtgaaggaaaaggggtttaattggacttacagcttcacgtggctgggaggcagaaggcgtttcttacatgatggcagcaagagaaaaatgaggaagatgcaaaagcagaaacccctgataaaaccatcagatctcgtagtatgggggaaaccactcccataagtcaattatctcccactgggtccctcccacaacacatgggaattatggaagtacaattcaagatgagatgtgggtggggacacagagccaaaccatatcaggtgtggtggcgggcacctgtaatcccagctacttgggagactgaggcaggagaattgcttgaaccaggggggcgcaggttgcagtgagcagagatcacgccactgcactccagcctgggtgacggatcaagactccgtctcaaataaaaagaaaagcaaaaacagaaaactccaaggaagcacaggaggtaggctctaggactcttctgctcagagggctggtctggtgtctctgatcagactgccatagccgatttgcctaacggcctctacaatcatggtctgctatgagcgacagcattcccaggtgggagcagaacacaagagcattcagatcccaagtcattttggctccatggttgctcagaggtcctcatttttttttttgagtcatggagcctgtatcagtcatgtgctccagggaaccaataggagatacacagatatgtaagaggaggcttagtaagggaatgggttcacagggtcacaggggccaagaagtcacaccatctgccatatgtaagccgggggtttcattcagtctaaatccaaaggcctgagaatcagagaaactgatggtgttagtgctggtctgaatctaaaggtctgagaaccaggagtgccgatgtccaggggcaggagaaggtagacgtctcagctcaaacaggaggcaaattcatcttttctccatctttttgttctattcaaaccctcaatgcattggatgatgcctgcccaaaatagtgaaggcatatcttcttcattcagtcaccctcacgaacacacccagaaatcatgtcttctcagctatctgggcacctcctagcccagccaggcagacacgtaaactgaaccatcaccaggtccttgaaggatctgatgagagctgtggaccttctccccactgcagtccccagagcatcatcacgacctcaagcatctatgcaaacacactggactttgcagagctgacagggcccactggctggatgaagcccatccatggagctcacacccaggtaaagaaacctacgccgagaaattgccctactggggtgcagtggctcatgcctgtaatcccagcacttgggaggctgaggcaggcggatcatctgaggtcaggagtttgagaccagcctggccagcatggtgaaactccatctctactaaaatataaaaattagctgggtgtgggggtgggcacctgtagtcccagttacttgggagggtgaggcgagagaatcacttgaacccaggaggaaggttgcagtgagcagagatcgcgccactgcactccagcctgagcgacaaattgggactctgactcaaaaaacaaaaaacaaaaaaacccctgccctattggacactgtatgacttagtgccccagaaggaaagtttcataaaaattttctttaaagataagattttccaggaaaagctgaattcctcttagatacggataagatgttgtttctttgacaacctctctctggctgaaccttcaactgaattctatcaaccaaaaggactcttaagacctttctgtttcgccctgcggttttgtcttcctatatgaacttttattttctttggtcctgacatatttcttctctactgtgtgcttttgctcattttaagccttctcaaatgcttcactgaacaaataaataaggcgaggctctctgttttcactttttgatctaaacactggaacccagacggaaagattatgctttttatttttaacctaatcaaaaggcaactgttaactagtccctattattgagctcttgctacttcttttcattgaataatcaaatatccacacttttctagctacgattaagacttctggcctttaattaaaggtacagtttcaccattgagtttatattttggtcaattaaaatagccacatgttgaccatgaaaaggtacctccaaaaagtcaaagaacaagagtatgtgcgtatgtacacacaggtgtgggctcttattctggggccatggggatctggggttcatcctgtgaacttcgatgggaggaaaccagttttttcatgaacttctgatatttagcatttccttctattatgaagttagtagaaattacagaggtattaacaacccccttgaatttcacaccaacagagatcacatggattttttttcccatcacatcacacttgttgcagattaattcagggtatggtttaaactcactgccattttttctttttctttttttttttttttgagacggagtttcactcttgttgcccaggctgcagtgcagtggcacgatctcggctcactgcaacctccacctcctgggttcaagcgattctcctgcctcagactcccaagtagctgggattacaggcacatgcccccacacctggctaattttgtatttttagtagagacggggttttaccatgttggtcaggttggtcttgaactcctgacctcaagtgatccacccgcctcagcctccctaagtgctctgattacaggtatgagccactgtgcctggccttaaactcaactgctattttgaaactatgacagttattagctctgctattagactgtgttatataatagaccaacacatgaattattactatatccaataatttaaaaaatattttgataaccgtatttcaatagaattggtttcctcgaaaatcctaggaactttattttgtgtatttagaaatattattctgagatgggatccaggggcttcagcaacttgatgaaggaatccgaggcacaaaatgggttaagacgccgagacttggaataaaggactgacagcagccagtgtgtctcctctgccggactgccacgtagaaaatgctggcaggggtggaagggcgatcacacacctaatcagaaacaactttttaagtaatattcccagttccctaattagtcatataaggtaaattagttccaaccacttttaatcagcctcagcagaagggcggcattgtcactgattgcctggatgatttcaccgggctcatactggatgtgaaggagtgcaggagccagggggcttggctgattgctcccaggttactgctcagcattcgacccacacgcgacctgctggaaaatctgagcacagacagccccggcccattccagaggctggtgatatttcaactatggcatcactctcttgcacgcatagaactccctttttatgtttctctgtgttaaactgtagggtaaattgtctttaaatcctggcatttcttggagcctggtgtagacacttaaacataacaacgcaaggctaatgacacagctgcggaaataaacgtgatttaactgagcctctttaaaaacaaaaccaaacaaaacaaacagatcctactttaatatgaacaaaacggtttctgttcaatggaaatgttctgagtatctatgacatggtaggcggtgcaggaacttattgcttacatgaaagggatggaggctgttggctacaaataagagatagcatggaagaaaagtcctggtcagtccctgtccctgagagatgttccccagagaactgctaagagaacggcctggtgtgctctcagtgcaaatggcgctgaggcagattctaaacccaggcaaccctcttggacttcaagcctaaagaaatacttacctgactgtacaacagcacgtctgaggatgctcacagcagcactgttcaaattaactcccacctggcgttactgcaagattaaccaattatgaaatccccatccacagaacgcaatgcagttattaaaagcctcacatgtatgtacaaatgtaaggttttctagacagatggaaggagaaaaagtaaatcacacaacaatgtgcacagtatgatcacgtttgtatttaagaaaagcatgctgaccagggcgtggtggctcacacctgtaatcccagcattttgggaggccaagatgggtggatcacctgaggtcaggagtttgagaccagcctggccaacataacaaaactctctctactaaaaatacaaaaatcagccggtgtggtggcacacacacctgtagtcccagctactcgggagactgaggcaggagaatcgcttgaacccgggaggcagaggttgcagtgagccgagatcgcgccattgcactccagcctgggtgacagagtgaggctatatcaaggaaaggaaagggagggcagaaggaaaggaaagggagagaaggaaaggaaaggaaaggaaaggaagggggaggggcggggcggggctgggaaagggtgagcatgctgacattgatgcacacttttgaccacagtgaccccgagggaagcacttagggggtggtcaaagtttattttaaatatagattttaaatttacaaggagaatgtctctacatattacttgtagaatttaaaaatctaataaagtaacaataaaaagatccgtatctaccctcatttaaatcctacaggagactaggatgacaacaacaaaaaacacggagaacttcatgtttcaatatatctacatgtatctatattccttatttctaagtgaagcacagatttctgtctgtttcattcactaacacagcacaaacatctagaatagtgcctggtgcaaagtagactctcaatacagatttgttaaataaatgaattgactatttattcatgtgttccagaaaactgtactgggtgcctaccatgtgctggcttcttgctaaagatcacgggaaacaaactgtgaatcatttaaccagcattcactgaataccttccacgtgccttgcactgggcactaaatgaaagtacacaccaatacggacacacagacacacacacccccactgccctttaggaacttggaactaagcttgggagaaggcgaactagcagaggttggagcaatgagataaggccttttcctggccagagcctcaatcctggctttggttttcaaaattatgcctccgaggctttgcttattatggcctgtcttgtaccagaattatgttcatgggtttgtgtctgcccagctggaggaaaatgagtatcaaccttcctggattgtggaaccacagaaaaacaaagggctttattctttgcctgaagcccagcaaaccaaagcattctttgttcaatggctttatttcccaattctatacattcattacagaattagaaacctcccagtgggggtcaggcatggtggctcatgtatgtaatcccagaactttgggaggccaaggcaggtgcatcacctgaggtcaggagtttgagaccagcctggccaacatgcagaaaccttgtctctactaaaaatacaaaaattagctgggcttggtggtgcatgcctgtaatcccagctacttgggaggctgaggcaggagaattgcttgaacccgggaggcggaggttgcagtgagctgagatcgtaccgctgcactccagcctgggcaacagaacaagactctgtctgaaaaacaaaacaaaacaaaacaaaaaaaaacaaaattcctagtgaggaaggagtgttgatggtcatttggccatggctactgttatcaggaccttggtctaggccttgacatctaattgaaggtgaacagctaccaaactagatgaattagaagttttcaggtctcactggggcattttcctgatagaaaagcctaactcctttcatcagtaattctactttacttccccatagcatctcccattcttagacgcactctactgatttgcttcctctcctctccagacttttgcagccatatctgcacaaatccagcccttctttaccttgaagttcagacttttctacctaagtggattattctgctttatctatagcaaatatcacttttgtgcatgctccctctcctccatttgttggaatcatttctaaattcaattccattttcatattgagtctctttggtcccaatagaaatggtccccaaaattcaaatatcagatgtctgggacccttttaacttctgaaaatgcagttactgggcaatggatgtgcgaaagttaactcggggaatgacattaaatcagaaaagccttctgtttttagtgatgaaaagcttcttcatctataaatcccaaagtatcaactttgcagatccataagctcttatcccaaaccccctaggccagatctcatttgaaattccaagtttttctaactttagaatggtaagacaggtcatagaacacatattaaacaatacttcaagctgggactcgggcagtgccctgtaatgaaatccagtaatattttgttagcaaaacatatgaatatgctcactaaatattgggatcaataaagaccataaacagccctttgtcacttggaaggcagttttgccaccagcttagtttcaaacttaagaaaaaactcttagttttcagagctttctgaacttttgagatggtaggtaaggggttatgtacaagtgcaagacccaaacgaaagaagccattgtagctctcttaagcattctgcataaagacccttttaaagtatatatgtgtggccgttttcctgaacatcaaagggctattttggaagtcctgtaagaagaggtcatcctgcgttattcagtgttgtgtaaaaagcaaagcaaaacctacaaacttaaagcatttccctttaaatgctgagcatgtgtaagtctaaaggaataatggttctcctgatatacaccattatcagttaaaaggaatgttcacaaaccacttgcatacacacaagattacatttaatacattaaaaagtggccccgactcggcgtggtggctcatgcctgataagtccaacactttgggaggacgaggcaagcagatcacttccagccaggagttcaagaccagcctaggcaacatggtgaaaccccgtctctactaaacatactaaaattagccgggcatggtggtgcacacctgtaactccagctgctcgaggctgaggcatgagaattgcttgaacccgggaggtggaggctgcagtgagccgagatcatgacactgtacccagcctgggcgacagagtgaggctgtgcctcaaaaaataataaaaatacataaaaatacacaaataaataataaaataaaaagtgtctgtctcagccacccacgtgaacaatctgtggtgatttggcatcaccgcgattcctgactctcaatttacatgctaccagtaaacaatcattttgttacacctattcacacctaagtacttaacagtaaaaaatatgacacaccattaacacgggagaaaacagtgtgcccagggaaactaagcagcacagtggcatcactggaatacctgcctcagctgttcagcagcaacagatgacagcaggcttccagtctccacccacaatgctgcgttctgactcaaaggctcctgtgcactgtattttattttttcaggtgagaagaaacatcagaagcagttgagggaccagaaagtgagtccgccagggatgaggaggcattctgctagatggctttttaaaaatgttccctccaagctgggttcagtgactcaacacctataatcccagcactttgggaggcgaggagggcaatcacttgaggtcaggagttcaaccagcctggccaacaagatgaaaccccatctctactaaaattacaaaaattagccaggtgtggtggcaggcgcctgtaatcccagctactcaggagactgaggcaggagaatcacttgaacccgggaggcagaggttgcagtgagccgagatcatgccactgcactccagcctgggggacagagtgagactgtctcaaaaaaaaaaaaagttccctccagagtcatctgccttattaacaagggcttttgtcttagaaatctcttttattaactgacacaatttcttgatctgttatgaatgcatgctgttctagtccttcaaaagctcaccacacattgctatggtttaaatatttgtgtcctccaaaactcatgttgaaacgtaatccccagtgtggcagttctgagaggtggggcttttaagaggtggctggatcgtgagggccatgccctcatgaatggatgagtccattcatggattaatgaatgaatgagttagtggattaatgggttatcatgagagtgggacagggtgcttttttgtgtgttttttgtttgtttgtttgtttgagacagggtcttgctctgtcacccaggctggagtgcagtggcatgatcacggctcactgaagcttggactcccaggttcaagcaatcctctcgcctcagcctcccaagtagctgggtctacaggtgtgcaccaccatgcctggataattttctattttttgtatagacggggtttcactatgttgtccaggctagtctccaactcctgagctcaagcaatccacttgccttggcctcccaaagtgctgggattatagatgtgggtcactgccctgggctggtggctttttaagaagagcagagacccgagttagcacactcagccccctccccatgtgatgttctgtgccactttgagagtctgcagagagagtccccaccagcaagaaggccctcagctgatgtagccccttgaccttggacttctcagcctccataactgaaagaaataaatttcatttcttataaacgacccagttccagatattccattataagcaacagaaaacagactaagacacacattttcaccatgtcatctatgggtacttttcctgcagcactgccatcatcctcatcatcactactataggttgagtatctcttatgcaaaatgcttgggaccaaaggtgtagagttttccactatggtgtcatgtcagtgctcaaaaagtttcacattttgaagcatactggattttcagattagggatgctcaatctatcagtgcttcttgaacctcattgtccatacagttcatctgggaatcttgttaaaattctgattcagatccattaggtctgggcagggcagagattctacatctctaacagctccatctgctgctctgggcaccaccttctgtctgaccagccaggctgcaaaacgaagcgcacaaggtttggaaacagatgaacaagagttcccagtttacaagctgagtggccttgggaaaagcaattcactgctctgagccagtttccccatcaattaaaatggaaatagcaatgacacctcctttgcaagactgtaatgagtagataagatagtaacacagttcctggcagataacagaccctgaattccagtccctgccatctgcagtaggctgaacaatgtccctccagagatgttcgacatcctaactcctggaacttacaaatatgctaccttatatggcaaaaggggaatctgcagatgggattatgttaaggatcttgagatggaaacattatcctgggttatctggatggacctaatataatcaccaggatctttacaagaggaaagcaggagaatcagagtaacagaatatgagagggtggagcagaggtcagacgggagaaaaggtgcaatgctgctggctttgaaggcagaagaaggagcatgagccaagaaacgcagttggcctctagaagctggaacccctagaaggaacacaccgctgcaggttcttgttggacttctgacccctgggatggtaagagaactgtttgattccactaagttggtggtaatttgtgatagcaggaacaggaaactaacataccatcctttggaataatactgatatggttttgctgtggtctcactcaaatctcaacttgaattgtagctcccacaattcccacatgttgtggaagggacctggtgggaggtaactgaactgggggggttctttctcatgctgttgtcgtgactgtgaataagtctcacgagatctgatggttttgtaaagaggagtttccctgcacaagttctcttctctcttgtctgctgccatataagatgtgcctttcagctgggcgtggtggctcacgcctgtaatcacagcactttgggaggctgaggcaggtggatcacgaggtcaggagatcgagaccagcctggccaacatggtgaaatcccgtctctaccaaaaatacaaaaattagccgggtgtggtggtgtgtgcctgtagtcccagctactcaggaagctgaggcaggagaatcgcttgaacccaggaggcggaggttgcaatgagccaagatcatgccactgcactccagcctgggcaacagagtgagactccatctcaaaaaaaaagatgtgcctttcgccatctgccatgattgtgaggtctctccagccacgtggaactgtgaggcaattattctttttgcttataaattactcagtctgaaatttgtctttatcagcagcatgaaaacagactaatacaaatactaaagcaggcttgcctccctttacagaacagaggacttcccagggctacatcatcaactgaaactaagtcacagaatagttgcccaagtgcagctgaatacatgaagaactcttcaaggaaactttatatcaagggaagaattattcctgtattaactgtttttgtgtggttatgccaatttttaataaacagggatgaatgtatatgttagtaacaaactgttctaaaggctcaaaggaatctcttgcaccctaaaggtatcatcatgttctgatttgtcagcttcacacgtaattgctgaaatctaacaaggcttctggggacaaaaccagtgggtcgatacctcagcatcaggaggactgacaagagtaaccctaaattaagagtgaaggatgaaaatcaatgggtctcagtatttgcacaaatgttcacttgctacttacaatgtggcttaccccatagaggagctttataatagaataaaataccaagataacccaaaagatgcctgcaaaacaaaaatgtgtttcaaaactaaatggactttgtgtgaaacaaagaagcctgtaactcttaaggattttcctatgggcttggcaccaaggactcctcttcccatcacatttttgtgcttctctgccaagactctagttccacagaaagacctggtctcttgtctccaatattacatccatagcatctaacactgtaattggcacttagtttgcacacagacatttttgtggatgataagtactataatagatatttataagaaaaagcatattattactttcattaaaaaaaaaatgaaagttctttttttctattttcttttttttttttttttctttttttgagatgaagtcttgctctgtcactcaggctggaatgcagtggtgtagtcttggctcactggattctccaccgcctgggttcaagcaattctccttcctcaatctcccaagtagctgagatgacaggcccacgccaccatgctgagctaatttctgtatttttagtagtgatggggtttcaccatgttggccaggctggtctcgaactcctgacctcaagtgatccacccacctcggcctcccaaagtgctgggattacaggtgtgagccaccatgcctggcctttctccattttcaacttaaatccacttggcccaagatattttcttttcttttttctttctttctttctttttttttttttttttgagatggagtctcgctctgctgcccaggctggagtgctgtggtgcaatcttgctcattgcaacctccacctcctgggttcaagcgattctcctgcctcagccccccagagtagctgggatcacaggtgtacaccaccatgcccggctaatttttgtattttagtagagacggggtttcaccatgttggccaggctggtcttgaattcctgacctcaggtgatccgcccaccttggcgtcccaaagtactgggattgcaggtgtcagccactgtgcctggccagggccaagatactatttatggtagaactaaaagtatgctttctgattttatttgcctattaatatatgcatttgataatgaagaatgtgctaagtagtcaaagcaaataattactttctagtgtctaaccctgtctatgagctaaatgagagggaaaccacttattgcatattaaaaaatggtaactagttttaaaatgctctgtttaatctcaaaccacaatattcaaaacagttacattcctttcactggttcaattaaaaccccagaaaacagtccaagtctccagaacaaattatacattctgcttgagttgcactgcatgtaaaattcacgttcaaaagtttgccaagtcacatttatgaagtcttgaccaactggcggggctgatcataaaaactatatcttttaatttatagtgtttaatgtatattcagtgtatcttatttaaaaagcaacataattgcatgaaaaacttttattttaaatctgattttgaaatatgactgaatacatcaacagaattcagaacaagttggtaaacatctacgagaacatgttatataattccagtgagccctataacattctgtttttaaagagaagaaaccactgaacagaaaaatttgaaatcttcttttcttcttcttttttcttagagacaggggctctctctgttgtctggaggctggagtgcagtggtacgatcatggctcactgtagcctcaaactcctggactcaagtgatcctcccactttagcctcctcagtagctgggactacaggcatgcaccaccacgcctggctaattttttttttttcttttttgagactaagcttcccgctctatcacccagtctggagtgcagtggcgcgatctcagctcactgcaatctctgcctcccgagttcaagcgattctcctgccttagcctcccaagtagctggggttacaggtgcctgccaccacacccggctaatttttatattttttagtagagacagaatttcaccatgttggccaggctggtcttgaattcctgacctcaagtgatccacctgtcccggcctcccaaagcacataagccaccgcgcccggccattctcatgttttcattatgggttttgttctagataagtgggctgccagaaaaaagagccaccatgaggaggaactgatacactcaggcttactacagggtacctcggcttctaaaggagttagacatcatcacagaactcagagcctcggtttacaaggtacaactagccccagacagacacccacacccactgctgtgttttctgcaatggtctaaggtcccctgcctccctgagggacaggagcactctccgtttgcttatacctgcttgctgggctttatctttgcctgggagaaaaggacatcagagtaggcaaaataaataggaagagagttctagaaggtgtctgtcatcgttgaatttccaacatctcacttttttcgggggagactgtcctgttctttagggcacgtggttgcagtggagctgaccccacactctggtggaagggggccatgtgagccagaggggtatgagcctgggactttgttttttgtttgtttgtgttttgtttttttgagatggagtctcactccttcacccaggctggagtgcagtggcacaatctcagctcactgcaacctccgcctcctgggttcaagcaagtttcatgcctcagcctcctgagtaactgggactacatgcaccaccacgtctggctaatttttgtatttttagtagagacggggtttcaccatgatgaccaggctagtctcgaacacctgagctcaagtgatccgcccacctcagcctcccaaagtgctgggattacaggcatgagccactgcacccggccagcctgggactttggaccatccagaataaggcactttctttctgttctggtttctgacaaaaggatacaaatgtagacctcccaggagccactatctagagagagcctgaacgtaaatgaggtcaacccagagaaaggcagatcagagtgatggagagaccaagtccttataaccaagctgaccccctagatccagctgtacctgcaacccaggtctgctcccagactttacagtcctattaggcaacacataccttaaaaaaaaaaaaaaaagggaatcctgttttaagttggatttctgtcacttgcaacaaaaaagcaccaacaaataagggagaaataaaagtgtaagaagaaaggaaatgaggagagaagattatatttatggatatagtgtctggaagcagttcaagtttgtccctggaaatgcagaaaggtgatgtgtgggaatctgttccatttttcatattaagctcaaatcatcagaactgtagctgtgcctaattactgtgattaatctcgccaaactctaaatataacatgagtgtgcactttctgatgttcaatgatactgcaacaatcatgaagcgaaagaacggtccatgactgagcaaagatgccttcgaagcaaaatctttttttctcctgcccaaatgcagtcatgaccggctgaaggagaaaaggtcacaagcgatgacccgagtcttacctggcatggcgtggatgaggtcgccgcacagaacgaagaatttgggtttggggttcagcttgttgatggcctggacggcttgctcagttagacggatctcctgttcccattcgtcaccgccattgtcacagtccccagtggaccaggccttgatcagcccaaactgtgggtctgcgcccaggatgaagtagaatgggcctttccattcgctttccttttcttaaaaaaagagagagggagaaagaaggagaaatcttgtaaaatctgtcataaaagcaaccagcttcccatgcaaagtggatacactatttttcttaaattaagtaggtcattttaataagctgtggttcaaacataccattttcctgtcatagtctagaggattttgatttatactaattatgcctgggacctggtgatacccaaaggccagaactgtccacgtgggcttctgcagccacaccaccaagctgtttgctgacaagctagacagccaaaaggaagcacgggccacaagagaacccaatgcagaagatattcgtgctccataatcgtctttaaattagaataaaactccccaaattgaatgctgccagaagtattatatttaaattactaggtgaagtgcttacacatcttttctgtgaggcttcgtggcaccatttccaccgtttcgggggatgtgacagaattttaattataaaacttggcgcttggaagctctggctatctggtgggaggtgtggtgccagaaatgaaatctcggaatgagtaagtcaatgtgggagaaaaaaaaaagaaaaaagaaaaatcgatgctaacatttcaaaggcagtaggatgtgggcatccgtgaggtgtgaggctgggggtggggactcttttatgttcttggaaagggatctaggccacctgaaatcattctgcttgctcttccgactgactctcctgggccaaagctttgtgggtcttagggtttctactcttatctgccagaactgccgcgccagtgcctgcttgggcagagctggaatggccattaatgggcacagaagtgctgtgggtttcactttttaaaaaattatttggccacagaatcctttccataatcaaaatcgtacatgacagaccaatgttgaaaaaacattccaagcaaagaagcttgctcttacagaatagcatctggaacttccaatgccagagccagatctggggctggacacggcacagtctgaggacccccgatctacagccccctcatttatcctctgaagaaactgaggcccggagaggcaagagaacttgctaaatggcctgctagcgcttagtggtgggacagagctgctccatcaccttgaggctgttttttttttttttttcataatttaatgtatggccaggtacagtggttcatgcctataatcccaacactttgggaggccaacatggacgaatcacctgaggtcaagggtctgagaccagcctgggcaacatagtgaaaccccatctctatcaaaaatataaaaattagccaggcgtggtggctaattacaggtgggcacctgtaatcccagctacttgggaggctgaggcacaagaatcgcttgaacccggaaggcggaggttgcagtgagccaagatcacgtcactgcactccagcctgggtgacagaatgagactctatctcaataataataataataatttaatggacaatgcatgttaactgaataaatggcatttcctttggaagtcatgatgatgctgtaatttccaaaaagctccttggaatcagttcacgtccatgtgtttgattcatttgtctattgagtatcatactgggagcctttgctttgccaggccctgtgagaggtgctggcaatatgagggtgaccaagacagatgagtccctgctgtcctcgcactcagtgctcgttgggggagatgagcaagtaaacaagcagggaatagaatcagagagtattaatgactatgcagattaagagtgaggcaacggctagtttaaattagacagacagggccaggcgccacgcctgtgattccagcagtttgggaggccaaggcgggcagattacttgaggtcatgaatttgagaacatcctggccaacatggtgaaacctcatctctactaaaaatacaaaaaattagctggatgtggtggtgcatccctatagtctcagctacttgggaggctgaggtgagaggaatactttaacctgggaggcggaaactacagtgagccgaaatcatgccactgcactccagcctgggtgagagattctgtctcaaaactaaataaataaattaaataaataaataaataaataaataagataggaaaggcctctctgaagtggtgacatttaagctgagatctaaatggcaagtaagggccagtgataacctttttaaattccatggccactttcccacccatcacactgagctcactatcaccttagaatggactctggtttcaagcctcctttcccttcttaattcctttttcagagttaaagaaaaaaaaagtgaacaaaaatacctctgcacacgttacagaacaaattgtacatgtacataaacccaacagtcctcaacttacagcacagtgttcaattacaatgggccagaagtcaatctgaacaaaggctgcatgaaaccctggtgtgtgcatctcatggagaaagacagcaatatggcacatccagcagggactgagggagtccactgtcattcactgagcactgactgtgttggcagaaagactctaagatgccccccaaatccctgcctcctgatattcacatccctgtgcaacaccctccctttgagtgtgggctgcaacttgcttctaataaacagaatatgatgatggcagtcccttccaagagtgggctaaaagaagaccatgactttcatctctttctctttctcagagcccttgctctggagattaaaaactgtcatgttgtgaatatccctacagagaggccaatgtgctgaggaacagagggaaacctctggccaaaagcccatgagaaaccaatcctgccaacaaccatgtgagtcagcttggaagaggacactcctctgttgagctttcagatgacaccacagccccaacagataccttgactgaagccttataagactctgtggcagatgaactcaactaagctgtacccagattcctcacaaaatcctgtgacatgatacatatttgctttttaagctgtgaaacttcagggtaatttgttacacagtaacagatccctacaaatgaggcattagggataaatggtcaagaagtagacaacaagatttcctgaagatctgaccattttgtcatgaaaaaaaaaaaaaactgagactctgctttgtgtctttatgttattaatcatttattttacttgcataataaccttttttacaccaatgaatgcttctagctgtgtttctacttttgaggctgtttgcagagccatttaagctggatgaattaatcagaaccagataagggaggtgaacacaggcaccccaaagtagcagcataaatcaaccttctacaacagagtttatgaacagctccctatagcaaacattttaacaaatcgtttcctatgacgaatagtcagaatttcaaaaagtcaatagtccttgaagctattaaaacaaatctttcattattacttgtttacttactaaaaacttagaatctcaattttatgtgacaaagtacaaaataaacagatttgacctaaaataaacgacagctcacatatcagtattcaatctaccttacttatctaatgaggtaatttgtttactcaggaatcttcattctccaaaggaactggatgctcttaaggttcctgctacagaagctggtggtctttggtctcatcgtaatttctttttatcaagactgaattaaagatatttggagcttacaatgcttaattctagaaggaggaatctcttttaaatgtatacctctccatcccttaaaagggcagctttttacattatgaaagtgaattgtgtttttttaatttatttttacagatggggtctggctttgtcaccaaagctagagtacagtggcacagtcatggctccctgcagccttgttctcccatgctcaagcgatcctcctgcctcagcctcccaaagtgctgggattacaggcatgagccaccacacccagacaaacgtgaattctttttttttttttttttttgagacaaagtttccctctgtcacctaggctccagtgcaatgctgcaatctctgcttactgcaatctctgcctcccaagctcaagtgattctcatgcctcagcctcccgagtagctgcgattacaggcatgcagcaccacacctgattaatttttgtagttttagtagagacggggtttcgccatgttggccaggctggtctcaagctcctggcctcaaatgatctgcccgccttggccttggactcccaaagtactgggattataggcatgagccaccacactcagatgaaagtgacctcttaacaatacttgcattaaaattatttcaccaaagcccagagttacccccagggtacagtccccaggcacagtccagcttttctggaaaccctctggaagcactcttttagcaacttgagccatggaagtatggataaactgaggtccactcctgaagcactctgagtatgacagtatttgtcattactggaaaaaaaaaaaaaaccaaaagacactcaggggtccagttttttccccctacctttcctagcttaaatatgagattactcggtcaaacagtacatgcctgacaatgctaattaacgaggagaactagcctggcaatgagcctgatgaagagggacaaggtgagggttacctgacagcagaaagcagcaggttgctcatggcacagagatggcagggctgggccacagccttattcctccaggtgtgacatcagcgtcgcctgggagcacattcacaatgcagaatctctggccccagcccagatccactgggtgaggatctgcattttactgaaccccggggtgacctatgcgcacatccaaatttgggaagcaccagcctacatacaactaaccaaggaactcgagtggcctgcaacttacatgggttggaggagaaacagaagcacagtgactttcgtttccttaaactaacacttcagaggggctttgttcaggttgttagtggtggtatattttttattttgttttggtttggttttgcatacttctctggtcattgttaggtctctgcctatgtacaggtcatggatttggccctaaatatttcttatttctctgtattattcattactatctagtcatcaccctttacattgccttgcaaaactaagtgtcaagattctttgaaaagtaagaagttgggttgggcatggtggctcacacctgtaatcccagcactttgggaggccgaggcgggtggatcacgaggtcaaaagatcaagaccatcctggccaacatggtgaaacctcgtctctactaaaaacacaaaaattagtcaggcatggtggcatgcgcctgtagtcccagctactcaggaggccggagaatctcttgaactgggaggtggaggttgcagtgagccgagatcgtgccactgcactccagcctgggtgacagagagagactccatctcaaaagtaagaagttaatcagggaatccattactaattagtatgttctaatttattactacatgacttcatggaaaaagcacccattaccaagtatgagtatatagcacacatgtatgtgtacacccatacgtacacacacacatacatacacgttttccagtgcacaacagagaagtctgtatttttcttcccaaattgacttaaaaaaattaacccagtcaggggccctaactgatgactatgatgaaaaccaaggtcaaattttgagacaaatatgtgtggaaggaataaaagaaaaaagaattgattaagatctcatttctgacccagatgatatcaaaacaagactataaactttggaaacaactcatacaaagctctggataatgcctatagggtatttagtgttcatacgtggtaaaaacatacatttatttaattaaaacacctatatctgttatgaataagaatatccagaatgaatttttctttcttttttttttttttttttgagatggagtctcactctgtcactcagactgcagtgcggtggcgtggtctcagctcactgcaacctctgcgtctcggttcaagtgattctcccaccttagcctcctgagcagctgggattatacaggcatgtgccaccacacctggctcatttttgtatttttagtagagatggggtttcactatgttggccaggctggttttgaactcctgacctcgtgatctgcccgtctcagcctcccaaagtgctgagattacaggcatgagccaccacacctggccagcgaatttaactttttcaacgttaattttttgacagattcatagagaagttaatttagctgtctactgctgtgtaacaaactaccacaaatgtatcagcttcaaacaacccacatttattatcttatagcctctgtgggagtctggcatggtttagctggtcctctgcaaggtctctcacaagctgcaacagaagtgttggtcaatgctgaggtctcatctgaagactcacatggggcaggatccgtttccaagctcacttacatagtggttagtaggattcagctccttgtaggttgtaggactgatggcttcagttcctcactggctgctgcctggaggatgccttcagttccttgccatatgggcctctccaatatggcagcttgcaatatggagacttgcctcatcgaaccacacaaggcagagggtctgctagcaaatggaagctacaatcttatataacatcatgatggaattaacaccccatcacttttgctgtgttctgctcattacaatcaagttaccagggcagcccaccttaagggcaggggatcacacaaagcatgaacacctggaggtgaaatcactgggctcagctgagagtcagccatggatggtaatataaacctgagggctagtctcacatacttaacttatctcagttaatgtcacatttgtacctgaccttccagtactgcactcaataaggccatttattgtagctcatcctggtgagatcagaaggcttaactcacagaagcccgccttttcctacctaagtactagaaattgtcagtgctggaaggactctcagagttactgtaaccagcctttcattaaaccaagggggagatgctgaggtctgggtagtgagggggaagggagatggggcttaggcatgcctcaagttcaaggtcacacaataaagacccagcaacttctacccaagagctattcagaacctcagtgctgctgggctggatggcctggagtggtgagagccatgatgaagacagaacatgctctgggcttccctcaagttatccacctcaatactgacatcttctctccaaaaagtttccttcaaatggaacgtcttgataaatgggctgtacacaaagacaatgatggcaagacccagagcttttccctggtcggccgtgatgttcagggtccctgccaatagcacagggttgatttgaggcacaggcggggacccagacatctgtctcctgtgagtgctcagtggtgatctcttccagagattacaaactcgacgtctgtggatgaggtctgcttagcagatgtgtgctgttgggcccaggcagcgtttataaacttctgaatttgttgccaacctttttaattcatgagtttcataaatatacctggctttctggattctcttggaaaatctggccacatcagacccaaatgaagcatgctagtgactctctgggtctgtacagtggttgtgccttcacatggggtttgtgctctcaaatttgccacagtccccacctggcccaatttaccacctggctgctgttggcatctgcaatgacaaacccttatctatggtaatctttccattttgcttagaggtgaggaagaggagacccagcaaaggaaaatacattgactgaaatctacaaaggctaaggggcaaaccaggcccccacctttgcaaattctgccacagacatcactcgcccacatttcaggacagctgaaattactatagagaagacatatccaagccaggaatgcctaggtctagccaaacaacaagccaggaaaaaagaaaaataagctaatgagttaccataattttttttaatggggtctcactctgtcacccaggttggagtgcagtggcatgaccttggttcactgcaacttccacttcccgggctcaagtgatcctcccacgtcagcctctggagtcgacgggagcacaggtgcgcgacaccatgcctggttaattttttgtatttttggtagagacggggttttaccatgttgcccaggctggtctagaactcctgagctcgagtgatcagctcaccttgacctcccaaggtgctaggattacagccatgagccactgcatccagcctggttgccataattttctaaatcgaattataaaattaactttgaaacacttttaaatgaaaaattgaccttagaaatcagagtcacctgttgtatagagaataacaagatctggccacttccacatttcggctaacttataaaagactgtcacagaaaccatatttcaaaactgagggataaatacacagtgaattttgggtaatatcaagctaaggacagaaaggcctgtaggttttctttaaacattatcaggtgcaaagcaattgcactcagagaagaatcttaaaaacctggaagaattcacgcaatgctttaccattaatctttcctatgagcctctgtttatgtgccaatatcctgcctgaaagacagatattcaaattgcaattgctctttaccgctgaacttttaaaatcacaaactaaatgttttcttggatttgtctctgctaatacatttcctctctcatttttattatcccttttaggcatatttgtcaatgttaatgaaagctgactttttaatatataccaagaattagaaattttattgattttttcactattaccagttaagcaatgactaactataatgaaggtgcccccaaaagcaaatgaatcactgttttcatcactcaactaggaaaaggcctgggggccagccacgttattaagtaatacctaacattataataatttctgctctcatgatgtgctaaacctgttacttgtatgcaacctcaaataattcacggtagaatacaatgataaatagctttcttaacttgattttcataagaaaagtcacattggccggtcgcggtggctcacgcctgtaatcctagcactttgggaggccgagtggcggggcgggggttggatcatgaggtcaagagatcgagaccatcctggccaacatggtgaaaccccatctctactaaaaatataaaaattagccaggcatggtggcatgcacctgtagtcccagcaactcgggaggctgaggcaggagaattgcttgaaccttggaggcggaggctgcagatcacaccactgcactccagcctggtgatagagcaagactctatctcaaaaaaaaaaaaaaaaaaaaaagagtagaacatagtattagtatgtctgtttttctggacatgtccaagctcccagcttgtcccatcaggatcttaaattcaacacttccacaggcaaatccatcatcttttttttttttttaattttactttaagttctgggatacatgtgcagaacacgcaggtttgttacataggtatacatgtgccatggtggtctgctgccccatcaacccgtcctctaggttttaagccccgcatgcattaggtatttgtcctaatgctctccctccccttgcccccgacctcccaacaggccctggtgtgtgatgttcccctccctgtgtccaagtgttctcattgttcaactcctgcttatgagtgagaacatgcggtgtttggttttctgttcctgtgttagtttgctgagaatgatggcttctagcttcatctgtgtccctgcaaaggacatgagctcattcttttctatggctgcacatctttctttaagactggctccctccctagatcttgctaattttgccaccatcatccctagtcccccagtctacagatcttaagatcatgtgtcatcctgtgcatgtagacagccaagttgcatcattccacgtctacaacatccctgcagcagccccaccttaccgttcccatcaccaactactcttgggccaggtattcatggttcccacctgggagaaggaggctggcaggatggctccctgcagctctccctactccagtccatctcaggcagttgctgccattatgtctcttcccaaccccttaaccagatcatcaaattcctggctacagagccaccatcctgaaagctccagggcaggcccacgtttgcattccctttctggcatatcagcagcttttattattgagtctggcacgtggcaggcatcagtcaatatttggtgaagaaatggatgaagacatcaatggatccccactcatccactcattctagcacttgggcctaaaggggcccaaagttcttccagcggtatctttttttttttttgagatggagtcttgatctgtcccccaggctgaaatgcagtggcacgatcttggctcaaagcaacctccgtcccccaggttcaagcaattctcctgcctcagcctcctgaacaactgagattacaggagtgcgccaccacacccagctaatgttttgtatttttagtagagatgaggtttcaccatgttggccagactggtctcaaactcctgacttcaagtgatccacttgcctcagcctcccaaagtgctgggattacaggcctgaaccgctatgcctggcctcttccagctgtatctcactggtcctgatggaccagtggctgtagtcccatcagaccagggatgattctgacacataacaatgtctacagacattttgaggtatcacactgggaagtgggtggtgctgctggaatccagtggataaaggctggagatgctgctaaacatctcataatgcacaggacaggaacccacaacaaaatccagcccataaacatcaacaatgctggggggttgaaaaaccctgtttaagacataccacaggaatccccccagatagaccactatctgcttctccaacacaccctatacttcctgatatggtttggctgtgtccccacccaaatctcatcttgaattgtagctcccataattcccacatgtcatgggaaggacctggtgggaggtaactgaatcatgggggctggtctttcccatgctgttcgcatgatagtgaataagtctcacgagatctgatggttttataaagcgcagttcccctgcacacgctctcttgcctgccaccatgtaagacatgcctttgctcttcctttgtcttcccccatgattgtgaggcctccccagccatgtgaagtgtcagtccattaaacctctttcctttataaattacccagtcttgggtctgtctttattagcagcatgagaacggattagtacacttcccctcctctttctggtatacgctctccattccaccaactcttcctgctgaaatcccttctacccttccctgccagctcaaatgctccctgccctgtaggcagatgcagcttggcctccttcactcattcaagcaggtatgttctgagcacctgctctatggcactggctgtcagtggttggacattcaacagtgagcaatgctgatggatcctgttccttaaaaccttacacgatagcgggggagatgcacaacaaacaagcaaataactaagttagttacacaagtcaattacacacttcgctctttacaactgcagggtcatcaggctgattgcaagacagagtggccagtgggtggggctgtggagacgcgctccagggagggggcactgcaagtacccagaccctaagtcaccagaaggctggagcgggaggcggggatagaccatgctgacaacagactttgggcctctatctcctgaaacccttaactgagttccagtggagctcagactgaggcctgagtgcccaagttcaactcccatttctaccctttaccagctacgtgacatgatgcaagttcctgaacctctctgggactcagtctccttatctgcacagtaggaataacagctcctacctcaaaagggttgttgagaagaattaatgacttaaaacatgtaaagcatttggactagacacagagcaagtggtcaaaagtgagttactcgtgccatgactaccattcacagtaacccctacccttatcttagcagagacaggctttttaaagactcacctatctcttggttcccacagcacatggtggggctgagaaaacatctgatgagagacacatatatatttacatgctttggtcttaacatcttttcctttatatactgtggatattgctttggttataaagcaggaaagatgggaagcttcacagccgcctgcaggctttctagctaaagagcaaatggcaacaaaatgcaatttttgcagtttctcacaatagcaatctgcatagtgaatcacaatctaaatgtctccagcaatacccttcaactgctctggggactaatcttatttcagcagtttaaaaaaaaaaatcacacaccaaagagtagctaaacaatatttaccactttgggactctttctgacttaacaatcgtaatgtccccactgtgaagctgccagaatggtatgcagcagataagagtgtccttcattagtggctgtttaggggttgggggtctttgggggcagtttcagcacggggtgcagggtttcttcttggattaaggaaaatgttctaaaattgattgtgatggttgtacacctctgtgaatacactaaaagccactgaattgtacacatttacactgttgaatcagaaagaagcccaaagtggtaaatattatttaattaacaattcacatggtgaactgtagggtatgctaacagttgttaaaggaaaaaaaaaaaatagtgtccttcaggaccctgtccctccccccacccccaaaataattaactgtgacagcaatatcctcaagagtctccaaatgacttgtcctaagtacaggttgcatatctcttatctgaaatgcttgggaccagaagagtttcagattccagacttttttcagattttggaacatttgcatatgcaaactggtagtgcattcctaatctgtaaaatctgaaatccgaaatgcttttgagcatgacctttgatcatcaagtcagtgctcaaaaagtttcggtcggatcttagagcattttgcaatagggatgctcaacctgtacaaaggtaaatttacccaacctctcttttcttggcctaaatgcatccaaaaggcagtttttgagacacacaaaagattctgagtcatggcttggctgccacaatggccgtccttccaaaatctttatctgcaactcttcagagaactaagaaagcagatgggctgggacttcgtggccaggcggcttttggcatcactggctttggctgacgccattcgagacaacggttaaagaggggaaaagacatttccagaacctctctcacttttcaagagcagaactccacttggggtttgcctggttttggtggatatttgctgttattttttttcccatttccctaacaagacagcaggcagctgctgtcccaggcagcactctgggaagaactggtagaaggcgccttctctgggcagaagcagctgtgtaggcacatggccaggctaacagaagccccagatgcaaagagaaggtaacccttcccccgggcagatgtgctccatgtgagggcacccacctggtaggcaaaacctctgcctctagatgctctggagtagtgcacacagtgcacagccacctggtgtagtcatgcaacttttttttttttcagagtctcgctctgtggcccagcctggagtacagtggcatgatcttggctcactgcaaactccgcctcccaggcgcatgcagttctcctgcctcagcctccagagtagctaggattacaggtgccagccaccatgctcagctaatcattgtatttttagtacagatggggtttcaccatgttggccaggctggtctcaaactcctgacctcaagcgatccactcgcctcagcctcccaaagtgttaggattacaggcgtgagccactgtacccagccaacaacttctattggtttgatcaacaccttggtctcagctttgtttagtccggagactccatggtacatgagagcagtgggttggacagatacacccaggtgacccaggtggagtgtattcattcatactcatccatttactcaatattaaatggtcactgaggccaggcgtggtggcttaggcctgtaatcccagcacttcaagaggccaaggtgggcagttcacttgaggtcaggaattcaagaccagcctggccaacatggtaaaatcccatctctaccaaaacacaaaaattagccaggtgcagtggcatgcacctgtagtcccagctacttgggagtccgaggcaggagaatcacttgaacccaggaagcagaggttgcagtgagccaagatcacgccactgcactctagcctgggcgatagagcaagactttgtcttaaaaaaaaaaaagccactgagtgtctactactgctagacaccatcctaggtctgggcttcttgctcctcaagaatttatagtgtacaggtagaaaaagacagcaaagtcacaagaagaaacatacaactggccaggcactgtggctcatgcctgtaatcccagcactttgggaggctgaggcaagtggattacctgaggtcaggagttccagaccagcctggccaacacggtgaaaccccatctctactaaaaaatacaaaaattagccaggtgtggttgtgtgcacctgaaatcccagctacttgggagtctgaggcaggagaatcgcttgaatccaggaggcaaagcttgcagtgagccgagatcatgccactgcactccagcctgggcgacagagtgagactctgtctcaaaaaaacaacaaaaaaaactcacaatgagatactacttcacaccgatttggatggttataataaaaaagagtggcaataagaaatgttggcaaggatatggagaaactggaacccatatacactgctggtgggaatgtaaaatggcgcatctgctttggaaaatagtttggtggttcctcaaaatattaaacatagttaccgtatgactcagcaattccaatcctaggtatctacccaaaagatatgagaacaaatacccttaagaagatgtgtctgtgactgttcatagcagctttattcccaatagacaagaggtacccagatgcgtgaaatgtccatcagtgtcaaaaaaaaaatgtccaaatgtttatcaataggtggtcggataaacaaaatgggttatctatacaatggaatatcatttagtaaaaaggaacaaagtattggttcaagctacaaaataagtgagcctcagaaaccttatgctaccacaaagaggccagtcacaaaagaccacatatttttccattaacatgaaatgtccggaaaaggcccatctatggaggtaaattagcagttgcctgtgctgggagtggcaacatgaagagacttgcaagtgggtataaaaccacttttttgggaaggtagagatgtgctaaagttagattgtgactacaccactctaaagttaataaaatcccttgagttgtaaacttaaaatgcatgttatggtacataaattatacctcaagaaagttattaaaaaaatttaggccaggtgcggtggctcatgcctgtaatcccagcacttttggaggctaaggcaggaggattgctcgggtccaagagttcaagactaacctgagtgacacagcgaaactgtctctacaaaaaatataaaaatcagccaggcgtggtagcaccttctctgttcctagctactcaggaggtggaggtgggaggatcgagcatggcttgagcccaggagggggaggctgcagtgggcggagatcatgccactgcactccagcataggtgacagagtaagaccctgtctccaaaaaaaattttaaagcaggcaaggcccagtggctcacacctgtaatcctagcacagggatttccaatcttttggctttcctgggccacaacggaagaactgtcttgggccacacatgaaatacactaacattaatgatagctgatgagcttgaaaaaaaaatggcaaaaaattccgaacttttaagaaagtttaggaatttgtgctgggacacattcaaagccatcctgggccacatgtggccagcagaccatgggttggacaagcttgtcctaacagtttgggaggctgaggtgggaggatagcttcagttcaggagttcaagaccagcctggacaacacagtaagaccttgtctctacaaaaaaatacttaaaaattagccaggcatggtggtgcacgcctgtagtctcagctactcaggaggctgaggtgggaggatcacttaagcaccacaggttgaggctgcaaatcagccatgatcacaccactgtactccagcctgggtgacagagcaagaccacctcaaaagaaataaaatacaataaataaataaataaatttttgaaaatgaaaaaccccgacattcaaaaataaaattaattgtgttttctggaaatgttatagtgcaaactttttacatatgtgtgctggtcactctatcccttgactgatgattacaacaaagagttgagaaagtaatcataagccctatttactcacaggaactctcaaataagaggaccttcaaatatatctcaaataagagataactagtttggcctaaatgtatggcacaatttaaagcatttatttcatcatcatcatcctgttagaatttttaaaaccacaatattttcaactttgttcaaacttggagatacctttccaggtctactatttctagaaaagttcttaggtgagacctgcaagagacagagtgagttatttttttactgacactattctctgccaagggagaagttttccagagagtacaaggaaagattcaggattagcaaattccatcagcttcttaggaatgaaatgtctgggaaaataatctttttaagaataccacccattagtccagttctctgaagggaaaatatcaaactggaaaaacagattcagacctaaaaataattaagtcactttaaaagcatattttatcttgatctctctcccttttaggatttcttcaaaacagaagccataaacttctcaaaagacaattactagaagaaagtagtcctaattaggatatgtgtcaagaaaacctaattatcaatttgcctaattaaaatgaatatctgaacatgccttaggaatgtgagctttctcaggtgagacatgtacaattttttttaatcaacatccgtcaacagagcctagcacattatgttaacagggaacggatgactgaaaccaagtgtcacacataccactactggaaggagttgatgggaatactgttactcacgtaaatcaccggtgggaggaaatgggtcttaaagcaaagcgctctttcatttaattggcaggctacacttggaaaacaaactgctcaatgagctgattctgcagcaaaggtgaagggttcagagctgtgatttttagggactgttgcttgagttaatcaaacccctttgatggtgtgtgttttggcaagagaaggggaaaagtcagttttttttttttttttttttgagacacagtcatcactctgtctcctaggctagagtgcagcgggcaatcttggcttactgcaacctccgcctctcaggttcaagtgattctcctgcctcagcctcccaagtagctgggattacaggtgcctgccaccacacccggctaatttttttaattttagtagagatggggtttcgccatgttggccagactggtcttaaactcctggcctcaagcaatccacctgcctcggcctcccaaagtgcaggaattacaggcgtaagccactgctcccagcctcgaaaagctagttctttaactttctcagtctgcccaaggggcaaatctactggcttcccaaggagtctggagaggcctctgatgcctctaagggcacctctccaagttgccagcgatgctaatagagtcaggaccccggggaattgtcaatgagtgcaatggaagcagcaatggtaggctagggttcagcacctagtaatgtgaacccacaaacctggggttctcagcagaacactctgaggctgggcctctctaggccctccgttaaatgacccatcctgggtgtgtctatgggactgcatggctcacagaggagatcaagtgctggccccacttctagatttactcggggctaagaaaagttcagagtcactctctcctcctatcagcagggtaggtatcttatagatttatcatcaagtctctctccagcatccccattcttatccaggggagctgctctctgatcctctggtcccagtggtggccccctggcagctgcaatggcctaggaagctactatacctcagcactcccaccatctccactgaaagacaccccgtgcccaataggcacctccagctacagcaaataaacacattcaaagtaaacaatgggggccaagtgcggtggctcatgcctgtaaatcccagcactttgggaggccgaggtgcctgaggtcaggagtcccagaccagcctggccaacatggcgaaaccctgtctctactaaaaacacaaaaattagcgggcatggtggtacatgcctgtaatcccagctactcgggaggctgaagcaggagaatcgtttgaacgtgggaggtggaggttgcagtgagtagcatcactgcactgcagtctgggtgacagagctagactctgtctcaaaaaaaaaaaaaaaaaagtaaaccatgggggactacagaaatgcagcctctggacaaatccttgagctccagcttccaactggattgcatcccaagttgctctaaagtagaaatgcttttgttgccattgctgcaatcagaccactcttttcaaaataaaaatctgatcatacatccttgcttcctcacacatccagcttgaaacctcttgatgctattaggacacgacaaaaatccttagttaccaccacctccctctccagcctcagcccacaccatgtcccaacctcatctttctgctccagactcagagacttccttcagccctcatccttccctttcccatcctgccatgtcctaggactctcacacttgctctgcccatggtccacatggtcttccctcccttcgtggcccagttaactcatactcctcttttagcaatcagacgaagcaacacttcctcagggaaaccctgcgtgaatgacctcagagcccaccagtagccaagcattattttttgtgccctagctttgtacctggattattacaagcctctgagagcatgtaacttgaaccactcccccgcccccaacttcctattctccaccatactggacagtgcaataggaatataagaaatatttatttcctttcggtttttttgtttgtttgttttgagctggagtcttgctctgttgtccagggtggagtgcagtggcacattctcggctcactgcaacttctgcttcccaggctcaggcaattctcctgccatagcctcccaagtagctaggactacaggcatgtgccaccacacccagctaattttgtatttttagtacagatggagtttcaccatgttgaccatgctggtctcgaactcctgacctcaggtgatccacccgcctcagtctcccaaagtgctgggattacaggcgtgagccaccgcggccggccctcaacaaatatataggcgtgagccaccgcagccagcccacaacaaatatttcttgaactgaaaaaaaaaataatacagcagagtaacagggaactctcatatactgctggtgggagtataaattggcactaccactttggaaggcagtttgaccacatctagtaatgctggggatgattataccctataacccagaacatagcttgtaggtatatgcctcagagtaactctcccatgtgtccacaaagagatttgtacagaatgttcataacagcactgttaccaagggcaaaaaccagaaacaactaaatggccattgtattagtcaggatccttgcaggaaatagttggcattctcaaattaggatgattttaaaaagggtttaaaaagggattacttggtgggggttgggtggacgaaacctacaagggagtgtggtaacccaaggttagaaaagcagaaccactgccactcccacgcctcaaaggaggaaatggttactcaaatccagaactagagagaatgaggagaaaagctgtcctgagaaaaggagcgaccttgaccttcaggggtggggaggaagacagccaggcgaggcaaccccacagagtaaactgcaagaataaatacagctgccttttgcttctctccctgctctgatttcttctcagggctccccactggctgagcccaaaggaaaaccaaaaggcaaggagcccaccgatgtagctcacggagggcaaacccctggggcatggtggggaagggagaaaggtttggagaggcaaagggaagatattcagcatatacatcaacagaatgtataaggtatataatcatccaatggaatgttgcccagcaagaaaagagcaaaatcttcatgttggacaaaaaagacaaggtccattaaaatacagtcgtcccaggccgggcgcggtggctcaggtctgtaatcccagcactttaggaggctgaggacggcggatcacctgatgttgtgagttcgagaccagcctggccaacatggagaaaccccatctctactaaaaatacaaaattagccgggcgtggtggtgcgtgcctatagttccagctactccagaggctgaggcaggagaatcgcttgaacccgggaggcggaggttacagtgagccaagatcgtgccactgcactccagcctgggcaataaagcaagactccgccttaaatgaataaataaggttttaccatagaattaccggagaaacctactttagataaggtagcaggtaaagtctctgaggaagtgaatgaactttaaaatgaggtgtgacggttgagagagccaggctcaccaaccctgctaaagaagcagaaaacagcaagcgccaagaccctcagggaaagaacggccttggcccttttaaatgcagttcaaacaagggcaacaacaaaacctgttgcagaactgggcaagagagagaatgacaaccctgaaggaagtggacacaagcctgatcatatagggcatttagggtgacttccctgggggtataaagctggtgagagcctgggaggcgatctggctgcaggcagcaaaaagccacagaggggaatcaacaaaccagaaacaaacctccctctttacttagcacctagcatgcgtccaacaccgggttacaaaaatacttttgatctgtttacgcttccaacaaccctatgaggcaggtattatcaaacccatttttaaggcaaagcagataatctaaatccaaaatccaagcacttcactacgactctcgaatgccctccctctctactgctctgatggggcagtgttaccatttcggtgaatgacttaaataaacgtcattatggagtacagaatacataacggtgaacaaccttaataaaaccgacaccctctaacatgcaccgaacgcttatccagtaacacccacaagtattcccgtttcacagatgtggaagctgaggccaagatgctaatgcacagcttggaaaccaggtctcgctgcagagtccaagctgtcattaactatgctttgctaccctcctcttacttcccttctctgggggaagttaggtcaaggccaaggaggctcctagaccagatcgctctctcggcctcgcctctcaactgcgcccctggaatccctaagagcaggctttgatgcagctatggcggctcccaggccccggtgcagccccggatggtgtccgactggcggagcgcacacctgaacaaaaggttcccccggcggaaggttccgcagccccagagtcccctccccgggtgaggggcgggcagtacctgcgggaaacgcggccagggtcctgcccctggctctgtggaaaacaccccccgcctctgcagccgacatggcgagcgagtttctggccttcacttagaacactgcgtgggtggaagccgcgcgacttcacacagaacaaccgctggacctgtcccgctttgggcgacgccctttgatctcggggcgggactggggcgggacggggaggggcccggtggctcggggcgccactagtgctgcctgggcggagcggaggcgccagcggcccctctgggatcgacctgcgcgcctggcgagtggagactgtctagggcacgcgtgggcggggataaggctttggggtcagtccttccctaaaggcagagttactagatttaacaagtaaaaatgcaggactcccggttaaattggaatttcagatttttttttttaaagaatgactgacttggtataaatatgtcctatgcagtatttgggagctacttacgttaaatttttttttcattatctgaaattccaattgaactgggcgtcctaatttttttaaatttttctctttttgcaggtttgaatggaagcgtcctgatttttttttatctgacaactctatcataaagtcagaaggagccactggggtggcttacgcctgtaaccccagctctttgggaggccaaggagggaggatcgcttgagtccaggtgttggagaccagcctgggcaacacggcgagagaccttgccaatacaaaaaaaaaaaaaaaaaagatgaaaaggtggacgtcttggaagactgtctcagcctgaacttcccagtggctgccaccatctttctgttattatctttgcttgctatgcaccaggcagggcgctaagcactttgcacgctgctcacttaatccccactacagccctaggaggtggtgctgttattagctgcatccgtcatttggggaaactgacgctcagagagatgaacgaacttgcacaaggtgacacacatctagagaggtagtaaagctgcgagtaaccaaattagtgtctcttcaactcaagagccattgtagtgaactacttagccagcatttgtcaaacgtgttgaaaatacaaattccagaatggacctattgaatccaaatctctatgaaaatgatctgtgttttgttgttgttgttgttgttttgagacagggtctcactctggttgcctaggctggagtgcagtggcacaatctctgcagtctcgatctcctgggctcaggtgattctcccacctcagcctcctaagtggctggcactattggcgtgcgccaccatgcctggctaatactttgtatttttagtagagacgagtttgactatgttgcccaggctgatctggaactcctgagctcaagcaatccacccacccgggcctcctagagtgctaggattacaggcatgagccacagtgcctggcctgaaaatgatctgtttttaacaagcactgcaggggagctcttatgatcttacaaatttgggaaattcttttctaaactagctgcctacatccaaagcactgtttgagtagctaatatggccataactactgttctctaatccttgacaagagtcacccatgaatcatagtggttaagagtataaatgcctatgagtcctggagtcagtgggcttggattaatcccggttctacccacttactggttgtatgctcttgaaaattgcatagtttctctatgcctcagtttccctatctgtgaaatggaaacaatagtagcatctaggtcatagggttgcagaaaggcttaaatgagttcatgtatcaaagtgcttagaataatagttctaataacaaatggtaggtactcaatgaatattagccattgttattattaatcaatcactataaccctattccctgaacatggcctggcccagaggaggagtcccaagaaatgtgaaggaggccgggcgcaatggttcaggcctgtaatgccagcactttgggaggtggaggtggcggatcatgaggtctacagatcgggaccaccctcgccaacatggtgaaacctcatctcaactaaaaatacaaaaattagctgggtgtggtggtgcacgcctgtagtcccagctactcgggatgctaaggcaggagaatcacttgaacccgagaggcagaggttgcagtgagccgagatcccgccgctgcactccagcctgagcgacagagtgagactgtgtctttaaaaaaaaaaaatgtgaaggggaagctgagcacaatggctcatgcttgtaatcccagcattttgggaggtttaggcaggaggattacttgagcccaggagttcaagaccagcctgagcaacatagtgagaactcatctctattaaaaaattttttttaattaaaagaaatgtgaaggagagaatgaattatagaaacagaccctgcctcttattcactagctttgcagtcatactggccattcagttcattaaacatgcaaattaatttccctctctgcatatgcagttctttctgcttaaaatgcctcttcccagctgggcaccgtggctcatgcctataatcccagcattttgggaggccaaggcaggtggatcacgaggtcaagagatcaagaccatcctggccaacatggtaaaaccctgtctctactaaaaatacaaaaattagccagatgtggtggcgcgtgcctttaatcccagctactcgggaggctgaggcaggagaattgcttgaacccgggaggcggaggttgcagtgagctgagatcgcgccactgcactccagcctggtgaaagagcaagactctgtctgaaaaacgaacaaacaaacaaaaaagtatcttcccctgctgagctaaagcccatttgaacatgaaggcctgcagttaaataacacttctgtggagaggccatgccctacccatttgcacactttgctgatctaaactaggcctccctcattctttgttagagcactatgttcttgtcccttgttgcactttgcacagttgataattatatgttttcaggtgtaattatttatttaatgttgactttcccgactcaactataaggtctattaagttggttacctttttaaaaaatttactgttttggccgggcacagtgtctcacgcctgtaatcccagcactttgggaggccaaggcaggcagatcatttgaggtcaggagatcgagaccagtctggccaacatggtgaaaccccatctgtactgaaaatataaaaattaggtaggcatgggagcacgcctgtaatcccagctacttgggaggctaaggcaggagaatcacttgaacctgggaggcggaggttgcagtgggccaagatcgtgccactgcactctagcctgagtgacgaagtgagactctgtctcaaaaaaaaaattattatttataaagatggtgtctcactgttatccaggctggtcttgaactcctggcctcaagtgatcctcctgcctcagcctcccaaagtgttaggattacaagcatgagccgccacgcccagctgagggcagttaccttgactgtctagctcaccaagcaggatgcctgaggcatagacactaaatgtttgttgcattaataaataaatggattatgaatatctcaacaagataaccatattttgaacctcagcagcaattgggaatagatctataggccaatctggagcaacttcaaaactgtaccagtgcattggatgatagcaatagctgcaattgtgaaaggaaaataaatattgagaccccaaaatcactaagccaaggggaaaagtcaggctgggagctgcttagggcaaacctgcctcccactctattgctgaaacagacagctactaaggctgggtacagtggcttacacctgttatcccagcactttgggaggccgaggcaggaggatcacttgaggtcaggagtttgagaccagcctggccaacatggtgagacatccatctgtactaaaaatacaaaaactagccagttgtagtggtgcatgcctataatcccagctactcgggaggttgaggcaggagaatcgcttcaaaccacaagacggaggttgcagtgagctgagattgtgccactgcgctccagcctgggtgacagaaggaaactgtctcaaaaaaaaaaaaaaaaaaacctactaagataaaaaagctacgtacgtcgctcagaaggaatttccttgtagacaaaggacagacagaactcaaagttatccctctgctcactgagataaatgcatttctgactgcctcctctggaaaagctaatcagaaactggaaagaatgcaacctttttttttttttattcccccgagacagagtcttgctgtgttgcccaggctggagtgcagtggcatgatctctgctcactgcaacctctgcctcccaggttcaagcgattctcctccctcagtctcctaggtagctggggttacaggcatctgccaccacgcccagctaatttttgtatttttagtagagacggggttttgccgtgttggccaggctggtcttgaactcctgacctcaggtgatctgcccgcctcagtctcccaaagtcctgggattacaggcatgagccaccgtgcccagccaccttttgtctcttatctacctgtgacctggaagccccctccccacttcgggttgtctcgcctttccagacggaaccaatgtacatcttacatatattgattgatgtctcatgcctccctagaatgtataaaaccaagctgtgccccgaccaccttggcacgtgtcatcaggacctcccaaggctatgtcatgggtgcacatccttaactttggcaaagtaaacttcctaaattgtctgagaactgtctcagacatttggggttcacactttttttcttttttgagacagagttttgctcttgtcgcccaggctggagtgcagtggtgtgatcttggctcactgcaacctttgcctccggggttcaagtgattctcctgcctaagcctcccaagtagctgggattacaggtgcatgccaccatgctaggctaattttgtagttttagtagagacagagttttaccatgttggtcaggccggtcttcaactgctgacctcaagtggtccacctgcctcggcctcccaaagtgctgggattacaggcgtgagccaccatgcccagcctggtcttgccagaggcatttgaaccagagagactccatcttgaataggggatgggtaaaataaggctgagacctgctgtgctgcattcccaagaggttacgcattctaagtcacaggatggaccttaggaggtcggcataagatacagtcgtaaagaccttgctaggctgggcgcggtgggtcatgcctataatcccagcactttgggaggccaaggcaggcggatcacctgagatcaggagtttgagactagcctggccaacgtggagaaaccccatctctatgaaaaatataaaaattagccaggtgtggtagcaggtgcctgtaatcccagctacttgagaggctgaggcaggagaagcacttgaacccgggaggtggaggttgcagtgagccgagatcatgccactgcactccagcctgggtgacagagcaagactccatctcaaaaaaacaaaacaaaacaaaacaaagaccttgctgataaaacaggttacagtaaagaagccagccaaaatgaagatggcaatgacagcaaacctctggacatcctcgctgctcattatacactaattataatgcattagcatgctaagagataccccacaagcaccgtgacagtttacaaatgtcatggcaacatcaggaagttatcctatatggtctaaaaaggggagctctcatttccaggaattccccacctctttcctggaaaactcatgaataatccaccccttgtttagcatacaatcaagaaataaccataaaaatgtgcaaccagcaaccctcagggctgctctgccgatagagtagccattcttttattcctttactttcttaataaacttgctttcactttactgtatggacttgccccaaattcttccttgtgtgagatccaagaaccctcccttggcgtctggatagagacccctttccagtaacagtcttatggcccccacccaggcactgactttgtgcaaagatgacaacttccccatgatttcatttcttctatttttattttattttattattatttttctgagacggagtttagctccatcacccgggctgtagtgcagcggtgcgatctcggctcactgcaagctctgcctcccgagttcacgccattctcctgcctcagcctcccgagtagctgggactacaggtgcctgccaccacgcctggctaattttttgtatttttagtagagatggggtttcaccatgttagccaggatggtcttgatctcctgacctcatgatctgcctgcctctgcttcccaaagtgctgggattagaggcgtgagccacagcgcctggcctccccatgatttcatttctgacctaaccaatcagcactcccgactcacaggtccactaaccaccaaattatccttaaaaaacctgatccccaaattcacaaggagactgatttgagtaataaaattctggtctccggtacagccagctctgagggaattaaactttctctattgcaattcccctgtcttgataaattggctctgcccaggcagcagacaaggagaacttgttggacagttacatcctctgccctttataattttggctttatcatcactctctacagagaagacttcctcccaatcacttggaagctccaggctcctccttcatgggagcggaatggctacagcagttctagaccacattctcatgagacaccacccagtgaggtgaggaaggaagtgtcttttatttcctctgaatcctccagcaaacatcccctgcatcactgcaatgccagtttaaaaccaaagttagaaggatagatggcatatttaaactggctgcagtcatgaggcccaccctaaagaaggcatggtgtcaatttcaccctagttacatgcctaagagtggggagcacaattctcttaaaatgaaatcttgacgccattgtcctaagaaaggaagaaccaattgttaaaaagagccaataggtaatccattacataacccgtgcaggagtgaatgttgaggtgggggtgggggagtcacaaaggccaatgactaccatccccgctctccaccctttaaaaaaactgccctttttcttccctcccacttcttgtaacagctatacttgtaaaaagccctaatctacgtggtggctcacgcctgtaatcccagcattttgggaggccgaggcaagtggatcacaaggtcaagagattgagaccatcctggccaacatggtgaaaccccatctctactaaaaatacaaaaattatctgggtgtgttggtacgtgcctgtagtcccagacacttgggaggatgaggcaggagaatcacttgaacctgggaggaggaggttgcagtgagctgacattgtgccattgcactccagctcggcaacaaagcgagactctgtcaaaaaaaaaaaaaaaaaaaaaagctctaatctaaatgtgctgttatttagagtcctagatataagattaagaacatcattttctgtactgggctgtagaatagcctcacttcttgaagcaggcagaacaatttgtcctaacactcaaggactctgggctgctgagcttttatagttcttctgtccactttttatagatcttctgtctccttgctcccagcctgtgggcagtcactccttgctttttgttgcatctgtctcttgcaagtcctgtctgtctccttcccttgtttctcatctgccccagtttgtgaagctggatgacaaagcttgttaaaactatgagccaggttggtttatggattggagccagtaggcttggcataagagcgtaaggccgcatttagagagaagcacttgggccttgctttgatgggtattgtcattcctggttaggctgtgtgatggttaattttatgtgtcgacttggctgggccacaatgctcagatatttggtcaaacattattctgaatgttgccattgttaatggtggagggtgtccaggttcttggcatcttgaacaaagaattggacaaaatgcacaaacaaggaaagaatgaagcaacaaaagcagagatttattgaaaatgaaagtacactccacagggtgggagtgggcctgagcatacgggctcaagagcccagttacagaattttctggggtttaaataccttttagaggtttccactgattactttgtgtatgccctatgtaaatgaagaggctaaagtgaagttacaaagttacttacttggcatacaccctatgtaaatgaagaagatgaagtaaagttacagagtcatttactagctgtatggtgtatgccctatgtaaatgaagaggatatttcctgttatagctgaagtgtttccatttgatttagttctaggaagtccttagattccctgcctccaggccctcttctcctgcctcaccatggaaatgtttttttgggtttttttttttttttttttgagatggagtctcgctctgttgcccaggctggcgtgcaatgtcacgatctcagctcactgcaacctccgccctccaggttcaagtgattcttctgcctcagcctcccaagtagctgggattacaggtgcctgccaccacacctggctaatttttgtatttttagtagagatggggtttcaacatgttggccaggcttgtctcgaattcctgacctcaagtgatacgcccaccttggcctcccaaagcgctgggattacaggcgtgagccaccgcacctggcctaggggtgtttacatattacattactacagttacatttggacttggagtgcaacagattgccctccataatgtgggtgggctgcatccagtcagttgaaggtctggatgaacaaaacactgaccttctctaagcaagagaaaattcacccagcagacctctttggacatgaaccacagcatcagctcttcctggtcccagccgtctggaccaccttgcagattttgcacttgccaatctctctctctagacaatctatacacagtcatgcatcacttaacggcaggaataagttctgagaaacatgtcattaggcaatttcatcattgtgtgaatatcatagagtgtgcttacacagacttagatgatcttgcctactatgcacctaggtggtgtggtatagcctatggctcctaggctatgcacctgcacaccatgcttctgtgctgaatactgtaggcaggtgtaacataatgataagtatttgtgtatctaaacacatcaaaacatagaaaaggtaaagtaaaaacacagtgttataatattatgggactaccatcatatgtgaatatatgtgttaggttgttgaccaaaataccatgcagcatgtgactgtatatacagtcttgggaccccaaaatcactaaggcaaagggaaaagtcaggctgggaacagcatcaggcaaaactgcctcccattttattcctaaataagatagctacaaaaataaaaacattacatacctccctcacaatttgcccacaaggaaattccttgtggacaaaggacagatataactcagtcatccctctgctcatatgagataaatgcatatctgactgcttcctctgccgctttcttccttccttccttttttttttttttgttttagatggaatctccctctgttgcccaggctggagtgcaatggcgcaatctcggctcactgcaacctctgcctcccagctcccaggttcaagggattctcctgcctcagcctcccaagtagctgagatcacaggcatgtcccaccacgcctggctaattttgtacttttagtagagacggggtttcaccatgttggtcaggctggttttgaactcctgacctgaagtgatccacccaacttggcttcccaaagtgttgggattacaggtgtgagccaccacgctgggctttttcaagtgattctcctgcctcagcctcccaagtgacaagggggctgggcatggtggttcacatctgggatcccagcattttgggaggccaagggagaggatcatgtcaacccaggagttcgaggccagcctgggcaacatagcaagaccccatatctacaaaaaatacaaaaattagctgggcatggtggcacatgcctgtagttccagctactctggaggctgaggggagggcatcatctgagcccagaaagtcaaggctgcagtgagtcgtgatgaggctactgccctccagcctgggagacagagtgaggctctgtctcaaaaaaaaaaaattattttgtgtatctgaaataccaatttaattgagcattcatattgtatctggcacccgtaggctagtatctaccatattggacagcacacatgtggaacattcccatcgatgcagaatttctattggacaatgctgattcagaacattcatgaataacctgtagccagtgaatctttcctgttgcttcggttcttctgtccgatggcctacctctggcatgtgggacagaacagccgtaagtatgctcaccttctcaaatgcagttctcagccttggaagcagatagtactaattgttccaactatttttcatccagaaacttgagtttaacttaccatttaggctttcttttctacctcccctatattgcttaacactcccttgtaaattactttctggatgatagtggagcttactgttaacttttttcttcttctccttttttttttttttttttttttttaagacagagtttcgcacttgttgcccaggctggatgcagtggcacgatctcggctcactgcagcttccgcctcccaggttcaaacgattctcctgcatcagcatcccaagtagccaggattacaggcacccaccaccacgcctggctaattttttgtattcttagtaaagacggggtctcatcatgttggccaggctgctctcaaattcctgacctcaggtaatccacccgcctcggcctcccaaagtgctgggattataggcatgagccaccgtgccaggccaactttctaatcttcatttttttttcatctgaataatgaacccagcctcctgaagcatttaaatattttgcaattgttctcttgggttgtgaaatgaacttttccccctttttcaacaagaataagaatattcctgaaagctccactccactgaactcaattgtgcattgaccgtacaacttaagctctttgcagaggtatgagctccccaaggcttatgtatccattagaatacaccaagtgtccagaacaggacctgacacataggaagcccttaatgaatacaaagcccttaataaaaagaccctaatcaaagtggaatttgcttctcggttaaacttactaatgttgagaatcccaagggcagattccaaattccatttagtttctccatgaatcttggtattggatgagtttacaatgaataacaacaacagaattttacatacttcaacccccacctcttgccttgctgtttgtcatatattcttgcaaagtaactgtagtctgttctggccctctcaggatgacatttttgtcactgggggccagggcaaaattgaaagccaccagttttgtcggaaaacactgttgatacatgcaaccctttctgcgtttcattttctttctctatcttccccctgctgggcactgtttgattgaaaccaaatcctgtgtttgctaacatcataactgtgctttgtttcctaagagaaggaacacatgtctgaatctgtcagctcttactggtttttatcttcccaaagcactagcttggttttttattgagcatttaatattctggactataaggtctgtacgcagaggcactccaacaacaggattctggattttctctcttgggactctgaacatattagtctcaattagtggttctcaacccgggctgcacattagaaccgcttggggagcttttgaagcatattcgttccaagacttcaccctgggaatttctgattggatgagttttggatgagacctcagcattgctctttcaatgtcccaggtgatcctaatatgaagctagggtgaagaactgcttgtccacactctaaaataagccaactggctgggcgcagtggctcatgcctgtaatcccagcactttgggaggccgaggcgggtggatcacttgaggtcaggagttcgagattaacctggacaatatgctgaagccctgtctctactaaaaatacaaaaaaaaaaaaaaaaaaaaaaaattagccaggcgtggtggcgcatacctgtaatcccaggtatttgggaggctaaagcaggagactcacttgaacctgggaggtggagcttccagtaagctgagatcatgccactgcactccagcctgggtgatagagtaagactctgtctcaaaaaaaaaaaaaaaaaaaaaaagaataaaataaaataagccaagcacctgagtcaagtgaatggcaagtgaacaatacagcctattgctgctggtgtgaggagacaaatgcaatacactgctgagtcactgggcactgggatacataccttttcatacagagtcctatttaagcttcaccacagtcttgaaattttatgcataggattgaatgattgaagagtgtcttcagaaaattcatgtccatctagaacctgtgaatttgatcttaattgtaagacaggtctttgcagatgtaatcaagttaatactcatactggattggagtgggccctaaatccaatgactgatatcttctaaaaaaaatttttggccaggcacggtggctcatgcctgtaatcccagcactttgggaggctgaggtgggtagatcacttgaggtcaggagaccagcctggccaacatggtgaaattccttccttactaaaaatacaaaaattagccaggcgtggtggcaggtgcttgtaatctcagctactcaggaggctgaggctggagaattgcttgaacccaggaggaagtggttgcagtgagccgagattgcatcattgcactccagcctgggcaacaagagtgaaattccatcttaaaaaaacaaacaacaacaaaaaaattatagagtgttccttctcttgtttcctaagaaaaggaacacatgtctgaatctgtcaagtcttgctggtttttatcttcccaaagcactagcttgtttttttttagattttgtttgtttgtttgagatggagtcttgctctgtcactcaggctggagtgtaatctcaatggtgtaatctcagctcgctgcaacctctacctcctgggttcaagcagttctccctgcctcagccttccgagtagctgggattacaggcacctgccaccatgcttagctaattttctttcttttttttttttttgtatttttagtagagatggggttttgccattttggccaggctggtctcaaactccagacctcaagtgatccacccacctcggcctcccaaagtgctgggattacagacgtgagccaccaggcttggcctagcctgttttttttttttttttttttttaattgaggatataatattctggagaaataaggtctgtagctagaggcactccaacatcaggattctggattttctctcttcagactctgagcatattagtctcaattagtggttcttaatcctggctgcacattacaatttcctggggagcttttcaagcatattcgtcctaagacttcactctgggagtttctgattggatgtcatgttgcccagctggtctttaactcctcggctcaagtgatcctcttgcctaggcctcccaaagtgctgggattacaggcatgagccaccgtgcctgggctgatgtcttttaagaagagaagaggacacacagagaaagcaatgtgaagacaaccacagagattagagtgtgtggctaggatgcatctataagacaaggaatatcaaggataacagaaaacaccagaatctagggcccagcatgacggctcacgcctgtaatcccagcactttgggaagctgtggtgggagaattgcagcctgggcaacataacgagaacctgtctctgcaataaaattttaaaaattacctgagtgtgatggtgtgcacttgtggtcctagctactcaggaggctgaggcgggagaattgcttgag

SEQ ID NO: 275 - DNA, 39106 bp, Homo sapiens
caatgtggcccaaacactgccccattccctgcccagtgagtgaataagggcacaagctcttaggaacaaatatgaactctgtcacttactagccctactatcatgggtaagggactttctctttgtgagcctcagtttcttccactgaaaaatggagataatagtagaactcagctcatctggtggttgtgaaggctgagtgagatatcaaatgtggcatgcttaacacagttcatagcaaatattcagccaccatgatggcaacgatgatgatggtggtggtcttgatgatgagttcttgtgtctgtggtttctctgcctcaaatgctgttagaggttaggctcacagcctcagagcctgaccacctgggtttgaatctcatctttgccatttatttggtcaagtgatgttccctatctgagcctcagtttccccatttgaaaaatggcggtagtaacagttccagcctcacttaactgtcataaggataagtgaaatgatgtaagcaaaagcactgatggggcctcatcatacccacccgagacaggaagcctctctgtggaaagcctgccatggccccttccctctggctttcttctcacagggtcctgccgttgtcctaccaggaagaggcaacacttacagactcactgtggatgcggctgataactctcagcctcccaggactacagagcccctgcacccttccagggttagccaggaagcgccggcccagagaaggagaagctggtctcagggacacacagcaaggctgggctgagccctcacctctgcacatgacctgttgcaaaatcatgtcttcacttccaaaatacttttttcatcaaaatattctagtttctgccttttgtctcagatgccttctaggcagaaatttcacatccatccccatcctgatccgtggacctggccgctcagggctggcacagcctccctccacctgtctctcatctgcttgtctgaatctctgtgatactccaactctctccccgcgtttctgaatctatttctggctgtgtatttacccagttctttccctgtctctttgtcctctgtctccctctctttctgccccttcctgtttttcccactggtatctctttctttcttttctttctttcttttctttctttctttcctttctttctttcctttctttctctctctccctttccctctttctttcttctttttcttttttttgacagagtcttactctgtcacacaggctggagtgtaatggcacaatctcggttcactgcaacttctgcctcccaggttcaagcaattatctgcctcagcctcccgagtagctgggattacaggtgcccgccaccacactcagctaattttcgtatttttagtagagacggtttcaccatcttggctaggctggtcttgaactcctgactgcgtgatccacccgccttggccccccaaagtgctgggattacaggcgtgagccactgtgcctgggccccactggtatcatttctaaggttattttttcaccctttgtctctgtctctgtgcgtatctcttctccctgtatttctctctctttctccctgggtctctggttctgtggctgtgactccatctttctctgtctctctctctttctctgtgtacacagacacacaaacacacatctttgtctttctctcttgtctctggtctctgtttatgtctccttctgtcagtctcttgcatctgtatttttttctgtctctgtctctctgtgtctgtttctctctctgcctctgtcactctttcctcaagtatacacacacacacacacaccactgacaaatatacatatatctttgtctctctgtctctggtctctgtttatgtctccttctatctcttttgtatctatgtttatttctgtatttctctctttctttcttttttttttttttttttttttttgagacagggtcttgctgtgtcactcaaactagagtgctatggtgtcatctcagctcactgcagcttccacctccgagttcaaggttcaagtgattctcctacctcagcctcccaaatagctgggactataggagtgtaccaccacacccagctaatttttgtatttttagtagagacgggggtttgccatgttggccaggctggtctcaaactcctggcctcaagtgatccacccacctcggcctcccaaagtgctgggattacagatgtgagccaccacgcctggccctatctttatatctgtatctgtctttatttctgtctctgtctctgtgtctctattttttttctctgcctccatctctttttcctcgagtgcacacacacacacacacacacacacacacacacacacaccgctgacaaatagatgcatacaacctccctcctcccgcatctgaaggaagcagggcactcacctgaaagcaggattcccatccagtggtgtccccatgagtcagcaggccccatgggtcccggcacctgacttcagtgtgccaggccgtctgtcgccccggcttgcacacacagatacagtcctcactccaggtgcagcccctccacctcccttctctcctctcccaccctgctacaaactcacacacacactgcagtaactgcagctcccaggacagacaggggtggtggcaggaaagtaactttgaccccacctctgccctctacccccagggctcactttccttccctgcccagcacaaagagcgggaagtccaggaaccctggagaccgggaactgcgattacgatagtcaatagcaatgataataaaaaacaacaatgaccagctccttgtccccgagagcttaataaccagtcccagtgccaagttcattataagcagccaataaatattaaatgagccggaatcatgcttgtgatatagatcctggtcataaacaaaagctctggagtcagaccggcaggaatctcagactgagcaggactgggggacctccaggaggagcctgacgtggtcttgggagaaggggcagggagggcctcctggaggagtggacatctgagctgaaacttcgagaacatagtaaaggttccatatataaaagttacttaaaaaaaaatctctatgacaagacaagctggtggtctttgacagtgtatagacctagacccagaagatttaacagaaccgaccagctgagggaactatcattaatccatgtatccatccattaatttaacaaatacttcctgaattctcttcctttttttttttttgagatggagtcttgctctgttgcccaggctggagtgcagtggcatgatttcccctccctgcaacctccacctcccaggctcaagtaattctcctgcctcagcctgcctagtagctgcaactacaggcgtgcgcctccacacccagctaatttttgtatttttagtagagacggaatttcaccacgtagcccaggctggtcttcaactcatgagctcaagcaatccgcccgcctcagcctcccgaagtgctgggattacagacgtgagccgtcgcgcccagtcctgaattctctcctatgctgacccctgctcctggtggtactggggacacagctctgactaagacagccccaaccctgttctcacagaggctcacagtccagtgggggagacagaactgtccccagacagtgacaacccagagtgggcagggctgggatggaggaattcaaagggggcgcctggctcagcttcaggatcagggagagcttcctggaagaggggacatggtagctgagacctgaacaacataggggtgagccagggggagcagcatgtgaaaagtttttgaaattggggcacagaaggaaggtcaggtgggtctagaatagaggaagtgagagaggatggatgattcaacaggcggcttagaaaactctggaactgttacttagggtatgaggggcagcttggcattgcaagaaagagatcgtgactcactcagctgcctcgttttgctgccctgcttccgtcttgctcctgctacaggcagtcacaaagtatctgccctgataaagcataaggccgagccagctggctctggagccagagtgcatgggttcaaatcctgactccccgacttgctaactgggtggcctcagcaggtcagctcccctctctagggactactttcctcagctctaaaatggagatgatgcccaggcacactggctcacatctgtaatcccagcactttgggaggctaaggtgggaggatcacttgagcccaggagttcaagaccagcctgggcaacatagtgagaccccatctcaattaaaataaaataataaagcagagtagatgatgatgcttttgtctcctaggaagctctgtggttatgagcacttgacctcagtgtgccaggccatctgtcacccttgcttgtggcaccatttacaagcactaggctagctggctgcctgggctggcaagacagtcctttacatcccagccatggttcattgggaaaaatttgtcacccttgcatgcttccgtgtgctccatctgcagactgggagaaatcacagactccccgcacaagacggttgtgaggatcgaatgagtgagtgccaggaaagtgctcagagcaatgcctggcacagcgtaagccatcaacaaatgtgaattcccactggatgtcatgactgccctgcatcataatctcactgcagccctgtgagggggtacgcattcattcactctgttactgctgtggactgaatgtttgtctctctgtcattcagatgttgaagaaatcctgatcctgcacgtgatggttttaggaggcagaaactttgggaggtaatcaggtccctcccaatgggattagtgctcttataaaagggacctcagagagctctcttgttcactttccaccacgtggggaatgcaacaagaagacagcagtctgtcacccaagaagagagcccccaccagaacctgacaaagctaccaccctcatataggccttccagcctccagaactgcatgaaatagctttctgttctttacaaatcacccattctgtggtctgttctagcagcccgaactgaccgagagccactcaacatatatttcgtgagtgtctactgtgcctgttctaggtgctggggacatagcaggtaatgagaccatcagacgaggccaggtgcagtggctcatgcccataaatccaacactttgggaggccaaggtgggatgattgcttgagcccaggagtttgagaccagcctgggcacccctctctacaaaaaaattaaaataaaaaaaataggcatagtggtgcgtatctgtggttgcagctactcaggaggctgaagagggaggattgcttgggtctgggagttcgaggctgcagtgagccatgatcgcaccgctgcactccagcctgggtgatggagcaagactctgaaaaaaaaaaaagaaaaagaaagaaagaaagagaaagaaaggaaagaaagaaagaaagaaagaaagaaagaaagaaagaaagaaagaaagaaagaaagaaagaaagagaaaagaaagaaaggagggagggagggaaggaaggaaggaagaaaggaaggagaaaaaaaaaagagtggggtaaggaatatgattattccatcccatagttaaaaacactgaagctcacagaggtgagatgacttggataaagtcacaggacatctcaggccctggccctcaacctccatgtgcgtgtgcctttttccaagggcccttcgctattccccagccacacctttctgtacacccagatcaatgaacaccaatgtggccacatcaccccgccacgccttcagactctatgggtccctgtactgaaggcgcctgacccagaccagcccagcattcaaggcctctgccacccacctcgttcttcccagaatgtctgaaccttctgaccacccaccttctcctaagccagcttccctccccaccacctctgccctgaggcactctcccctcttcccctcctccccatccaagacaacagagctgctgctggaatggacttcccaaatctgccccttcatgcaaaagcagggtttcctctcctgaaattcccaccaactcacccactcagcccccagggcagattctgttttttgctgccccaaggaaagaaagggactttctgggcccctccctgtagcacaacttccaattatttccaacaggtgaaaataaaccaggtcctctccacttcccacccttacctaccaggtctcagccatgcaggctggctcaaaattgtgtcttcccatgggactgacctcccagcccaggatgctgccctatgactgtgccctcactgaggccattcactcagcaaagatttgtatggccctactatgtgccaggcactgtttcaggtatcagggcacgccagcaaatgaaacaaacagagatctctgcctttatagaaatgacatgtaatgagtgctgggaggggaggagggagacagataataattgagatacgtggaaaataaccggctgggcacagtggctcatgcctgtaatctcgacatttcgggaggctgaggcaggaggatcacttgaacccaggagtttaagaccagcctgggcaatgtagcaagatcccatctcaaagtaaataaataaatgtgcttttttaaacatttaaaaacatgaaaatattaaaattaattttttttttaaaaaattagaaaacgtagccagccacagtggctcatgcctgtaatcccagcactttgggaagctgaggtggaagaatcacttgagcccaggagttcaagaccagcctggacaacatagggagatccccatctctacataagatcaaagttagctgggtatggtggtgtgtgcctgtactcccagctactcagaaggctgaggcaggaggatcactgcctggagtttaagaccagcctgggcaacatagcaggatctcacctcaaagtaaataaataaatgcttttaaaaaatttaagaatgcagaaacattaaaaataaaaaaataataattaggaaatgtggccaggcacagtggctcatgactgtaatcccagcactttgggaggttgaggtgggagaattgcttgaacccaggagttcaagaccagcctgggcaacataaggagaacccatttcaacacaagatcaaaaagttagctgggtatggtgatgtgtgcctgtactcccagctactagggaggatgaggcaggaggatcacttgagcccaggagtttgaggctgcagtgagctataatcatgccactgcactccagcctgggtgacagagtagctgggattttgtctctaatataaataaatgaataaataagtggaaaattactaaactatctatgatgttggaaagtgatgtgtgccatgggggatgagggcaggcagcgtcagagtgccagagtgggcacgcaggattcaatgctaaagcaggcagtctgggtagccccatggagttttaagcaacgacttgaaggaggtgagagggcaaaatgtacatacatttggaggtttctaagaattaattcacttctgaaaaaaaaaaaatgcaggcagagtcccaaggagccattccctgcctcctgcatttaaataactgagttttctatctgctgccacaataaatgcctccagacttggcagcttaaaacaacataagtttatccttttgcagttctgtagatagaagtccaggatggctaaatgacttctctgctctgggctttatggagctaaaataaaggtgttggcagctgagctcttaatgggggagctttgggaagaatctgcttccaagctgtcattcaggctgtggttggcagaatcaaactccttggtattataaagctggaaacctgtttctgcgatggttgccagctgagggctgcccttagctctggaggcctctctcctgtccttgcctttgagcctgtacatctcagagccagcaacgccacaacaaatccttctcgggcttgggatctctctggattccctgtctgctgcatctcttcacaattttttttttctttttagagacagggtctccctctgtcgcccaagcagtggtgcaatcatagctcactgcagccttgaactcctgggctgaagaaatcctcctgccttggcctccaaaagcactgggattacaggcatgagccactgcaccaggccctctgtctgccgtgtctctcttctgcttccagctggggaaagttatctgctttgaagggcttgggtgattaggttggacccaccttgataatccaggataatctccttattttgaagtttgtaactgtattagtccgttttcacactgctgataaactgagcagcttacaaaagaaagagatttaatggacttacagttccacatgacgggggaggcctcacaatcatggcagaaggcaaggaggagcaagtcacatcttacgtgggtggcagcaggcaaagagagagcttgtacagggaaactcccccttataaaaccatcagatctcatgagacttattcactctcaggagaacagcacaggaaagacctgcccccctgattcaattacctcccaccaggtccctcccacaatacatgggaattcagatgagatttgggtggggaccacaaaacctaaccacatcagtaaccttaattacatctgcaaagtcattttgcttttgtaatgtaacatattcacaggtttgttcattttttatggctgagtagtatttcatggtgaatatatatcacaggttccaggaactaggatgtgggcacctttggtggggggtcactattctgcctaccataatgacatgatgtgaaagcaggaatgtctagagttcaggcagccattctgagaccatgaagtagcaagttcagcaggatatgcaatgcactgagggtggagggatggatgagaggatatcactgagccatagaataaacctagggcatcttgcaaaatgacaattatgatttttgccgctgtgatccaggttgtcttttgtttgcagctgaatgcattctacctggctcctttccagatcaccattggaagtgtttattggaagaccttgcatcaaaaccctgatctttcagaaacatagagtttgtagtagtgttctttttcttaaagtgtgctaaaacttgtaaaatcgactttgagaaagagcctactcaaaattactcttctgtttaaacagagattccagtctaagctcccttttatcccatatggggaaactagggcccagagggtacagtgaagtttttctccagggtcatagaactgagtcttcttggaacatctgggaaactcagttttgtaccattgactttttgtgcttttcctgtgtacaagaagcaagatcagtataaatgggaaaataaataatgcagatccaggtaatagaatcccaacatctcatacccaagaacccctacacacacacacacacatgcacacacaacacatcatcatcatcgttgtcgtcatcgtcatcctcatcatcaccatcattatcctgccccctgcagcctctacaccatacttgtttccatgactccttaaattcctagaatggcacagaaaacagacaaaagattagctcacagatgctattttattaaactcatgatgcccactgacatagaaagggacatatgttttctgagtcatggttcaaaggagtaaactttcccagaagcttctccagctgagatatcctcccctcaccaatataacaatttcactaacactctcccacttctacccactctgtcatcataagcatccacatcccactctacccagtcagagctatgacttcttcttctagaacttgggacaccaccaattagagagtaaaatactttggatcttccaagtaacctgcaggatacttttttttcttttttttttttttgagacggagtttcactctgttacccaggctggagtgcagtggcacgatctcaagtcactgcaacctccacctcccaggttcgagtaattctcctgcctcagcctcctcagtagctggaattacaggcacccacgaccacacccgactaatgttttgtatttttagtagagatggggtttcaccatgttggccaggctggtctcgaactcctgacctcaggtgatccacccaccttggcctcccaaagtgctgggattataggcgtgagccaccgtgcccagccacctgcaggatacttttaagttcacctcaagatcgtgcattaacaattttgtaaggtgcttagctcttgtctcactactaggaagaaaagagtgtccaatcttgcattatcaagccagccatgaaaattccatttaagggagatggtggggacaaagaagcatggatgagggtcagacagagttctgtggtaggaaagtgagaggctcccaggagctgaaggatgttagagatcaactgatgacatgaggatattagctaatgctgccaaggactctgtacagactcctcagcctcccaggtagctgggattacagacacatgccacggcacccagctaattttttttgtagcgtttcagaggggagtctctctatgttgcccatgctggtctcgaacttgtggcctcaagcaatcctcccatctcagcctcccaaagcactgggattataggtgtgagcaaccgtgcctagtctgaactgtgaattttttaatgcaaaagctgactgagctacttgagccacagcccttagagagttacacataatatgcaaagaaggaatgcaacataagaaagggtattctacatcataacacttctttttttttttaaattttttgagacagagtttcgctcttgctgcccaggccagagtgcagtggtgccatcttggctcaccgcaacctccacctccggggttcaagcaattcccctgcctcagcctcccgagtagctgggattacaggcatgtgccaccacacccagctaattttgtatttttagtagagacgggatttctccatgttgatcaggctggcctcaaactcccaacctcaggtgatctgcccgcctcggcctcccaaagtgctgggattacaggcgtgagccaccgcgcacagacaacacttcttaactggtggagtaaacgtgtggaggtggtctgtgaagctacaaggtaagtcctaatcatcatgcaatcccctgtctaaagcatttttgttttaaaaaaggaaagagattggggagtgattacaaccttctacctttcaatgaagatcacctcaaatctgttaaaatagctggctcagtgtctctttttggccttgggaggagttgaaatctctggtcagggtgttgaagactggtcacaatgcagttgacatctccatgcctctggaaaatatgaaaccttgctcaaccctacccaagaaagggactttctgttctggcctccatagccagaaacgcctctgcctcccccagctgtggaaggaatacttgattcccaactcagggtcagctgcccttactctctgctcaattcctcttttttctctgaaacaaaatatttgggcatctttctcgataccctcctttccctaaatcacctccaacatccaatcaatcaccaactcctaagggttccatctttgaaactcattaaccttcttttctgcccccttttctccatccgcatgaccttaccctaggcaatacctccatcttctctcgcctgtaaaactgctctgagttccccaaccctgacccccagcctccctgtcagtatacttaacccctccaacatgcccaccacaattctggccacctttccaaatcccagctctgaattagagtctctctctctcccctctaaacagagaggctcaaagaccctcagctgaccctacaagaagtctgggatgctgccattctttcctggtaaatcccctcccatgatcccttactgtccacagggtgaacatctaattcttcagtctggcatctgaagcttctgaagcatctggaggtaagtatttcatccttaccttgctgagctgaactccacaggattcctgggctggagagaaggaaagaagagttaagtcccaagaggcgagtggaaaaggtgtcttcctctgcagctaagccaatagcaggctgtcttcatcccaccttctgaaggagggaaagggggcaaaaagttgagatctctgcttcctaggcgagcccgaggtcccagagaaccctgaaggtagagcaaacctcgtgttatcatggtgaataatattggcgtccatcccaggaaactgagctaatgctctctgcccagatgtgcacagggatgacacaccacgagcgatcttggtcccatcccacccctattctgctccaggcttcaggtagcacagtggttaaggacccagactctacagtgagagagaaatgggttcaaagctcccccagctcctctgctcaccgtctatgtgacctcgagcatgagacagagcctctttaagccccagtttcttcttctgcataataggtgtaaccctagctcctccctcctcgatgaaatgaggagacgctgaatgcagtggctcagcagagggtgaaatacagcaagcccacaggaaatggggctgcagtcatttgtctttgcacaactggtagtaggatggagagtggacgctcaaagataccaggtcctaacccttgcaacctgtaaatgttacgtcataaggaaacaaggtttttgcagatacaattaaggatcatgagatgaggaggtcatctagatgatgcgagtggacagtaaatgtcatcatgagtttcctcattaaagagtagagggagattggacacccacagaggagaaggcaatgtgaagagaagcagaaggtgacccggacacaagtcacagaatgccaccagccagcagaaacatgactgcagcagacccagggtcccacgcccagaaacctccagaacacctcaagggaattgtaaaccagcaagagatagctttacatttttttttttttttttttttgagacagggtctcactctgttgcccaggctggaatactgtggcatgatcatggctcacagcagcctcaaactcctgggcccaagcgattcgcccatctcagcctcttgagtagctgggaccacaggcatgtgccaccacatccaactaattttttgtatttttggtagagacagtttcaccatgttgcccaggctggtctcgaactcgtgagctcaagtgatccacttgcctcagcttcccaaaatgctgggattacagtagtaagcctctgtgcccaacctaggtagtgatatttatgattagccatgccataattataatatgatattatacctagggtttagcggacactatataaatgttagttgtaactaataatggttattttaacaatattattaatagacaaatttagttaccatttacatatacagacattagctaagtcctgatgatgccggtgaattgtctccacaactataaggtaatggctacctttatccccatttcacaggtgaggaaactaaggcaatagtggttaggacacccttccaaggttgccactgcgaggagctggtgacagaggggtttgaattcacttccatctgactcaagagcccaggatcgaactcaggacaaatgggtggtgccccagcgccagtgctgactgccagttcctgagcaggttcttcccctgcaggcccacccactggtcctcagtgcccctggtccctgccagtgaagtttgcagctcccagataagtagccccctctgggatccccactcagtcctggctccgtgacctctgaggggcccagagctggtacctgggaccttatgaccccaacacagtagccagcagtccctgtgagcaccacgctgatcaggacactcgaggcaatccctgcgatgcctccagcaggaatagtggtcctgagtaaggccggctgcagttcatccccaggaacctctgcaggaaagagagagagaaggagaaagagagagatagaaagagagagagggagggagaggaagagagaggtgtcagtgctggggctctgggtttcaggtcctcagagctgttccctccatgtgctcaattcgaaccctcctctccccccattttacagattgggaaactgaggcccagggaaaggaagcgtctgtaccagataataaatataacactcacagatgacaggaataatgtctggtaaactatattatctcatttattcctcaagacaaccctatgaggaaggcattgttaatatccccattaaagaaacaggcactgagaagttaaactacccatccaccatcacacatggggtagagttagaatttgaaacatgttgatgccagagcttacactctgaacctctgcactatgtggcctctgaggatcacattcatccattcctcattcaacgaacatttatttagcacatactgtgtgtgccagacacctttttaggcactcgagggatattgcagaaaacagaacagacaaaattcctgatgtcctagagcttacactttaggagggaactgagacataaaacacacaatgagggccaggtgtggtggttcacgcctgtaatcccaacactttgggagtccgaggcaggcggatcacgaggtcaggagatcgagaccatcctggctaacacagtgaaaccctgtctttactaaaaatacaaaaaattagccgggcatggtggcacgtgcctgtagtcccagctactcaagagactgaggcaagagaatcatttgaacccaggaggcggaggttgcagtgggtcaagattgtgccaccgcactccaccctgggcgacagagtgagactctgtcaacacacacacacacacacacacacacacacacacacacacacacaatggagcaaatatataaagtgatgacaagcattataaaggagtagaataagatgctattcgaggatctcacaggaggaccagacttagtctggggaaatcagggaacgcatcctggaggaagtgacatttaagctgagatccaaaagacaagtccaagatcagctggtagaggggttagtctcctgagcaaagtggccagcattcattcattcattcatttattcattcagcaagctgttctaggcactgatgatacagcagtcaacacaacagacaaggtctcaaccgtcacagatctggccacctggatggagagattgatgataaataattaggccctaataataattagggcctggcatggtggctcacacctgtaatcccagcactttgggtggccaaggccagtggatcacctgaggtcaggagttcaagaccagcctgaccaatatgacaaaaccccgtctctattaaaaaacatacagccaagttcagaaggaccacccaactgacctgcagacttacaagctgtaacaaattcttattgtcttgagccactgggtcttggcagggggggcattttatgcagctttgttgaggtactatatgattgacccaagccccagaacccacttatatcaggcaagagactctgagccattatcaccatggcatctcaacacccacctgagatccagatcttcccattgactgagctgcagaggtgagtgatgctgttggaggcctcacaggtgtacctgccctactggtccagagtgacctcagaaatgaccaggtgctgggtggcagggcctggccttctgtccatctcccagtggtactgggcaggggggtttgagtcagcaaagcaggacagggtgagggctgccccagctgtgacctctgggtctggagggttgaccataggagggtctgggccatctgcagagaattgagaagaccaggccagagggaagaggaaaggcctttgtccatattacaatgcattggccattgtctcagatgacactcttccatccccctccagtgcacaactgcatttgacactgttggccatctcccttctagttgctttcttgtcccctaccaccaccaccacctccccataccatattctctacttctactgtgcagctagaggtatccttttcaaagcttgttcaaacctgcgtcacatcatgtcccttctctgcacaaacccttctttggctgctgtctcatgcagggtaaaagccaaagccctcatcatggcccacaggccctgcacagtctgtcccattacctctcttggggcaagacagtcctcttcttcctcactctccttcttccctttacttcagccactatgacctcctctctcaaaaccacactcccaccccaggcttggcatttgcagtctcccttccacaaaatctccccttggtgccctctctcactttgtccaggacagacacttccagctttgccaacagaaccagctaaacttcagccgctccttcacccctcaaccacactcctatgcacatctccacccatcctttatcaggtcctggactcacatgtaactttgatgagagtggggttgctgatgctgctggtggctgagttccagctctcacactggtagacccccgtgtcattcctggtgatgttcgacagagtcagtgttctgcagtccagggacagctccctgtggccaccaatgaagagcttctggccattgacatcccggcggatggccacagtgctccttggaggaaggcaatgcagactgatggaatccacatgctccactggggctaagttactggctgtgacattgggctgaggaagtgtctctgcaggaaaattagaaagaggtagaaatgctgagtcctgcccagatcatgggcttagagaagaacacccttagggaacacccttagggctgaaggaattcagcacacttgccaatcatccatccatgcacctgtccataagtccatctactctccaccaactcagcctttcctacattcattcacccaattgttcactcgtccagtcacccttctatttatccatccaccaatttgtccctcaatccacccatctatccatccgtcatccatccatccatccatccatccatccatccatccatccatcctatccataaatctaccttcccatctacctacccacccagggatgcatacatgcacccatcttctcaatcattcaccatttttttcacccattcgtccacccaatcatcttttccaatcacttaccacccacctaaattcgctcatccatctatcccttcatttacccaatcacctattcattcatcacccaatcacctattcattcatccaccaatccatccattgatcttcccttctgtctgtttacttaataaattaacacttctggagcaccaaatatgccccaggctttgtgctaaatgctttacagacacaatcttatatcctcatgcttatatttcaagagaagggtggattttaacccatttcacaggtgataaaactgagcaaacaataagaagaaccttcatcaattgagtacttaatctgtcgtagatgttttatgtgtgtgattcattagacttcacaacaaccctgtaaatccccatttgcaaaatgaagaacctgaggctcagggatgatccatgactaacccaagatgaggacactgatccatgggggcaaatgggattcacgctgcccatctgcctgcctctttcctttctcgctgacctgcattacacccagggtgatcgcccacacagctgagttgtaccctctgtagctcctacgaatcacctggatgttgagatgcactgtgctataacatccttttattctcctaagtcataatcacaccatacaaataagaaaaggatctcagaagggtaaccattgaaagcaaaaattttcatccctaaataacttttataccaatatttttaaaaatttggagcaagatagcacaactcttctttataaaggaaaatacgtatgcagtaatttataagaaatagatactggaggccaggcactgtggctcgtacctgtaatcccagcactttgggaagccaaggcaggcggatcacctgaggtcaggagttcgagagcagcctggccaacatggcaaaaccccgtctctactaaaaacacaaaaattagccagatgtgctggtgcacgcttgttatcccaggcggctgaggcagaagaatcacttgaacccaggaggcagaggttgcagtgagccaagatcatgccattgcactccagcctgggtgacggagtgagactttgtcttaaaaaaaaaaaaaaaaaaaaaagagagagagaaggaaaaaaaaaaagaaataggtactgggaatgaacctgtaagagggtataataaaatattagcagtggtcatttctgagaatgtagagtttttacccttttcctttttaaaaatatttgtattggtaatttctcttacactggatatacagtatgtattcaataaagaaataatcagaatgtaggatgtaatgtggctctatattaattaacagaaagacattaaagattaaaagatgaaatttaaaaacagtttaaacaataataagtatagtctaatactatttgttgtttaaaaatacatatatttggccggccacaatggctcacacctgtaatcctagcacttttggaggccaaggtggacggatcacttaagcccaagagtttgagaccagactgggcagcacagcaagaccctgtctctacaaaaaggacaaaaattagcccagcgtggtggcatgtgcctgtagtgccagctacttgggaggctgaggtgggaggatcaattgatcccaggaggttgaggctacagtgagcaaagatcaaaccactgcactccagcctggcagacagagtgagaccctgtctcaaaaaaaaaaaaaaaaaaaaaaagaagaccacacacatatatttgaatgtatatacaaaaacagaggaattatagaagccctgtggctttttctgggaggcttactgtggaaaacattttttgccttcttgcccatctatatgatttactttttctacaattattgtgaaatttatttaaaatgtgaaaaaggtggcatataatatttttaaagcaatcctatcaatgaaaagtcattttgttggttaaagaatgtaaaaatttattctgcataacacaggttagaaaaatcttgctgaatatataaagaagtgaaacagcaaagaaaagaattctaaaaaacaaaaccaaacccaaattcgccaatgaagtcctggggcagagaagaatttttctcttatttttttctttttcttttttttttctttgattttgaagatttcaccattaaccaataaccctcaaccctggcttcatacctgagacagtgatgatggtgtccatactgctgtgcaagccggaaagggagttggaggccttgcaggtgtagacccctgagtgtgccctggagagactgggcatgaagagggtctggccctcccatgtggtgaccccactgaagctccatgtgtactgggcaaggaggtgggagtaggctaagcagaccagagtgaggttggaaccaatcacaaaatctgggtccagtgcggtcacgatgggggtatccgggccatctgaacaaggagaaagacttcctaattaggaagagtatgagaagtaaggaccacccccctagattgtgcatttcagctcagtgttggaagcctgacatgttgagggaggcacacagcaccacaacgtaaaagtttgtcagaggaaggaagggagggaggggaggaagggagggagggagggagggagggaggaaggaaggaaggaaggaaggaaggaaggaaggaaggaaagaacaaacgaaccatggctggcggtagcctccctcttgtgtctattaccctccttgatctttgaagactgtcagctccatgaggacagggatatgcttgtcagttatgttaactgctttgactagaaataacacccaatacacacagcacacagtggatgctcagtagatgctttcccaaaagtagagagacagaggggcagagagagaaaaacacatgggttcaagttcttatctttcttcttgaccacggtgagatcttgggtgagcccttcccctttcttaatctcagttttcttgtttgtaaaatgtggtgtctctgaaagtccttccagttctgcaaatatttatgttgtcgagtctggaatttctgggatcttggcttcctacaatctccatctacctttgtacctgagattgaatgggtctgaaagtccttaattgggtacatagtagaaactcaatacatgccccttaaataaataaatgatgataaacttctgagagaatagtcattgtaaacgtctattaagcacttagtgtgcagagtagtggaaaagaataaagaaaaaaagagaaaaaaaagaagcacttgctatgttccaggcactattctaagttccttaaatgaactaactcacttaatcctcataatcacccaatgagatagataatattatgattctcactttgcagatgagaaaactgaggacatagaaaagtgaagtgacttgcccaaggacacctagctaagaaatagcagggacggctgggcgcagaggctcacgcctgtaattctagcactttgggaggctgaggcaggaggattgcttgagcttaggagttcaagactaggctgggcaacatagtgagactttgtctctaccaaaacttgtaaaaattagccaggcatagaggcatgtgcctgcgatcccagctactccggtggctgaggcaggaggattgcttgagcccagaagggcaaggctgcagtgagctatgatccagccactgcactccagcctggacaacagagtgagaccatgactcaataaataaataaataaaaggaacagaagcactaggatttgaaccaaggcagtctgtagagtctctgatttaaacgctaagctataaatcatggatgaaccagtagatagttgggctggaggttctgtgtggatcagaggtgagtcagagcaaagaaacccagacttacaagccacgccaaccacgagggcttcactgagcctggatcccaggtggttcctggcctcacagtggtaggtgctggagtcattgcgtgtgactgtggggatggtgaggaccctgccatctctggagattactggtccatccccttcctgaatcacctcaaggttcagaaaccactggaatgtcctgtcattgtttggagaaatgcatgtcaaattcaaggagtctgtgtgctccagaggggccaagttctgggcttccaccgggggctggtgcagcttctctggggagaaggaaagagaaagaatggcgttataggacatgggaggatctggaaccctaggaatgatcagcagcacgaataggctggggaccttggaaacaccagtgttggctttgctgtttccaagatgaccaataagcacacacacacacacacacacacacacacacacacacacacacagccaacagctctacttccggaagttcttaactgtctagagatcccagatcctctccccagaaatacacccaataacacacacaccacacaaatacctacacatttgtatataatttcaaggggttatggggcactctaaagaccaactttagatttcaagtgaggaatcttatacctagattacaaattagtaaatatctttcttttttgagacagggtcttgttctgttgcccaggcttcagtgcagtggcactaacacggctcaccatagtctcaacctcccaggcacaagcgatcctcccgcctcagcctcctgagtagctgagatccatgcatgtcaccatcctcagctacttttgaaaaacttttgtagggtggggtcttgctgtgctgcccaggctggtctcaaactcctgggctcaagtgatcctcctgtcttgacctcccaaagtgctggcatgacaggaagtaaatatctttcttgaagtcaacttagaaatacaagttgaaagttacacatgtttatataacttttgacccaatgattacacttttaaaaacagttttattgaggtataataagcaaataaaaatgttgtatgttcaaagtgtacaacttgatgttttgatagttgatctctacaatcaagctaattaatatatccatcaccggctgggtgtggtggctcaggcctgtaatcccagctctttgggaggctgaggaaggtggatcacctgaggtcaggagtttgagaccagcttggccaacatggtgaaaccccgtctctactaaaaaatacaaaaattagccaggtgtggtggcacgcacttgtaattccagctacttgggaggctgaggtgggaggatctcttgaacctggatggtgggggttgcagtgagccgagatcataccacgacactccagcatggacaacagagtgagactccatctcaaaaaaatgaaaaaaaaaaaaaggaagaaaggaaaaaaaactgctggatgcttgcttgcattgcttccattgcttgcactgcaagcattatctcatgtactactggtaccaccctgtgctgtaaggactattaatatcccattttacaacaggtaaactgaggtttatgttgggtaagtgagttgtgaaaaaccaagttgtaagtgggtgaatcatttttaaactcagggctatgtgactccaaacttcataaccactgtgaaataaatactatgtagaaaaatctatttttaaaaaatctcagaaaatgaagcaggcacagttttccctattccatcccgagcacagttaaaaaccttggatattatcacttctacactgctggtgggaatgtaaactagtacagccgttatgaaaaacagtgtggagattccttaaacaactaaaagtagaactaccatttgatccagcagtcccactactgggtatctacccagaggaaaagaagtcattacacaaaaaagatactcgcacacgcatgtttatagcagcacaattcacaattgcaaaatcgtggcaccaacccaaatacccatcaatcaacaagtggataaagaaactgtgatatatatatatatgttcatatatacgttcatatatatatgttcatatatacgttcatatatacgttcatatatacgttcatatatacgttcatatatatacgttcatatatgcgttcatatatgcgttcatatatatacgttcatatatgcgttcatatatatgcgttcatatatatacgttcatatatatacgttcatatatacgttcatatatatacgttcatatatgcgtttatatatacgttcatatatgcgttcatatatatacgttcatttatgcgttcatatatacgcgttcatatatacgcgttcatatatacgcgttcatatatacgttcatatatacgcgttcatatatacgttcatatatatacgttcatatatacgttcatatatatacgttcatatatatacgttcatatatatacgttcatatatacgttcatatatacgttcatatatacgttcatatatatgttcatatatacgttcatatatatgttcatatatatatatatatatatatatgaatgatggaatactactcggtcataaaaaggaatgaattaacaacatttgcaatgacctggatgagactggagactattattctaagtgaagtaactcaggaatggaaaaccaaacatcatatgttctcactgatatgtgggagctaagctatgaggacacaaaagcgtaagaatgatacaatggactttggggacttggggtgaagagtgggaggggagtgagggatgaaagactacaaatagggtggagtgtataccgctcaggtgatgggtgcaccaaaatctcacaaatcacccccaaagaacttactcatgtaaccaaaccgacctgtaccccaataatctatggaaaaataaataaaataaaataaagcaatagagaaaaagcctcaaaaatatgaacagaacatcattgttctatgggaataatatcaagcagtctatcacaggtgcagctaaagaataaataaataaataaataaataaataaataaataaataaataaaaatagatgactcggaaaggaggagagaatatggcagactggctgcggatctcaagaccggagaaagcacatggtggtgagttttctggactttctttgcgcctcacagatcccagactgggagctggagagcctggcaatctagaaatgccaatgagtgtagatccaaaagaggctcaagcaaagcctgctctagccaaaggacaaggagcagtagcctgacaagatttgctaaagacagcaaatctttacaagataatcactttgctgctgtgatatcccacagaaaagcctggacatttacccttgccagctgtacagagacacccatcccctccaccaggctgaataagcagctgggactgtcatccttgcccagcagtaatgagcaccgaccctgcagtgtccattgaggccactagggagcggtaacgaggcgtctctgccccttctgggcaagatggtatcagaggatgtctcagtggaaagcctgaactctgctaactgcccagagtaacagttgccccgccccacctggaatgtcaacagaggccaaatggggaacctggacctccatccccactggctataacaagatggtgccctttttgccccaccagcaagatgtcagaggagacctgctataacagaagatttaaatgagatccagcgtctcataatttccaaaatgtccagggtgttgttgaaaatcacttgtcatacacctacatgtaatcccaatactttgggaggccgaggtgggagaattgcttgagctcagaagttcgagaccagcgtgggcaacatagtgagaccccatctctacaaaaaaaaaaaaaaaattgactgaatgagaaagacattcctgaaattaaatgaggaaagacaattaatagagatgacatggattgttgttgatgttttctaacttggtcttgagttttctaggggatttagttgtagatgtttaaagtgtaattttcactggttacttctttatcttggtggtcggcctaatgcctacatgtctgacctgtgaccaggtgtccctctcacagtacacttattttttgtgtgtttgtttgtttttgagacagagtctcactctgtcacccaggtcggagcgcagtggtatggtcttggctcactgcaacctccacctcccaggttcaagcaattctcatgcctcagcctcctgagtaggtgggattacagacatatgccactacacccaactaatttttttttttttttaagtacagacggggtttcaccatgttggccaggctgatcttgaactcctagcctcatgggatcctcccaccccaacctcccatagtgctgcgatcacaggcatgagccatcacacctggccacagtacacttgtttataatggcagacattcttaaggcttttgtctgacctgtgtccagtttatttctacaaagagagccatgctttaggacagccctgaccaggaaagacgttaggtttggatgtgtcagtcaggtgagacacagaggaggcagcacaacaaaacacatgaaataacaggggcagtttattactcacagattccggagaagacagagcagcacatctcacagagccaacaggaagaagagagttgtcgggacacgcacactcaaccagcgggtggggagcaagaaagagaaagtgagagacctgtgggctgatgcttttattggagtctaaggaaactgctcaggcagttttccacagagaattctaactgggtttagagccagcaggcacaagttgcatggagtcacactgactgggaggtgatcactgtggcatatctgcacagcctatgcagggtctgggggtcagggggacagtcaggtgagttatatctagctgttgcataaggaggtggttaacaggaagtggtagtgtaaggcaggtatctggatctgccacattaaggatctggggggaggcggagacctggaaactgtgtcaagggtgactaagcttttcttatggtatgagaaagtccaacttatattcaaaatagatactgagccaggcacagtggctcacatctgtaatcccaacactttgggaggctgaggcaagaggattgcttgagctcaggagtttgagaccagcctgggcaacatagtgagacctccgtctctacaaataaaatttcaaaaaattagctgggtgtggtggcatacgcctatagtcccagctacttgggggactgagatgagaggttcacttgagcccaggagctcgaggctgcagtgagccgtgattgcaccactgcactccagcctgggtgacagagtgcgaccctgtctcaaaacaataacatttcaaaaattgatactgagtttctataaaattgtaagaattcactacactgatgttagaattgtcttaaaagaatcttagagcagccaacataaaaatgcttcaatgaacaattacaaacacttgaaataagtgaaaaaccagaaagtctcagcaaagaaatagaagatatgaaaaagaacaagacggaaattttagaatggaaaagcacaataacagaaattttttaaaaacttaatgtttgagcccagctgcagaatggagatgacagagataaaaatcagtgcagataaaagttaccaaatctgaacaacagaaagaaaatagactgataagaagtgaagaacagaactttgggacctgtgggactttaacaaaagagccaacattcatgtcattggagacccagaaggaaaggaggaagtgggtataatggctggtttcccaaatctggtaaaagacatacatctatggaatcaagaaactgagtaaaccccaatgccagcgtggtaatcaggattctaaatatagtccttccagatttctgttcctgattgttcagtcaaatgctaatctaggtattgctttgaagggattttgtaattaaagctcaaagtcagctgatcttaaaatacagatcatctgggtgggcctgacctgatcaggtgagtcttttaaaagcagatcagatgagaaagtcagagaatcaaaacacaaggaggattcaatgcatccttgctgtctttgaagatgcaggggtcaatgtgtgagcagggtagagtggcctgcaagagcttagagcacccgcagatgacagccagcaaggaaacagacctcagtcctacaactgtaagaacctggattctggccaggcacagtggctcattcctgtaatcccagcactttgggaggccgaggcagatggatcacgaggtcagtagatcgagaccatcctggctaacatggtgaaaccccgtctctactaaaaatacaaaaaattagccaggcatgctggtgggtgccggagcttgcagtgagccgacatcgccccactgcactccagcctgggcgacagagcgagactccgtctcaaaaaaaaaaaaaaaaaaaaaaaaaagaaccaggattctgccaccatctgaatgagcttggatatgggttctttcccaaagcctacaggtaaaccccagccaactcacatcacaccttgattttgacctggtgagagaacccagttgaggacacttggacatctgaggtacagaaactgaaatagtaaatgttattcactctcttagttcacccagaatcagactctgcactagaatgtaagtgcaattagtttattatttatttatttacttttttggagatggagtctcgcactgtcgcctgccaccacgccaggctaattttttgtatttttagtagagacagggtttcaccatgttagccaggatggtctcgatctactcacctcgtgatccacctgcctcagcctcccaaagtgctgggattacaggcgtgagccaccacaccttagtgcaattagtttattttggagaaagcattggcagaggtgtgggaaagtaagtaagggaaaagaaggaagccatatagaaaaattagctctatagaaaactggagctcacctctgaaaactggtaaaaaacacacctctgagggccgggcgcagtggctcacgcctgtaatctcagcactttaggaggctgaggcaggcagatcacctgaggtcgggagtttgagaccagcctgaccaacatggagaaaccccctctctactaaaaatacaaaattagcccggcgtgctgtcacatgcctgtaatcccagctactcaggaggctgaggtgggagaatcacttgaacctgggaggcggaggttgcggtgagccaagatcgtgccattgcattccaacttgggcaacaagaacgaaactccatctcaaaacaaaacaacaacaacaaaaaataaaaccacctctgagttgttccccctaagttcaggggaatatatctaccaattccttcttggtgttagttaatggtcactcccaggatgttaatttctctgacattttcagcctgccctcagttggggcttgcatcctcttgtactcagagaaatcagagaggcacagacactcatggaaggggttgcggaagtactcaccactctctttcagtcatttcgagaatttctcttctttcatcattcagtcgtcctaaaagtcctgtgtgtcaataataaattacacccactgaaaggaagacgtatatttacatttcatggcctttcattttctattagtgtccccttcattccactccatcttattattagaatgattctaccagtgtctttctggaaaataggtgtaggaataaatttattctaaaaaataaaacaacatctacgcaaagaggtcttaaaaccttcataattagctctataaaacaattaactccaagaagtaatgctgaatgctttccaaatgcatactgacagtaagaaaacattatcaaatacccacatttgcattttttctagacatggttacagacctaaatccctcagttgatcagcttgagggaccaaataaatctctgttatcggtatagcaacagcacttacttgttttgtagcagtcagggcataccaaagtaagatcaaagaaaaaatagaatctcacgaaatatattttctcaaggtaaaccctcaccaaattataattgaatgattagtctggtataattttagtagaaaaattataggaaaaaaaagacaggacaaaatatgataattgagttggcaaagatcaactcctaagcagctaatttagtgttcaataaaacccaaaaatgcagaagcatgattttcccatttatagtatgttcacatactataaatgagttattttaaccaatttagaagtaagacctggccaggcatggtggcttacacctgtaatcccatcactttgggcggcaagacaggtggattgcttgaggccaggagttcgagaccagcctggccgacatggccaaaccccgtctcttactaaaaatatcaaaattagctgggcggggtggtgcatacctgtaatttcacctcctcagaaggctgaagcatgaaaatcatttgagcctggaggcagagattgcagtgagctgagattgcaccactgcactccagcctaggcaacagagggagactctctcaaaaaaaaaaaaataggctgggcacggtggctcacgcctgtaatcccagcactttgagaggtcaaggcgggtaaggtgggtagatcacaaggtcaggagttcgagaccagcctggccaatatagtgaaacccgtctctactaaaaataaaaaaatcagtcaggcatggtggtgtgtgcctgtaatcccggctactcagtaggctgaggcaagaaaattgcttgaacccgggaggcggaggttgtagtgagcagagatcctgccactgcactccagcctgagcgacagagcaagactctatctcaaaaaaaaaaaaggaagtgagacataagtattgtattgtatcatgataaagcaattatttggcattacaccttaatgaattttatccagtcaatttgcctttgtagacacagagtgattcatgtaatatgatatgtagcataatcaagtttaatctctgtaataatggttgtttatctgtaggctatagttgtaaaagaagaataaataaataaagcaatctatcaatcttgatcaaacaatgtagcccacagttgattcagatgttacaataatgtagttggtacaactcactgggcagcatataccatgagcactaatgaaaaataaaaatcatggcaaggcgcgatggctcatgcctgtaatcccagcacattgagaggcagaggtgggcagatcacctgaggtcaggagttcgagaccaagctggccaacatggcgaaatcccatctctactaaaaaatacaaaaattagccaggcacagtggctcatgcctgtaatcccagctacaggggaggctgaggcagaagagtcgcttgaacccaggaggcaaaggctgcagtgagccgagatcgtgccactgcactccagcctgggcagtagattgagactctgtctcaaaaaaaaaaatgaaaaatgaaaaatgaaaagcaactgcatgaaagtcaattcagtttatgcctagccttcattaaagaccaacaagaaaaaataacaaaaaaaaacaaaaaataaatgtttcagtgaaaatctcatttgggctctcatctacaggacagagtgtagatggaaaatacatgtttgatgtaataactgatcttgtgatatacctttatgattgtaaatagttgatatattaagaaataatagtaaaataaatgttattttaagcctccaaatttgtgataattttgttaggcagcaataaataataaaaaaaaaaactaatacacccaaacagaataaacccaaatgaatctatgccagggcatatcataatcaaactgttgaaagctaaagatgaatttaaaatcttgaaagcagtgaaagacaaatgataccttacccataggaagaaaacaatttcaatgaaagtagatttctcatcagaaactatgaaagccagaagaaagaagcataacattttataagttctaaagaactgtcaacccaggattctataaccagcgaatgaaaaagatgtacatttatatgtatacatataaaatatgtatatatgtatataaatgtatatacatttataggtatacatataaaatatgtatatatgtatataaatgtatatacatttataggtatacatataaaatatgtatatatgtatataaatgtatatacatttataggtatacatataaaatatgtatatatgtatataaatgtatatacaattatatgtatatattatgtatataaccattcaagaatgagagagatgtacattttaaaataattaaaagaggccgggtggggtgactcactcctataatcccagcactttgagaggctgaggcggacagatcacttgcggtcaggagttcgagaccagcctggccaacatggcaaaaccccatctctactaaaaacacaaaaattaggcaggcttggaggctgaggcaggagaattgcctgaacccaggaggcggaagtgcagtgagccaagattgcgccactgcactccagcctgggtaacagagcaagactccatctcaaaaaataaataaaataaaataaaataactaaaagagttattgaattgtaattgcatttggattggaaattggatctaattgtaaattggatccaagagtaactggattgtttgtaatacaaatgataaatgcttaagggaatgagcaccccgttctctatgatgtgattattccacattgcatgcctgtatcgaaacatctcatgtaccccataaatatatacacctactatgtacccataaaaattaaaataaacaaatttttaaaaataaaataaaaaagaattcaggaaaaaccaacacattctcagatgaaggaaaactaagagaatttgttgccagcagacctaccctaaaagaatagagaaagggagttattaaaacagaaaagaatggtaaaagaagggaatctggaacatcaggagaaaagaaagatagagaaggaagaaaagaaaaggagaaagagggagggaggagaggacagaaaaaggggagaggggagaggaaggggttttctttttcttcttgagttttctttccctttttttccagaggatcttcacacctctaactgaattttctaaattacatttaatagttaaagtaaaaattgtaacactgtctgatgtgattctcaatgtatgtaaagaaaatattaagacaataatattataaatgattataaatgggagaagataatggtattaaagggaggtaaggttttttttgttttttttttttttaactgtgtcttgttctgttgcccaggctggagtgcagtggcacgatctcagctcactacaacctctgcttcccgggttcaagagattctcgtgcctcagcctcctaagtagctgggactacaggcacgcgccaccatgcccagctaatttttgtatttttagtagagacggggtttcaccatgttggccaggctggtctggaacctcctggcctcaagtggtccgcctgcctcgatctcccaatgtgctgggattacacgtgtgagccactgtgctgggcctggccctgaggtaaggcttctatattttgtttgaactggtaaaacgtcaaaaccaataggctgtgataaactctatacataatacctacagccattgctaagaagtctatacaaagagacacactcaaaaacattacagataaataaagtgagattctaaaaaaatattgatgtgacccataagtaggcaggaaaaaggaaacagaaaaacaaaaaaccaaaaaacaaacagaagacaaaaaaaatgaattggcagacctaagtcctaacataacaataattacattaaatttaatagcctaaatataccaattaatggatttatatttacagactgtattttttaaatgagccagttaaatgatagccacaacaaaattacttcaaatattatcatacacataggttgaaaaggattaaaaaaaagatatactatgtcaatattaataaaaggaaagcaagaatggttatagtagcatcagataaagaacaaagcaaagataattagcagggacggaaaggaacataatgatagtagagtcgctccaccaaaaagatgtggcaatctcaaatgtgtacacaccaaacaacggaactacagaatatgcgaaggaaaaatggacagaactgaaatgagaaacgcataaactgacaattacagtttgggacatcagcactactctcaactattgttagaacaactagacaaaaaaaaaaatcagcaaggatagaagaattcaacaccaccagcaatcaaggtctaattgacattgacaggacatttaatccaacaacagcgaaatacacattctttccaaacattcacagaacatatactaaaataaaccatgtcctgggctagagaacctcaacaaacttgaaagaattgaaaccatacagggtgttctctgaccacagtggaatccaactagaaataactaacaggaagataagaacaaaatctccagatacttggaagctgaacactacacttttaactaagccacaggtcaaagaaaaagtcttgggggaaaacaaaaatacattgaactgaatgaaaaagaaaacacaacacatcaaattttgtaggatggaactaaagcggtgcttcgagagaagtttatagcacaaaaatgcttacagtagacaagagggaaagtatcaaattggtcatctaagctcccaactcaagatattagggaaaaaaaaaaaaaagaaacccaaatcaaacagaagaaataaaatagcaaatggcaaaaatcaataaaattgaatagagaaaaccaacaaagcaaaaagttggttctggccagtcacggtggctcacacctgtagtcccagctagtcgggaggccgaggcaggaggatcacttaagcctgggaaactgaggctgcagtgagcagtgattgcaccactgcactccagcctgggtaacagagtaagatcccctccccctaaaaaagatggttcttacaaacaatcaaaattgatgaacctctaccattattgagaaagaaaataatgaaattacttatcaccaatttatcagaaaattaatcaccagtgtcaggaaagaaacagtggatatcattacaagccttgctgacaacaaaatgataataaaggattgaaacaaaacagctctacacacataaatttgataatttacataaaaagaactaattcctcaaaaaagcaaaaactactgtgtccggacttggtgggttcttggtctcactgacttcaagaatgtagccgtggaccctcgaggtgagtgtttcggctcttaaggtggcgtgtctggagtctgtcccttctgatgttcagatgtgttcggagtttcttccttctggtgggttcctggtctcgctggctcaggagtaaagctgcagaccttcgcagtgagtgttacagctcttaaggcagcgcgtctggagttgttcgttcctctcggtgggctcgtggtctggcttggctcaggagtgaagctgcagatcttcgcagtgagtgttacagctcataaaagcagcgtagacccagagagtgagcagtagcaagatttattgcaaagagcgaaagaacaaagcttccacagcgtggaagaggacccgagcgggttgcctatgctggttcaggcagcctgcttttattctcttatctggccccacccacatcctgctgattggtagaaccgagtggcctgttttgtcagggcgctgattggtgcgtttacaatccctgagctagatacaaaggttctccacgtccccatcagattagttagatacagagtttccacacacaggttctccaaggccccaccagagcagctagatacagagtgtcaattggtgcactcacaaaccttgagctaaacacagggtgctgattggtgtatttacaatccctgagctagatataaagactctccacgtccccaccagactcaggagcccagctgtcttcacctagtggatctcgcaccggggctgcaggtggagctgcctgccagtcctgcgccgtgcgctcgcattcctcagcccttgggtggtcgatgggactgggcgccgtggagcagggggtggcgctcctcagggaggctcaggcacggcgggctgtaggtcccgagccctgccccgtgggaaggcagccaaggcccggagagaaatcgagcgcagcgccggtgggccagcactgctgggggactcagtacaccctccgcagccactggcccgggtgctaagtcccccattgcccggggccagcagggctggctggctgctccgagtgcggggcccaccaagcccacgcccatccggaactccagctggcccgcaagtgccgcacacagccccggttcccgctcgtgtctctccctccacacctccctgcaagctgagggagtgggctccggccttggccagcccagaaaggggctcccaccctgcggtgggggactgaagggctcctcaaatgccaccaaagtgggagcccaggcaggggaggtgccgagagcaagcgagggctctgaggactgccagcacgctgtcacctctcactaccaccactaacccaatatgaaatagagaatttgaataaccctacaactattaaggaaactggtttttaaattttaaaactcctgaaaaggaaatctccaggcctcaatagtttcacatgagaactaccacttgatccagcaatcccactactgggtatctaccaagaggaaaagaagtcattatacaaagaagacacttgcacacacatgtttatagcagcacaattcccaattgcaaaaatgtggaaccaacccaaatactcatcaatcaatgagtagataaggaaactgtggtatatatatatatatatatatatatatatatatatatatgtatatatatgtatatatatatgtatatatatacgtgtatatatatatatatatatgatggaataatacagagtcataaaaaatgaattaatggcattcacagcaacctgggtgggattgaagactattattctaagtgaaataactcaggaatggaaaaccaaacatcgtatgtcctcattgatatgtgggaactaagctatgaggatgcaaaggcataagaatgatacaatggactttggggactcaggtgggggaaaggtaggaagcggatgagggataaaatactacaaagtgggttcagtatatactgctccggtaatgagtccaccaaaatctcacaaatcaccactaaagaacttatactacctattccccaaaaacctatggaaataaaaaaagataagaaaaaaaagtaaatgtgaaaatataagctacagactaggagaaaatatttgcaaatcataaatctaataaaggacacctatctagactatacaaataactctcaaaactcaacagtaaaaacaaaaccaaacaacaatctatatttttcagtgaaatctctcttcacggtaccgcacagtcatgattactgtagctatataataaatttggaaatcagggagagtgctacctcctactttattctttttttttcagaattgttttagttattcagttcttttcctttgcacacaatcttctcttcatcgaagagcgatttcactgaaaaagatgcacaaatggcagataggcacaggaaaagatatttaatcaacatcattagccattagggaaaagcaaagtaagaccacgataaaacattaactacatacctattacaacgactaaacttgaaaacaatcacagcgacgatatgaaacactgccaaggatgcagggacactgcatctcccacaccttgctgatggagatgtaaaatggtgcagccacttgggaaaatagtttggcaatttctttaaaacactaaacagatacttagcatatgactcagccattgcacccctgagcattatcccaaagaaatagaaactcaagccaggcacggtggctcacgcctgaaatcccagcactttgggaggccgaggcagcagatcacctgaggtcaggagttcaagaccagcctggccaacatgacaaaaccctgtctctactaaaaatacaaaaaattagccaggcatagtcgcaggtgcctgtaatgtcagctactcaggagactgaggcaggagaatcagttgaatccgggaggcggaggttgcagtgagtagagatcgcaccactgcactccagcttgggtgactgagtgagactctgtttcaaaaaaaaaaaaaaaaaaaaaacagatccacacaaaatcctataggtgaatgtttatagtagctttatttgtaatacccaaaaaacaaaaacagccaagttgtctttcaataactgaatgattaaacaaactatagtacgtggaaaagtgttcagtaataaaaaggaacgaactattgatatataactacatttgacccttgaacaacttgggctttaactgtgcaagtccacttataagcagattttcttctgtctctaccacccctgaaacaacaaaactaacccctcctcttcctccttttcctctgcatgaaaacaacggggatgaagaccttcataatgatccacttccacctaatgaatagtaaacatatgttctctttcttatgagtttaatacatttttctagcttactttattgtaagaatacagtatataatacacagaacatgcaaaatatggctttcattcaacaataagctattagtaattaaattttgggggactcaaaaattaatttcaactgggcggagttcagcacccctaatccccgcattgtgcaagtgccaactgtatttgaatggatttcaagggcattatgcatgagtaaaatattgaagtcgctcgcaaaaggtcacatactgtacaatcccatttatataacatccttgaaatgacaaaattatagagatggaaaacaacttggtggctgacaggggttagggatgggggaaaagagggaagtgggcgtgactatgaaaaggtggcaccagggagaactttgtggcaataaaaccgttttgtaacttgattgcagtggcgtttacatgatcatgtgatcaattgaaactacacacacacacattgcaccagtatcattcctgattgtgatgttgaactatagttatataagatgtattcattgggggaaactggatgaaaggcacatgggatctctccatgatacaatttctttgcagcttcctgtgaatctataattacttcaaattttaaaaagaaaagcaaaattaaagattttacaaattaaatctgaaaggaaattaagtgttaataattgcctctttgggaggtggaagtacatgaaatttttctgttttgcatgcaagtattttctataatgaacatatatgttactttgtttttatcacagtaatttaaaaaaaaaaatcttcctcaaaccatggtcatgagaggtctactcagctgcttacatgttcccctccagtgacggcacaggggatggcctctcctaaaacaaccctaggaggatggcctcacagatgagggaagtggggagagcagagcatctcctggctagggacctctgagttatgcagcaagcatcaaccatttgcaacaaaaaaaaccgtgagaaacatacacttattcacaatgctggtaggaatgcaaaattgtatcattgcaatgcagtggggatggggaatatct

SEQ ID NO: 276 - DNA, 51840 bp, Homo sapiens
acttggtcacccaaagtgctgggattacgggcatgagccaccatgcccagccatataatatctaattttttttaccttgttaagtgcatggtatttattttccaataaaattacactagaaaacctgaagggatttgtttaagttgcatattagtatatggtataaagttgacagggcagttgctagaaaagattaaaattagagaaattctaggatttaagtttctttcatgtaagcttagaaaaaacaaaactggtattaccccagtggcatagagaacagaattctatagggtccttaccctgttccagacctgttcatattcacacttgttggaggccttatttagatctgaatctaacctggagtcttgctctcagaactgattagtagagatcagagttttggctggtgaatcctgctgcctttctagagctggtgctcacaatttcctgaaacccaaaagcagataaatgggaaaaatgaagtatgtattgtagggtcttagtttttaaattttctgttaaaaccagtgcttgcagagacattctatttagcaacttgttttctattcctgcagatccagtagttgctccacaagtcacaaaaaagtaaatataaacagaatacaattttctctaaactacattaaactcttcctttctatgtctctttcatctgtctatatttagcttttattctttacagtttttttaaaaatttgctaacagagaaacagaagaagaaataaaaatgctgggccctttatctaaatcttggaaattattaaacccttagtaccagctccagggtgttatgacaattaaatcacataatgtgttacgcccagcacagtgctccatatcatactcttgagcacatagtacgtgcttaataaacattgcattagtacatgtgtacatgttttttaaatccagacttattcagacattgctgccttttgtttcctctgtaaactttaaagagccatcaaagaataggaaactttaggatggagatgggttgtccttatttgtacaagaaatatttggttgtgacaagagttctaagtgtaaggaaccctgtgctgtgcctgctttctctaactaatgctaataatgagcccagtggaagaaacatcagcattgacagggaacttgtttaaaacacccattcatggacccttttcaaacctgcagaatcacattacataaagtggggccaaaattaccaagtgatttataagctcgttaaagcttgagaggcaatgattagctcagtggttatcagcccaggcttctcattaggatcacatggccaatttgcagaaacctcttgtgccctccccacagcttctgtttattgttgtgggtagaaatatccatgttgtttttttttgcctttttttttttcctttttgtggagaacggggtcttgctatattgcccaggaaggtctcaaactcctgggctcaagctatcatcctgcctctgcctccctgagtgctgggactacaggtgtaagccactgcatctggctccatgttactttaatgaagggcctcatgtgactctaaggtgaggtcagaatcaagtatgagggtttcaaaatacattcatgagagttaagttccaactatgccctaaagtgcggtcacaggggcagttctgtttgggtttggtagggacaggtcagtgtggcacatatttgcattactgtagcagaaattgctggtgtctgtggcaggggagggcaactgaggacagaaaaggagaaacttatatttttatcttcatggagcggctcattgttcctgaatctcttctgttttaaaggacagaaatgagtggactttttctgtctttttctgccagttgatgtcatgctagcaggtacatgtgtggtactgacacctttaaaggcatattctcaacatgcaggtgtaatttatccagagaatctcatctgagaagaaattccagagaaggagaagaaagaaaaaaaatggcttttcttcaggtaaacaggtgtcagatgaagagctgtgtccactctgcctcctggactgccatgaatttagtacttacaaaactttatttctctacttgtgtttttcctccttaatgagtttgatttaactacttcttaaaattcttatgatagtcaagagtctctgagaaatatttctttccaatatccagtagccttctctacattttctatgttatagcttcttatatgacatgaagaattctcagcaagaatttatgatacacagtattaaaaatgttccctttgtggctgttgaacagggaaagatgtgggtactcaagatctctattggggaaacttgtggtccatagtacacatggagaacatgtcatgttgaggctccatctgtgtgttccattagctctatgcagaacaggattaagaaaatgctgatttaaatgaaatggaatttattaaccagaaagttctgaaaaaagttatttggagatatctgttttctaggttgccaaatgaagcctatttaaaattactattaaaattacacaacataggagttatctggattttgaagtttgtatacaactgattttttttatggttaaattcagactataatttacttcttttgggagaaatatttcaacactgatgctgtgttcttctatgtgaattagcacatcataaaaatttgtcctagtgcagttagtggttaaagattcacttggtggaatagctctctgatgaattattttcactacagagttaattatttttctcttcatcatgaagtatctttatgcagcggatgtgcatagaccatcacatttaatctggcagctgttcttttttctaattttttctacataattttctttggaaaatgaaggctttcatctttgcttacaggctagaaaaactgggaaaaacatgggctcttccacttactggatgtctgccaaaatatccttcttgggccaaaaacattggcattactggtgagcttgttagaaattcaaaaaatcggccaagtgctgttgctcaagcatgcaatcttaccacgttgggaggccgaggtgggtggatcacctgatgtcaggattttgagtccagtctggccaacatagagaaaaccctatgtctactaaaagtacaaaattatctgggtgtggtggtgcatgactgtaatcccagctactcaggaggctgaggccggagaatcacttgaacccgggagacttaggttgcagtgagccaagattgcatcactgaacttcagcctgggcaactagatcgaaaccctgtctcagaacaaaacaaaacaaaacaaaaaatttgagaggtgccttctaactcaacatgtcttttccatttgaaaaatattcacaactcattctgtatgatgtaaatatagcactcaaaaatgtacatgtttatgtttatggccttaattttatactttattatatggaaaaatataagaactgatattgtggatgttatgctgctcttttttctcagagttagaggatatatcagagaatatttctgtgttgatattattttattggataactttagtcagtcgaataagtcagaaccagttctctttactctctcatttcaccttaagtcaaataaaaaattctgcctatggccacatggtgaaaatgtgtgtgtgtgtgtttttcagggaccattgcaatttagagatgtggccatagaattctctctggaagagtggcattgcctatacactgcacagtgaaattgatatagggatgtgatgttatggaactacagacacctggtcttttttggtgaagatagcattaatatataattcataatatactctgaagagtatattatttctcttttttatagaatgtattatagtagtttattctttgcataaaagagtttcagcgctgggcatgatggctcatgtctgtaatcccaacactttgggaggctgaggcaggtggatcacgaggtcaggagttcaagaccagcctggacaagatgctgaaaccccatctctactaaaaatacaaaaaattagccaggcatggtggtgggcacctgtattcctagctactcagtaggctgagggagagaattgcttgaacccgagaggcagaggttgcagtgagccgagatcgggccactgcacttcagtctgagcaacagagtgagacttcatctcaaaaaaaaaaaaaaaaaaaaaaagagtttctgatccccctttatttgtaaaatcttcagaatttggtaatataggaaagaatttcttcaatatgttttatcttaatccaaactttccacagtactgagatgagctgtattcttcactctaaattagtggtacttccagaaatttagcggcataaaatattgttgccccacctgaaaatctaattgccaccaccaatttttgattcagtagtaccaggtattaaaattaagaaacctacaaattgaaagtattttctaaatatttagaaatttcttttataatttagtattttggtatcaatttactattatattttatcacatcctctctgctgagcacattactagcttgtagttggagaatatgagcaagattcatgttatttattcttaataaaacaggtattgttttctctaagccagacctgatcacttgtccggagcaaggaaaaaaacctttgactttgaagagacttgagatgattgccatagccccaggtaggtgcgagtgaaaatgaatacaacagatgacacagataagaggtcccaaggtcaaagagaaagccagtccttagaatgtgactggggaagctgagttccaaaggaaatagttcctgggcatctggggttttttgtttgttttatttttttaaattttgctctcagaaaggggcatcttttttgttacgctttttgcttttttttttttttgagatggtgtttcgctctcgttgcccaggctggagtgcaatggtgtgatctttgctcaccacagtctccacctcccaggttcaagtgattctcctgactcggtttttctagtagctgggattacaggcatgcaccaccatgcccggctaatgctatatttttagtagagatggggtttctccatgttggtcgggctgttctcgaacttccaaactcaggtgatttacccacctcagcctcccaaagtactgaaataacaggcgtgagccaccacacccagccctgctttatgcctgtaaattctctaaggattctatttttctttcagtgagcttccttcaggtttatactgaaagcaaaattcctcttcatggcatataagagactgcacaatctggctgcttttttattgtttgcaggactcacaaatatttgcatgattttgagaaactaaaactcttttttaggttttttttgcatcagatttgaaatgtgtgagagcagtagtttcttttgcatttttttgttcatttttctgcacagtcctttctgtttttattgctagtcttgaaatatagttggcaattataagtatgatatccttctgctttgctctttttccttgattgctttggctattccaagtttattttagtttcatgtaaattttagaattatattttccattactgtgaaaaaaatagcactgcaattttgattggcattatattgaatctatagatcactttggataatatggcactttagtaatatttattttcaattcatagacataaaatattttaaaatttatttggatcttccctaatttttttcatttttttattgtaaagatttttttacctccttggttaaattttttctcagacatttattatttaatactatagcaaataagatttctttcttttttttttcttttagagatagagtcttgcactgtcacccaggctggagtgcagtggcatgatcttggcttactgcaaactccgcctcctgcgttcaagcaattctcttgcctcagcctcccaactagaagagattgcaggtgcccaccatcaggcccagctaatttttatatttttagtacagatagactttcaccacgttggccaggctggtcttaaactcctgaactcagatgatcgacccccctcagcctcccaaagtgctgggatggcagacgtgagctaccatgcccagcatcttcctgtattttatcagatagttttaagtgtatgaaatcatacgtatacttgtatgttaattttatattttgctaatttactgagtgtatttggtttagacaggttttaatatactgtttatggtttctttgtgtttatttttgaggcagaatctcactttgtcgcccaggctggggttcagtggcacaatctcaactcacttcaagctccacctcccaggttcacaccattctcctgcctcagcctcctgggtagctgggactataggcacctgctgctgtgcccggctaattttttgtaattttttttttttttgtagagatggggtttcactgtgttagccaggatggtctcgatctcctgacctcgtgatccacccgcctcggcctcccaaagtgctgggattacaggcgtgagccaccgcgctcggccctgtttatggtttcttaaatataaaattttatgatctacaaactgcaactttttacttttctttaatttcaatggattaaattttttcaactaattcttctgccacatacatccagtgctagattaaaatagaagcaatgacaatgggcaaaatatagttttatattggtgtctgaatttgatggagcaaacacctcttcaaattttcataaactgatttcagaagataaaaatcttttgttggacccttagggtgatgataagctctctgaatttgtagtgaagaggggttgcagcttggtcacaaggctgctgggtctgctttagggtccaccattagttggcttgttacaggggcttggatagttgtaattcccattttatttgtgaacagaccacatgtttttcaggactttgctccatagggcagacactagggcaggtttttgcagtcggatctgcatatggtgggcctcgtatcaggatgcggatgagtgtagctttcactgagtaccagagaacatttcctcaggtaactgtgtgggtttctatgtaggcagaactgatcataaactgaggctcaggtaactgaaactgagtcattgaactgcttcacagaccccagtaaaggccaaggtttgcaggcctgcctacatggctgtaaatgggtgccttcctccaggtctctggaatggcaggaccttggccagactgtggctggtaggagtttgggataattacagagtaagttcagaattctcagtgggatcaagttgggtgaaccctatcctggtctgtagccaagaacaggggtcatgtagttttccacctgaatgagggcctgccttccgaatagaacacttctcaaccttaagctttaacagtttttcacaactccctccctggatctcaaatctctcatagaggcccttattttggagatgacgtcttgcttcataaccaaggctggtctcgaaatcctggcctgaagcagttctccaaccttaatgtaccatgtagctgtcattacaggtgtgagccataatgactggttctctaataaaggcactttttttttcctctgagatggagtctcactctgtcattcaggctggagtgcagtggcgccatctcaactctctgcaaactccgcctcccgggttcaggcaattctcctgcctcagcctcctgagtagctaggattacaggtgtgtgccaccacaaccgcctaattgttttgtatttttagtagagataaggtttcaccatgtttgccaggctggtcttgaattcctgacctcgtgatctgcctgcctcagcctcccaaagtgctgggattaaaggcatcagccacagcactcagtcaataaaggcatcagggatggctgattttttttgctgtaagggaatatgaaaatagggctcttttaaccttattgatgtcactctccctatacatttttactttctattttctatttcaaattgtctgtaactttagattcagatatttaggacaatatgctagaatttgcatggtatgcctgaagtaaattacataactagcaggcactccatatttaccaaaatacttcgttataaattcaaatttgttgcaggcaaaaaggaattacagaattttcatttacattcttcagactatatctaaagaataacagtttatttcctaatatttgtttcacatatcacagtgcctaaccctattctgccaaatatatatgtatataattttttctatgtttaacaatttaagtctattttttgcttctaaagttggattacaacagtttcattttgtgtaataatagcatatattttaaacataaagagtaaccctagtttcttttaaatgcttattaaatgtttctcattaagtcttctatttattgttttgggaaaaaaagtctttctgctactttgttatccacataaaaaaacatatcctctacaaataataattaacaaatgtccagttttattcattacaaatattaacatcatttttcttttatttatcctttatgcatcattttatacattcacacacacaaagaacattaaaaatatatccaattattcaattttggttgaattttcattaaaataagtgttaaaaatatttatttgttttctgttttgagaaggcttttattgttgtactccggagtgttatttctggagacaaagttgcctgtgctttaatagggagattcctgggagaatctaaaccataagcaacaaaattttaagttaataaattcaagacaaagcagaaagtatagatttgctttcagcattcccgaggtgtttagatttttattagtcacctaattaacatattgttccaataattgttcttttcttctgaaaataagcagaaactcatacttacacaaaaacacttcataattttcttacacctaaggtttatcttcagaatgatatgtgtatatttaaccctgtgcaaattaacactaaaagtctatgtttgcaggcagagaccacatgttcaaagaaaactatataacaaatatttttaaataatttttcaggattttctatggatttctatttcttttttttctgagatcgagtctcactgtcacccaggctggagcacagctgcaggatctcagctcactgcaacctccacctcctgggttcaagttattctcctgcctcagcctccatgtgccaccatgtctggctatattttgtatttttagtagagacgaggtttcaccacattggccaggctggtcttgaactcctgacctcagggaaaccacctgtcttggcctcccaaagtagtgggattacaggcatgagccactgggctgggccatattctatttctgtataatttttattatgaccataaaaataacaatgtagtcaataacaatttaattgtacattttaaaataattaaagtatataattacactgtttgtaataaaaagtataaatgttagaggtgatggataccttatttaccctaatgtaattactacacattgtaggcctgaatgaaaatatgccatataaggcataaatatatacacatactatatacccacaaataccaataataaatttcaataagaaaaaagaataaaaatctaacctatggaaacaatattcttaaattcatttgctgtttaaagccactcgcaaagtgattactagagatgttatttcactatgtaccaaatagtatattgctaccatcttttacctacacccttgagtaaggtgggataggttaaagttagtggaataatgcttcattaaatgcacaatagtcttaacatgttaaaaaaataaaattaagtttgcacataatctaatgatttttaaatatactgcattttattacataaaagtacaattaataatatacttattttaatatacttttaactataattaacaattccaccataatgtagaaaatagtctgaacacctagcttatacattacttaatataggttaactacaatgagcctctccacttatcttttcatcacgcatcttacattttagtgtccttacttttatagaaaaggttataaataatgcccaataaaaaaagaatctctggtatctctgatgcagcaaaaattgctcatatgttttcacatgtgaataggaataaaataacagcataaagtaatttgaaagctgtatgacatcattattcacttttgaaaaactttttttcaagaaaacaagtatacttttaatgtaattacaatgcttccaaaaatctccttttaaagctatatacaaataattttaaacaattttttatttttatatttatcaagtgcggcaaccaaataaaggctttgtcacattttatacttttctacagtttcacactagtataatttttttatgtatagaaacgttggaggtgttgggaacagcactgtcacatctttcaggtttgcagggttcctcttcagcatgaattattgccatgtctcttaagaattgagaacttatggctaggaatggaggctcatgcctgtaatcccagcactttaggaggccaaagtgggtggatcaactgaagtcaggagtttgagacgagcctggcaaatatggcaaaaccccatctctactaaaactacaaaaattagctgggtgtcattgtgggtacctgtaatcccagctacccaggagacgaaggttgcagtgagccaagatcatgccattgcactccagcctgggtcacaatagtgaaactgcatctcaaaaaaagaaaaaaaaaattgagaacttgttataggctttgccaaattcttcacacctgtagggtttctgtccagtatgaattatgtgtaataagtgttgagaacttccttacaaagaggtttgtcagcctggtgcagtggcttgtgcctgtaatcctggcaatttgggaggctgagatgggtggatcacttgaggttggcagctgaagaccagcctaaccaacatggagaaaccccatctgtactaaaaatacaaaattagccaggtgtggtggtgcatgcctgtaatcttagctacacaggaaggctgtggcaggagaatcgcttgaacctgggagatggaggtgaaggtgagccaagattgcgccattgcactccagcctggacaacaagagtgaaactccatctcaaaaataaataaataaataaataaataaatagataaataaataaataaagctttgttacagtattggtttctgtccactatgaattctcttatgtttattgaagtctgaggaccagttaaaagctttgccacattcttcacatttgcaaggtttctctccagtatgaattgtcttatattcacttagagttgaggatgcagtaaaggctttgccacattcttcacatttgtaaggtttctctccagtatgagttctcctatgtttatgggggcttgaggaccatgtaaaggtttttataccatttatagcatttctctccagtatgaattgtcttatgtatagtaaggtgtgaaaaatggttgaaggctttgccacattcttcacatttgtagagtttctctccagtatgaatcttctcatgttcactaagggttgaggataaaataaaggctgtgccacatttatcacacttgtatggtttctctccagcatgaattttcttatgcctagtaaggtgtgaggaatgggtgaaagctttgccatattcttcacatttgtagggtttctctccagtatgaatcttctcatgtttactaagggttgaggatgaaataaaggctttgccacatttatcacacttgtatggtttctctccagtatgagttttgttatgtgaagaaagggttgcaggatgtttaaaagctttgccacattctttacatttgtagggttgctctccagtatgagttatcttatgaatagcaagctgtgagggccagttaaaggctttgccacactcttcacatttgtaggatttctctccagtatggattatcttatgttcagtaagcgtagaggaatacttaaagccattgccacattcttcacatttgtagggtttctctccagtatgagttatcttatgtgtagttaggtgtgaggaccatctgaaggctttgccacattcttcacatttgtagggtttctctccagtatgaatcttctcatgtttactaagggttgaggaaaaaataaaggctttgccacatttatcacacttgcatggtttctctccagtatgagttttcttatgtgaagaaggggttgtgggatggttaaaagctttgctgcattctttacgtttgtagggttgctctccagtatgagttatcttatgaatagcaagctgtgaggaccagttaaaggctttgccacactcctcacatttgtgggatttctctccagtatgaattatcttatgtgtagtaagggtacaggagtacttaaaggctttgccacattcttcacatttttagggtttctctccagtatgagttatcttatctgtagtaaaggttgagtaccagttaaagtctttgccacattcttcacatttgtagggtttctctccagtatgaattttcttatgtgtagtaagggttgaggactggttaaaagatttgccacattctatatgtttcaaaggtttttttacagtacgtcttctgtctgtttgaatttgaaaattgatgaaagactttcacatatttatcacattgaaatattttgcaatgggtagttgtcaagcattggttaagcccattataacctcttttttgcaccttacactcatccacactttcacatcctttttttaactgtaaattgccatgtccacattttttatatcttctcagtatcactttttgaaaagaatcttttatgttctgctctagccaaagttcttgggcaaaatgagaacaaataactgaaagagacaataaaaacacaacacttcaactgctagactcagataaatatattttacaaatctaacctataaaatttcacagactacctaaggaagatgacatggcaaaataccacaagctgtaatttcttcctggacatataaatgtaacaaaaacatactgaccaaaatacaatttgtaaaaaatgtataagtgaattaagtgtgtgaagggtcccaggtgagcacaatgcaaagagccacatagaagataaagaaaagcctgttacttatacccaacacagctcttccatatctccagtataactctgtgcctttaaaagtaaattattggcctggtgtggtggcttgtgtctgtaaacccaacactttgggaggcagatgtgggtgaatcacttgaggtcaggagttcaagaccagcctggccaagatggtgaaaccccatctctactaaaaatacaaaaaattagccaggcttagtcatgggcacctgtaatctcagctactggggaggcggaggcatgagaattgctggaacccagggggtggaggttgcagtaagctgagattgcaccactgtactctggcctgggtacagagtgagaccccaccacaaaaaataaaaattaaaaaaaaaaagttaattgccaaccaggcatgatggctcatgcctgtaattccagcaatttgggtgaacaagatggaggacaaccagaggtgatcagcctgaccaacatggtgaaacctcatctctactaaaatacagaaaattagccaggggtggtaataggtacctgtaatcctagctacctgggaggctaaggcaggataattgcttgaactctggaggcagagattgtactgagccaaggtcatgcctctgcactccagactagttaatagagtgaggctctgtctcacacatacacacaaaaatgtaaattgccaactcctggtttcttttttaaaaaacaagaaaaatattgacacatacatctttatttctggcttctaggggcttttttagacactagttgatatgtcccatgacacaaaatgccaaaaaaaatggtgatatatgttagaatgacactttgagtctgaaggtaaattatagagaagcagagaaactgcagtaacccaaacagggaatgggtgtagtgaatgattacttattattaactaaacaataaacataaaattttaaacaagacacaccttaaaaacatgtttgaggaattctcagaatctagagtcaagacaattgatttcagactatgccaggacagagccatattataaagactgtaacaggtagctttttgttaatgtcctaatctcaatcaaaggttataatgtataccaaatattagagcaacatggccccatcaaaaaaattataaaattttcaaaagcaaccataaaaagtatgtaaagtaatttttaaaattccaaatgaattgaacagcccagtgttggtagctcattcctgtaatcccaacacactgggagatcaaggtgggaaaatcacatgaggtcagaagtttgggaccagcctgagcaacatggtgaaaccctgtttctgctaaaaatacaaaaattagctgctcatggtggcatgtgcctgtaatcccaggtacttgggaggttgacacaggataattgcttgaatccaggaggggaaagttgcagtaagtggagattgtaccactgcaatgcagactgggcaacagagcaacactgtctcaaaaataaagtaaaaaaggccaggcacagtggttcatgcctgtattcctagcactttaggaggctgaagtgggtagatcatttgaggtcaggagttcaagatcagcctgcccaacatggtgaaaccccatctgaactaaaaatacaaaaaattatctgggcatggtggcaggcacctgtaatcccagctactcaggaggctgaggcaggagaattgcttgaaccaggaggcagaagttgcagtgagccgagattgcgccactgcactccagcctcggtgacagaaaaatactctgtatcagaaaaaaaaccagaaacacagacaactattgaagatcagaaaaatgagaacaaaaagaaatactaaagtaaacacacacaaaaaattgtggatataaaaagtacaaaaaataactgaaaaatttattacaagaaaatacgtaaacatgaaaaagctgaaaaaacaaacttagatacacacaaatatatttataacacccaaataagcaaaatttcaaaaatcacatataagaatagaattttgggtgctgaagataaaaatgatgttccgtttataagcatagtctcatgagataaccagtgaatttatttaaaacatttttgcatgtcaaaaggaaactgatattgttaaatttataataataataaaaaagctgtcaaatgggaataataccatcagcaaaattgtactatcagataaaaagaagtccttccaaaataaccaaatcctgagaaagtatattggcactgcatacaccctacatatcaaagatgctgaaaggagtttcttccactgaaaataacataatgtaagaaaacaccacataatcatatgaaaatacataactttctggaaaagatatgcaaattcacaaaaatggtatttcttacttaacattatcataatgatacagaaaacatttttaattattctctaaatttaaaagataaaagtacagaaattattaacatctgttaatggatatacaacataagaaatataattaacaaaatcaataacaaagttgaaggcagatgttatgatgaataattttggtatgtaactgaagttaattttttaccacattaaaatacatttttgaatattttagaggttttatggagtcccctggtaccactaagattatatctgtagagctacacaaaagtaaataagagggaactgaaagcctatcaatacaaaaataaaaaaaacacaaaaaaggcagaaagagaaaatgagagacaaagacacaacaatcaaataaaacaattaataaaaataacagtaaatttttctatttcagaaaactatttaaatatatatgttatctttccaatcaagaaacatactttttttttttttttttttgagatggagtctcgctctgttacccaggctggagtacggtggtgtgatcggctcactgcaacctctgccttccagtttcaagtgattctcttgcctcagcctcctgagaagctgagattacagttgcctaccagcacacctgactactttttgtatttgttagtagagacacggtttcaccgtgttaaacaggctggactcaaactgctgaccttgtgattcacccacctcagcctcccaaagtgctgagattacaggcatgagccaccacacctggtggagtttacagtgagccaagatcacaccactgctttccatcctgggcaataaagcaagactcagtctcaaaaaaaaaaaaaaagacggtacagaaaaactttaaaattcttttataaaatataaaaaactatgtaaatttgcatgaatcaatcaatagatacaccatatgaaataatttttataacaataacaaactagaaaatgtagaggcatagtttttgtgttcaattgaagttgttatgagattaaaacatattgttttaactttaagatgtatgtaatctctggttttcaaaatgattacaaagggaatatttgtagaaagtatggaaaagaagataaaaaataatcaaagcatgccagtacaaaattaaatgaaaattaagaaagtaaaacagcaaatgagaaaaatataactattagaaacacataaaacaataacaatataactggtaataacaacttcatttctttaagtaatcattgtaaatataaattaattaaactgcttaataaaatgaaatgtaatcggaggactttcaaaggccaaggtaggctgatcacttgatcccaggagttcaagaccagcctggggaacatggcaaaactctgtctctacagaaaaaaagctacctgggtgtgatggcacttactggtaacccagctacttgagaggctaaaatgagaggatcatctgaggtttggaggttcagtcaccagtgaaccatgcaaatcagcctggttgacagagtgagaccctatctcaaaaataactgaggctgggcacagtggcttatgcctgtaatcccagcactttgggaggctgaggcatgcagatcacctgaggtcaggagtttaagagactggccaacatggtggaatcccatctctactaaaaatacaaaaaattagccaggcgtggtggttggtgcctgtaatctcagctactcaggaggctgaggcagtagaatcacttgaacttgggaagtggaggttgcagtgagttgagatcatgccattgcactccagccttggcaacaagagtgaaactttgtctcaaaataaataaatacatacataaataaatatacctaaagaaaaatccatagaatgcctcagtggtttcttaaaaagcatactgtatgctgcccacaaaagactcatcgtagcattgagtcaaataggctgaaagtaacagaaggaaaaaaatgtgtatttcatgaaaattgtaaccacaattgagtgaggtggtcataattatattagacataacatgctttaagtcaagcactaccattaggtgaagactgatattatattatagtaaagtgagttaatttaccaggaatctataactatattcatctatctatatgtatatgtgtatataacatcagggctccaacatatataaagcaaatattgacaaaactgaagcaagacatacacagcaacgtaatagttgtagacatcaagaccccatttgcaataatagaaaattcagagaaaaaaatgaaaaacaaaacttagacaatattagactatattattttgcatacagaggaatacttcagagattataatttataaagaaaaaaattatgtggctcacactttggcagactgtaaaagaagtgtgtgccagcatctgcttctggtgagggtctcaaaaaacttacaatcatggtagaaggtaaagagtaactggacatattatatggtatgagacagagcaagtgtgaggtaaagaagccaggttcttttaatgaaccagctctcatttgaattaatagagtgtaaactttttggttaccaagaggatgtaccaagccattcatgagaaattttcccccatgacacaaacatgtcccagcaggtcccacatccaacattgaggatttatcttgcagcatgagttctggagaacatggacatccaaaccatattatagaccaactaggcttcacagacacacacaaaactctccagtcaaaaccaagataatacataatattcccacttgcatctggtgtattctgttatgacatataccaagttttattaaatttaaaagtactgactaggtgcagtggctctcgcctataatcctaacactttgggagaccaaggtaagaggatccactggggccaaaagtttgagactagcctgggcaacatagtgagatcctaacattacaaataagcaaacaattagccagacatggtagtgcatgtctgcagttctagctactcagaaaactgaggtgaaaggataacttgagcccaggaggctgaggctacagtgagccaaaattatgccactgcactccagcctcaatgtccataagatcttgtctcaaaacaacaacaaatcaattaaaaaacactaaaattacacactcttgtgttttctaacaaaaactgaatgaaactaggaattaaaagcacaagccaaacaggcaaattcaaaaatatgtgaatataagacacattcttcaacatattcttgctcaggggtcaaaaaactttatttttcaaagatgtcaatacaacctacagttaaaagctacagtaacataaacaatgtgatactgacacaaagataaacagatgaaagaacagaatagagagctccggaatgaacccttctgtatatgatcaaatgatcttccaaaaggttgccatgagtacaaaatagagaaaaatcatctcttcaaaaaatgatgttgaaaactgaatatcgagaggaggtcgcggcgccggaggccccagaagggtcgaaggcgccgcgggctggggtcggtggcttagggagcccgtctggccatggtggccgcggctggtggttggcgcggctgcgctgcggcccggggcagtgcggagccaggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtgggggggggtcagccccccgcccggccagccgccccatccgggagggaggtgggggggtcagcccccccgcccggccagccgtgccatccgggagggaggtgggggggtcagccccccgtctggacagccgtgccatccgggagggaggtgggggggtcagccccccgcccggccagccgccccgtccgggaggtgaggggcgcctctgcctggccgcccctactgggaagtgaggagcccctcagcccggccagccaccccgtccgggagggagatgggggggtcagccccccccacccggccagccgccccgtccggtagggaggtaggggggtcagccccccgcctggccagccgccccgtccgggagggaggtgggggggtcagccctccgcccggccagccgccccgtctgggaggtgaggggcgcctctgcccagccgcccctactgggaagtgaggagcccctctgcccggccagccgccccgtccgggagggaggtgggggggtcagccccccgcccggccagccgccctgtccgggagggaggtgggggggtcagccctccgcccggccagccgccccgtctgggaggtgaggggcgcctctgcccagccgcccctactgggaagtgaggagcccctctgcccggccagccgccccgtccgggagggaggtgggggggtcggcccccctgcccggccagccgccccgtccgggaggtgaggggcgcctctgcccggccgcccctactgggaagtgaggagcccctctgcccggccagccgccccgtccgggagggaggtgggggggtcggccccccgcccggccagccgccccgtccgggagggaggtgaggggggtcagcccccctgcccggccagccgccccgtccgggaggtgaggggcgcctctgcccggccgcccctactgggaggtgaggagcccctctgcccggccaccaccctgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaaaaaaaagaatggactttcccaggccagctgtggtggctcacgactgtaatcccagcactgtggcaggccaaggcgggcagatcacctgagatcaggagttcaagaccagcctgaccaacacggagaaaccccgtctctactaaaaataaaaaaaattagctgggcgtggtggtgcatgcctgtaatcccagctacttgggaggctgaggcaggagaattgcttgaacccaggaggcagaggttgttgtgagctgagattgcaccattgcactccagcctgggcaacaagagggaaactccatcaaaaaaaaaaaaaaaaaaaaggactttctcaaagaaaatgtatttaaatgtctgcaccaataattccagcatgtgtacgaataaatatgatatgtcctttacaaaaaaaaaaaaaaaaaaaaagaaaactgaatatcaacatcgataaaataaagttggattattttcttgaatgatacaaaaatatattttaaataaaatacttagacacaaaaaactaacaaatctttcagaaaaaatacaggaaaaagacatgacattgtcttggcaccattttcttagatatgacattaaatgcatgagcaacaaatacaagaataggaaccattaactatagtagatgtcaaaatttctgtacatcaaaagaaaattcgagaatgacaacatatttagaaaatgggtgaatatatttgcaaattacatgtgaaaaaagttaatattaaaaatatatcaacaactctaaaaactaaaccataaagttcaataacttgatttataaatgaacaaacaaaactttcatcaaaaaactacacaaatgggaagaaacatttgacaggatgcacaaaattactcatttgcagagaaatgaaaaaaaaacacaatgacagcgaaatcatctcacacccattagaatggccactatatattttttaaaaaatgccaactctgttgatgatgcaataaaaatgaaacccatgttggttgttggtggaaaacaaagatgtagtcattattttaaaatgttattaatgttcctcatttatatatctatatacaaaatatgtaacacaggccaggtgcagtggcttaagcctgtaatcctagcactttgggaggccaaggtgggcaaatcacctgaggtcaggagtttgagaccagcttggccaacataatgtacgctatcttactaaaaatacagaaaattagctgagcgttttggcgggcacctgtaatccgagttactagagaggctgaagcaggagaatttcttgaacccaaaaggcagaggttgcagtgagctgagatcacaccactgcacttcagtctaggtgacagagcgagactccatctctacaaaaataaatatagaaataaataaatcacaggaatgaatgaatgaatgaatgaatgaataaataaatgcaacagaggaccaggaagacatatttgaaaatccatggccaggcttggtggctcatgcctgtaatcccagcactttgggaggccaaggtgggtagatcgcctgaggtcagaagttcgagactagcctggccaacatggtgaaaccctgtctgtagtaaaaatacaaaaatgagccggtgtggtggtgggcatgtgtaatcccagctactcaggaggctgaggcaggagaatcacttgaacctgggaggtggaggttgtagtgagccaagattgtgccactgcaccctgggtgacagagaaagactccgtctcaaaaacaaaacaaaacaaaacaaaaaaaaaaagaaaagaaagaaagaaaagaaaatctatgtttattgcatcagtattcacaaaagcccaaaggctgaagcaacccaaatttctcttgatttataaacatatcaaaaaatataacatatacatacaatggaatatcgttccaccttaaaaagaacaatcttgtcacattttaagatgaacattgagaatattatgtcacttgaattaatccagtaagaacattatgggtactgtatgattccactcatatgagataccttaagtagtcaaaatcataaaaacaaagtggaaggtttgtctgtcaaggacgggagagagggtaaaatgagcagatgttacttaatgggtattgagtttaaattttacaagatgtaaggtttctagaagtcttttgcataacaatgtcaatatacttaacatccctgaaatgaacagcttttcttttgagacaaggtctcactctgtcactgaagctaaagtgtagtggcacacctttgactcctcctcaacgtcccaagtagcaggtaccacagctgcacaccaccatgcctagctattactaaatttattttatataggggggtctccatatgttgcccagactgatctcaaacttttgggctccagggatcctcctgtgttggccttccaaaatcctgggaatacagatgggagccacaaccatgcatggccctgaaatatagacttgaatagatttaagatggtaaattttatgttacgtgttcttaaaacaatttttttaaagaaaaactgaaaaatgtccagaattataaatcattttgaaaattaccttcaaatcacaaaaatgtttctctcacaaaagaaaatatatgttcatcattaaacacatggtgaaaataagactgtgtctatggctactcacttaaacaagaaaattttatggtcagttctgcctatatagaaactcacacagttttctgaggaaacgctctctggtactcactaaaagccacactcatccacatcctgatataaggccgagcgtatgcagacctgactgcaaaaacatgctgtagtgcctgccctactgagcaaagtcctgaaggatatgcagtctgtccaaaaataaaatgggaattacaactacccaagtccctgtatcaagccaactaaaggggaaccctagtgcagacccagcagccttgtgaccaagctacaacccctcttcactacaaattcagagggtgtctcatcaccctaagggcccaataaaagatcattaccttctaaaataagtttatgaaaacatgaagtgtttgctccatcaaattcagacaccaatacaaaactatattgtgcccaatgtcaatatttctattttaatgtagcactggaagcatgtggcagaattagtcaaagaaataaaaaaatccattaaaattaaagaaaaataagtaaaaattggtgtttgtaaatcatacaatcttatatttaaaaaaccataaacagcacattaaaacctgtctaaactgataaatacactcagtaaattagcaaaatataagattaacatacaagtatatgtatggtctcatatatttaaaacaaactgataaaatagagaaagacaaaaaccttatttactatagcattaaataatatacttcttagaaaaaaaataaccaaggaggtaaaaaatctttacaataaaaaaaaagaaaaaattagagaagatccaaataaatttaaaaattggcatattatccaaagtgatctatagattcaataaactttctatcaaaattgcagtggtatttttttcatagtagtggaaaatacgattctaaaagttacatgaaactaagataactttgatagccaaagcaatcttgaggaaaaagaacaaagcagaaagataccatacttataatttcaaactgtatttcaagactacatagtaataaaaacagaatgtattgtgcagaaaaatgaacaaaaaatgcaatacaaactattactcttatacatttcagatctgatgcaaaaagagaacttaaaatcatgcagatatttttgtgtccccaaaacaatggaaaagcagccagattgagcagactcatatgtcataaagaggactttggttctcactgtgaacttgaaagaagctcaacaaaagaattcttagagaatttaaaagcatgatacagaagatgtcccttggtgagaacaaaattaaaaaccaaccaaccaaacaaacaaacaaacaaaaaacagctgcccaggaactatttcctttagaacacagcttcccaggtcacattttaaggactggccttctcttggatgttgcgacctctcatctgtgtcatctgttgtattcattttcacttgcacctacctgggggtttggcaatcatctcatgtctcttcacggtcagaggtttttttccttgctccagacaggtgatcagttctggcttggagagaacaatacctgttttattaaaaataaatagcatgaatcttgcttatattgtttaattacaagctagtagtgtgctcagcagagaagatgaaataaaatattctagtaaattaatgccaaaatactaatttataacagaaatttctaaatattaagaaataatttcaacttgtaggtttcttttgttttgctcttgttgcccaagctagagtacaatcactcaatctcggctcaccgaaacttcagcctcccaggttcaagcaattctgctgcctcagcctctggagtagctgggattacaggcctgagccaccatgcctggttaattttgtattttcagtagagatggagtttcttcacgttggtcaggctggtctggaactccggacctctggtgatctgcctgcctcagcctcccaaagtgctggcacccggccaccacactgggccctgcttataggttttttaaattttactacttggtactactgaatcaaaaatggcttgtgtcaatgagattttcaggtggggcaacaatattttatgccactaaatttctggaattaccactaatttagagtgaagaatagagctcaactcaggaatgcagaagtttggattaaggtgaaacatcttgcagaaattcttttctacatgaacaaattctgaagattttctggaaaaaggccatctgaaactcttatgcaaagaataaattatttaaaaacattccactaaaaaagaaataaaacttttagggttttttgtgaattatgtatttaagttgtcctcaccaaggaagaccaggtgtctgtagttctctaacatcacatccctatataaattccgctgtgcagtgtccaggcaatgccactcctccagagagaattctatggccacatctgtaaattgcaatggcccctgaaacacacacacacacacacacacacacacacacatttttaccaagtcgccatgggtggaatttttgacttaagatgaaatgagcgagtaaagagaactgattctgacttataggactaaaattatccagtaaaacaattttcaacacagaaatattccctattatattctctgactctgagaagagcagcataagatctacaacattatttcatgtatgatatttttctaaataataaagtataaaattaacagcatgaacatgaacatgtacatttttgagtgctatatttacatcacatggaattatgaatatttttcagatggaaaagacatgttgagttagaaggcacctctcaaaattttttttttttttttgagacggagtctcgctctgtcgcccaggctggagtgcagtggcatgaactcggttcactgcaagctccgcctcccgggttcaagccattctcctgcctcagcctccagagtagctgggactacaggcgcccgccatcatgcctggctaattttttctgtattttttagtagagacggggtttcaccgtgttagccagggtggtctcaatctcctgacctcatgatccacccgcctcggcctcccaaagtgctgggattacaggcgtgagccaccgcgcctggcctcaaattttaatatgtacaataagctgaagaccttatgcaggtttttttttttttccagaagatctggcataaagtctgattttttgaatttctaacaagctcaccaataatgtcaatgtttttgtcccaaaaaggatattttgtcaaacatgcagtaagtggaagagcatgtgtttttcccagttttcctggcctgtaaacaaagagccttcattttccaaagaaaagtatgtagaaaaaaaaaaagctgccagatttaatgtgatggtttatccacatcagctgcataaagataattaataatggggccgggcacagtagctcatccctgtaatcccagcactttgggaagccgaggcaggcagatcatgaggtgaggagatcaagacaatgctggccaacacggtgaaatcttgtctctactaaaaatacaaaaaattagccaggcatggtggggggcgcctgtaatcccagctactcgggaggctgaggcaggagaatggtgtgaacccaggaggcagagcttgcgttagctgagattgcaccactgcactccagcctgggtgacagagcgagactctgtctcaaaaataaaaaaaaaagataattaataatgaagagaaaaataattaactctacagtgaaaacaatctgtcagagagctatttcaccaagtgcattataaaccattaactgcacaaggacaaattttcatgatgcgctaatgcacacagaagaacacaacatcactgttgaaatattcctcccaaggaagtaaataaaatctgaatttaatcataaagaaacatgtttatgctaatttcaaagtacagaaaactcctatgttctgtaatgttcagtagtaattttaaggagacttcatttagcacccaagagatcaggtatctcctaataatttttttcagaactttctgagtaataaatgccattccatataaataagtattgtcttaatcctgttctgcataaattaatgaaacacacagatggagcctcaacattacacgttctccatctttactaaggacaaaagttttccccaatagaaatcttgagtagccgcatctttccatgttcaacagccacaaagggaacatttttaatattgcagatcataacttattgctgagaatcctgcatggcatataagaagctatgacacagagaatgcagagaaagctctgggatatagaagaaaaattattttttcagagacccttgactatcgtaacaattttaagtagttaaaccaaacccagggagaaaaaacacaagtagagaagtaaaggtttgtgagtgctacatgcatggcagtccaggaggcagagtgaacacagctcttcatctgagacatgtttacctgaagagaagcctttttttttttttcacctcctcctctggaattccttgtcagatgagattctctggccaaattacccctgcatcttgagactatgcctttaaatgtgtcagtaccacatgtttacctgctagcatgacatcaactggcagaaaaagacagaaaaagtccacccatttctgttttttacaacaaaaagattcaagaacaatgagatgctccatgaagataaaaatataagtttctcctttcatgtcctctggtgccctttctgccacagacaccagcaatttctgctacagtaatggaaatatgtgccacactgacctgcccctaccaaaaccaaacagaacaggtcctgtgcgcaccacttagtgcaaaggtggaacttcttaactctcatgaaagtattttgagaccctcatacctgattctggcctccccttagagtcacgtgaagcccttcattaaaacaacgtggatacttccacccagaacaataaacagaacctgtggggaaggcacaagagatttctgcaaattggccatgtgatcctaatgagaagcctgggctgataaccactaagctaagcattgcctctcaagctttaagaagcttataaatcacttggtaattttgactccactttatgtgattctgtaggtttgaaaagggtccataaatgggtgttttaaacaagtcccctgtcaatgctgatgttgcttctccttggctcattattagcattagagaaagcaggaatagcagagggtcccttacacttagaactcttgtcacaaccaaatacttctggtacaaataaggacaacacatctatgctaaagttttatattctttgctgggtctttaaagtttacagaggaaacagaaggcagcaatgtctggataagtctgcatttaaaaaacatgtacacatgtacaaatgcaatgtttattaagcaggtactttgtgctcaagagtatgatacagagcactatgctgggcataacatattatgtgatttaattcttgtaacattcttggagctagtactcagggtttaataatttccaggatttagataaagggcagagaatttttactgcctcttctgtttctctgttaccaaatttttttaaacattgtaaagaataaaagctaaatatatacagatgaaagagatatagaagagtttattgtagtttagagaaaattttattctgtttatgtttacttttctgtgacttgtggagcaactactggatctgcaggaatagaaaacaagttgctaaatagaatgtctctgccaacactggttttaacagaaaatttaaaaactaagactctacaatacatactttatttttcccatttatctgcttttgggtttcaggaaattggattcaccagccaaaactctgatatcttctaatcagttctgtgaggcaagactccagagtagggtcagacctaaataaggcctccaaaaagggtgaatctgaacatgtctgggacaaggtgaggatcctatagaattctgttctctatgccactgtggtactaacagttttctttttttctaatcttacctaaaagaaaaaccccagagtttctgtaattttaatattttctagcactgctctgtcaactttatactgtatactaatatgcaatttaaacaattctcttaaggttttctagggtaattttataagaaaatcagtgtgtacacttacgaaggtaaaagaacagaaattatacggctgggcacagtggcttacacctataataccaacactttgggaggctgaggtagatggatcatgaagtcaggagttcatgaccagcctgactaagatggtgaaacctcttctctactaaaaatacaaaaattagttggctgtggtgggaggcactgtaatcatagctatttgagaggctgaggcaggagaatcgcttagacccaggtgacagaggttgcagtgagccaagatcatgacacagcattccaggctgggtgacagactaagactccatctcaaaaaaagaaaaattaattataacaattctactgttcattaatatcccttcaggtggtaggtaccatgactgcttcatgtatttttttttaatgaccataagaaatggaagcaactagtttatctacttgggtctccagatctccttgtttatcatccaagtaccaggaaactggagaaactctcatccctgtacaaaccaaagacaactcttgtatgatgggttgaacaaacacagaatgactcatttttctttacactgagacagaagcagaattaaccactcttgtcagcctgacacaattctactctggacatcctcaaatgcctcaaagaaacctaggtgattgtgagggaattcccagtgacccagggctgatggcccaatgataagccaggctggagcgactcaggctgattctaaatagaaaataaaactgcgttggtggagccccagaacctgggtcacctgtcctgatatgctagcacttgggtaaaagacagaacaaaaatactctactccagtatcccattttacaggtaaacatagttgtggtcatggctctggatactttgtggcctgatctctcactcctaagatgattatttacacttacagattctgccatcagattctatttcctcctggagcctctcacatcactgtagcaggtcaatgaaaaagatgtaaaaaaactcaaaatgccacactctgaaatgggggctgtaagatgtctatcttgacaacttacaatgcagaaaataacttttgttaattttctgtacattccatatccaaagtctggcactttttaaatcccaggcagaggccggacctaatctgtagattctagataggatcaacctggctctgcatcctttggtgttacagcaaatggagtacaatcaaaggagagtaccctcatagaggctgctctagaacattctaagtgataagtctaaataaaaaaagctgacatatcaagaatataagtagacagtttatttggtttaagcttaaggattataaccagggagcaaagattcaagttgcctgaaatctacactttgattagcagcagttacaagatttgtaaagacaagagagggacatagagtggtctgatacaaagttgtttgtcagaagtttttatttatttagataaataatattgattattgattagatatatatcattattgtttagggtatagaatatagtatccaatgtggcattgttaatttactttatagctacttgtggcaatagtgaacagtttcaagggatgaatacatagttcaaaggggagagaaagatgttaactgctctttcattttaacatctctctgagtttgataaccaaaagtgcttgcactttttagataaaagttttttatttcccaaatctcaagatctggattcaaaatatggagctacagatttaggtcctgaatggcaggagtagcagcaggtgttacttgcacattagtgagcatttcagcaagagtagaaaggggatagtggagactttcttgtctacatgtctactcaattcacatgttactccagttcagtttgttggccccacggtctctgaatctgtttaaggtctgaaaatacaagagtcattgaaagagaaaaaattattgattgcttccctgtgaaatttgtagaaatctgatctagtctctctagcagtgactgtaaaggactctagataccaaataggcagggacacaattctgccttcatatttaggggacagcatgcactttgctgcacaagtgtgagttgactggaagcctgagaggaatagtcccctctagagtaagttccggttggcaccttatttgtgtttatatcatgtctggtaattctagacagtgtttggaaacaataattaaaagacagattttatccagctccagagaaactccacaataatagaacagaaagaaaatggttttattacacaattgaacttgaatgtgacatgcatcatggtcagtctgcttaagagactgcaaagatagaaagatggtcaccaatattagtccccaagcagaagaatttccagcaccatgtcatacatagttcatcctaaattcacctggagattgaagaggccatctgtgtatactaattgcttatattcaatgacaaataaacttttcacatcttcataacaggaggtagtttagcagcttgaagccaggtgcctgctgaaggtagcctcttactctgctacaaaaatggttgaatagggttcttttttgctatttacattttagagctgtggttctgtactccctgccactgggctacagcactcctgcttgctttctcctggttgctagtatgctctcttgacctctaccatgtgccactgaggcacagcccagagcacagctcacattttatgtgaatcccatttgccacagcagcactttagtgtcacatcagatagtgaagcctgagctgcaggaggagagcctgcaggcctcctgggtagaattacacattcacaataatggaaatgagagcagtgtttcaacctcagtttctacttataatggtgacaaggaaaaaatactgctgaattttcagcatgactcaagatagagatagctccaaaagttctcactatgacagcccacctcattcagaaaaaaatgggatattaatagggtttctgaaacagacacctaaagctttggagagacaaacagatctccgtctgagcaagattgagagaaaaaagctaaaactatcttaagaaaaagctcagattagatgtaagattgatgatgtcagccagaaaatattcccctgaaagcaatttctctctaaacacccaaagtgcacagctactctctgcatgagaaacattagcattatgaagaaaggggcaaagtctcagaagaattttatagtttcttttctatctctgctgatccatcatctcctagtcattgaataggggttctgtattgaaatacatctgacaacttcccacaacaccttctgatgaagaaatagaatctgactgtgttcatttattggaatatattagaacttgcaacatagctaactgaagagctactatggtttttggtggccacatcacctgtctttatttgtcatgtaatagcagcataccaatttagtgaaataaaagatattaaaattttgtttactcataattatccctattgaataaagtaataaacatgtcacactaatatctacttactgtgacaatttggtaataaattttctttagatattagatataaatatcagtatgaataattttaataaactagtaataatatatgtagttttaaaaattgcaactatacttcagttaaaacactttatatttcaaaagtataaattacaatattaaaataaccatgtaagtgattcattcaaagtaagtattgcggctttatattcatgttactgtagaaaatactgtttatggctcatgccttgtccacacttcgggaggctgaaatgggtgggtcacctgggtcaaaagttcaagatcaaactggagaacatggtgacacccatctctactataaatacaaaaacttagtcaggaatggtgatgcacacctgtaatcccagctactcaagaggctgaggcagaagaatcgcttgaacccgggaggcagcggttgcagtgagccgagatcatgccattgcaccccagcctcagcaacagagtgagactctgtctcaaaagaaaaaaaaaaagagaatactgttaaatgtatataaatgcaggttgtctacaaacattacgtataactatgctaattattctgaagtaataaatagaaagcaaggtacaactactgactccactgttaagtttatacactagactgttcttgtttttgcagtgcaagtacttcagcctgcaaatattggataatttccttagatcatcaggtttctgtcaaagaaacgtagtatcttttattgtttaccattctgtgttactaaatttaatcctatctttgtgctaagcttttttgtgctctaaaattagcttttacctaaacaaatctgtgtctattttaaaggactaaaaatgaaaaaaataaagttttcagaaccaaaaacaaaccaataaatctgaagtaccagataacgataatctggagtcagaaaaatgacaaaaggggatgggcatggtggctcacgcctgtaatcccagcactttgggaggcagaggtgggcggatcacaaggtcaggaggtcaagaccatcctggctaacatggtgaaaccccgtctttactaaaaatacaaattagccaggtgtggcagcatgcgcctgtagtcccagctacttgggacgctgaggcaagagaagggcatgaacctgggaggcagatgttgcagtgagccgagattgccccactgcattccagcctgggtgacagagcgagactctgtcttaaaaaaaaaaaagaaaatgaaaaagaaaaaatgacaaaagacattatttagctgttaatatgatttacatacatttcaaaaaagcagagaaaattgtctatatataatctaaatcccttaagcaaagagggaatagcaaaatatttttttggaacttattgaagagttttgaactcttggacatctgaaatttgcacactctatgcacttgacagaatgtttatgaaggaaaaaccagaaaagagaaagatgttataaaaaaatccatgagtgcacaagaccaatgcaacagaatagagagcccagaaataatgccaccctcctacaaccatcagatttttgatgaagctgacaagagaaatgtgggaaggattctctatttaataaacagtgctggaataactacctaacattatgtagacgactgaagctagacctcttcattataccgtatacaaaaatcaactcaagataaattaaagacttaagtgtaaaacttaaaattatggcggggcgcggtggctcatgcctgtaatcccagcactttgggaggccgaggcgggtggatcacgaggtcaggagatcgagaccatcctggctaaaatggtgaaaccccgtctgtactaaaaatacaaaaaattagccaggcatggtggcgggcgcctgtagtcccagctactcgggaggctgaggcagaatggtgtgaacccgggaggcggagcttgcagtgagccgagattacaccaccgcactccagcctgggcgacagagcgagactccgtctgaaaaaaaaaaaaaaaacagaaaccaaccaaacaaaaaaacccttaaaattatgagaaaccctccaagataacctaggaaataccattctagacatagaaactggcaaagacttcatgaggaagctaccaaaagcaactgcaacagaggcaaaaattgaaaaatgggacctatttttcaattgtgaagatcttaagagcttcttcacagcagaagagattatcaacagagtagacaacctacagaataaaggaaaatatttgcctctgacaaaggtcgactttccagaatttattaagagcttaaacaagtttacaagaaaaaaacaagcaacctcattaaaaagtagacaggacgggcacagtggctcacgcttgtaatcccagcactttgaggggacaaggagggtggatcacttgagaggagttcaagaccaacctggccaacatggtgaaaccccgtctctactaaaaatatcaaaaattagctgggcgtggcggcaggtgcctgtactcccaactactcaggaggctgaggcaggagaatggctcaaacccaggaggtggaggcagaggttgcagccagctgagatcacgtcattgcaatccagcctgggtgacaagagcaaaactgttgcaaaaaaaaaaaaaaaaaaaaaaaaagtaggcaaaggctgggtgcggaggctcacacctgtaatcccagcacttttaaaggctgaggtgtgctaatcacctgaggtcaggagtttaagatcagcctgataaacatggataaatcccgtctctactaaaaatacaaaattagctaggcatggttgtgtgcacctgtaatcccagctacttgggaggctgaggcaggagtattgcttgaacctgagagtcaaaagctgccgtgagccaagatcgcaccattacactccagcctgggcaataagatcaaaactctatctcaaaagacaaaacaaaatgaaacaaataaataaataaataaaactaatgtagaaacagaaaaccaaatgcatgttattatttaagtaagtgctaaataataagaacacatgaacacaaagaggagaacaagagacactgaggcctagttgagggtggagggtgggagaactaagaggatcagaaaacatacctgtttggtactatgggtaggacctcaatgacaaaataatctgcacaccaaacccccatgacataattttagctgtataaaaaacccacacatgtacaccgaatcacaaataaaacctaaaagaaaaaaatactccaaggtgggggagagtgcaatgtaggtgcatggactgcttttcactatagatagtagcccaggtggggctgtactctgatttatttctgtgtgaatgcaggtagatgaaattacaaacaggtggcccagaccctaggctggtggagaaaacaggttgctgctgcaaatttagtatctaggggtggggatatgccaggagacttgtagagatttttgggttcttggcaagaaacactaggatcaaaaatgccatggtgaagttcttgagggtggtgccgagtcctgggagaagtgtggatacctcaatttctagtgtgtgtgtttgtgagtgggtgggaatcctgtagtagcagctgcaagaaaaggggtctgtcataagagcttcttctgagttttcagtcctctgtcaccctgggagaagacctggaatcacaggacaatgggcaatgtgacagcctgtgtacaggagagcagagcctcccatttctaaacacccagagctttgttccagtccaggcctctgtgatatcttttttctggcaccaaatctgtagagtttgctgagcatcaaacaattctccaacaactaattgtctaacatttaaattctgacaccacccagagtcagcacagaccctgattcagggctcagttccacaacattgtcctcactgcagatgccagtcacaaaccccatgggcccatctacgcttctgagctactgtttgaaaactggggactcccaaaacctccctgaagttcaatgatttggtagagctactcacagaactcatcaaaacactgtagttatgtttaccggtttaatatataagatgcagcccaggaaaagccaaatggaagaaatgcatagaacaaagaaaagagatggggaaagatgaaacacatagataatcatgaaaaatgtttgtgattaataaaattctccagccgggcacggtggctcacacctgtaatctcagcactttgggaggccgaggagggtggatcacgagatcagagatcgagaccatcctggctaacagggtgaaaccccatccctactaaaaatacaaaaaattagccgggagtggtggcaggcgcctgtagtcccagctactcaggaggctgaggcaggagaatggcatgaacccgggaggcagagcttgcagtgactggagattgcaccactgcactccagcccgggtgagagatcgagactccgtctaaataaataaataaataaaaaataaattgtccatcctttgtgtactccaggaacagtttatggaaacacccttcaccttatgacttcaatggtgctcttttttcttacctatcacacaggcaaacacactctctgcacattttctcctatttctcattataaaaatcagctgattttttcttcagtggtcaattttttttttttttggtgtgatcgagtcttgctctgctgcccaggctggagtgcagtggcgccatctccattcagtgaaaccttcgcctcccaggttcaagaaattctcctgcctcagccttcccagtatctggcactacaggcgcccgccacaacgctcagctaatttttgtatttttagtagacacagggtttcaccatgttgggaaggctggtcttgaactcctgacctcaggtaatccgcctgccccggcctcccaaactgctgggattacaagcgtgagtcaccacccctggcctaaaataaagtaattcttaatgaaatttacttaagtttatctccctccgtcaggctcctgaactttgagctaccctcggtctgagtcgacatacaaccccatttacgtccctcctaagaacatgctgatttcagggtaagacattctgtgatctaaaatctgaccttttcaccctccatttgccattcccttcccacctcctttctaatcttgtttaatcctccttaggaaagaaagtccttttgtgcctacagttttgcaagccacaaagaccttatagtaagttgatactttctcctattgcaatacttttttggaattcattgttttacataaatctaacgttgttatcttacaaagtctaaaacttgcctcaaaacaaaaacttcattatcagtaagaccctcccagtttcctttcatcttaatcttaactgcatctgcctgtggggctccagctttccagggctctgtagcttctctcaggataaaggctctttccatagctggggtgagcaggctgggacatctgcagggaagtctccccagcaaaaaaagaactgggcctttaataacctcctgttggccgagtgcgctggctaaagcctgtaatcccagcaatttgcgatgccgaggcgggcgaaaaacctgaggttgggagttggagtccagcctgaaaaacatggagaaacctcctctctactaccacacaaaattagccgggtgtgatggcgcaggcctgtaatcccagttactcgagagcctgtggtaggagaatcccttgaacccgaggtagaggttgcggcgagccgagatcgagccattgcactgcaccctgggcaacaagagctaaactccatctcaaaatttaaaaaaaacaaaaaacaaaataaaaacacctcctttttgcagccttaatattagccttagcttggaattactaggttcaagcttcagtttccatgtcagtgttattcacctggtttttgaaactaagtgtttgaaaaatccagtgaaattactcaaacatagtgtttacataaacggagattttaagatactttttaaaattttattaaacaggagtctcgctctctcatgcaggctaatgtgcaatgacgcgatctcagcttactgcaacttccgcctcccggtttacataaaggaaggaaattttaagatccttacttttttttttttgcgatggagtctcgctctgtcgcgcatattggaatgcgacggcgcgatctcggctcacggcaacctccggctcccgggttcaagcaattctcgtgcctcagcctcccaaggagctgggattacaggcatttgccaccacgcctaattttcgtatttttagtagagacggtgtttcgccatgttagccaggctggtctagaactcctgaccacgtgattcgcccgccttgctctttgaaagtgttgggattacgggcgtgagccaccgcgcccgaccaggaagtggttttttaaccctaaggcagttttgtttttgtgttcttcccctattgcctggggtcagaccagatcatctaaactgatcccgactggcttagaccccaactttttccaaataggataaacggagatttgcagggaaagaagagggaagaaggcgtagtattgatttacaatttttacaatttatgacctggaagttgagtctttcaagaggaacttagttgtcctaacaaccctttacctcaagggatccgcccgcctcagcctcccaaaatgtgggattacaggcgtaagccaccgcgcctggccccataaatttttaatacgagaaaagagaaactgtgaaccccacggaccaaagctcttcccattcgggaacccgcaccccgagtcaagattctcccctaaagaccctctcgtggttcctgcacaatctgggagatacccggagctgtgggtgcagagctgcccagagagggctccaggccggggcacactcgctgccaagggaagagtcaggacgcccgggaccggcttatagagcacccgccatcttttttttttttttgagacggagtctcgctctgtctcccaggctggagtgcagtggcgcgatctcggctcactgcaagctccgcctcccgggatcacgcaattctgcctcagcctccctagtagctgggactacaggcgcccgccatcatgcctagctaatttttttgcatttttagtagagacggggtttcaccgtgttagccaggatggtctcgatctcctgacctcgtgatccgcccgcctcggcctcccaacgttctgggactacaggcatgagccaccgcgcccggcggagcagcttccatcttatggatggtggggactaacgccaagctgggcaaggagaactcagggcacagattgtggagctgactgcggggagccctgagtcccgccactgccacttcccatcaaccagtccctcccctctctggggatgttggaccggtactcttaccatttctagacttctagggggtcctggctcttggctgtggatctcccaatacctgcaggtcaaagggcctcagaggctgggcctctatgagcagagaacacagagcagtgaacaagagatctggagctccagcggcagcaagagacaaaggccgcgccataccagaaagccgtcctcttcgctccagctgcctgcctgattggagggtttccagaccagcctccctgattggattatgcttaaggctctgccccctcagtacctgagtgacagaagatgtaatcagattctgggctgagtgaaggagtaacagcctaagatgcagcctttccagacagggcttcctccctgagctgagccaggctcaccccagagaagggaacaattctgtatcttttttactctctctgtttttgaatgtattcaaaaggtgagcaggagtatttttctgtcatatgaataatacataatatttttgttcaagagaaaatcaacttttactttggtaatagtgtattatcaatactaaagctaattttaataaaaccttataaataaatcaaatttgccacttttaacctctcgagatttacacatatattttgtaatctcttgtaatttttttaactttttatattttatttttatctacattctattttttcaatttgaaacaacctttaagtaatttcaaattgttgtaggagatagaaagaaatcatttaaggccaggcacagtggctcatgcctgtaatcccagcactttgggaggccaaggtgggcagatcactttaggtcaggagttcaagaccagcctggccaacatggtgaaacctaatttctactaaaaatacaaaaaattagctgggcatgctggtgcacacctgtagttgtagctattccggaggctgaggcaggagaatcacttgaatccaggaggcggaggttgtgtaatggcccaaggggtacaccttgccctttggtttagacagagctgatttatcaagacgggccttttgcctagacagagcctattaattaagacaggagaatttgtggaggaaaagttaaatattaaatttgaactcaattgaatgtggacacagacaatggtcactaagtcccagaataggttgtgtgagccccttgaggcatttatccagtgctgtattggagaaatctgtaattcaatctattcccatacatttattattgaaaaacaataggcaatcacaaaaacaaattggcctttttgtgttccttgggcctagtcttgaaaggctgtcataactgggccttatgccaaacaacttgctacaaaaagagctagggtcccagtgtagcaggacaagccacagacaaaacctctcagacatcgagttgtagaaggaagggctttattcagctaggagcatcagcaagctgctgttttaaaatccaagctctctgaatgcacaatttctgtcctttttaaaggctcacaacactaaagatttcacatgaaagggtcgtgattgatttgagcaatcaagggttacatgacaggggctgcatgcaccggtggtcagagagaaacagaacagggcagggagtttcacaatgttcttctatacaatgtctggaatctacgaataaaatcagtttttaagttatgagttgattttttattattaggtttaggccaggcaggcccagggctgcctgtctttaacttcacttccttgtttttttcttaaaacaggtactgagtataaaacaataaaacaatatgagtgggtctctctcttccctcatttcctctctttgagactctcacttttttattagtgggagttctcactcttatttttgctacttatgtctttttgtgcaatagattgatagtgatttatacagtatgcttgtgctgaagtattttggtgaactaaggtagcgacgaagttttttatcatttggagaaatacaggtatcagacaagggagcagtaagcaggttcctgttactattattactcttattataagagttttaaatcttcctatttctggaattaatttctaaacatggctcttggattgagtctgtgccacacttgcacgggtacatgtgctagttttgttatatctttaactatatcttcaactacttgcccctgatcatctgtgtgtagacaacaattagtaaggttaaattttctacaaacttctccttcagctgctagcaagtagtcaagagctagtctattttgatagacagcatttctcatcagagtccctcatggggcaagaacagtcaaggcttgaccagttttattagtaataatttttaaaaacagcttgtaaccctatgatttggttgagcctgtagatgggggctcgatatccttatgagccatcttgtgcctaagtggcaggtctatagtattgtatgattttttcagggggccattcattatctttctaatcacctatggctatgcttcatttttcatgggaagcatagactgggaagcctagaaattcacctgtttttatggacagcaagaagaaatggacagcttaatggtgccaattacacagctacctgtctactgatcaggtagcttagcataagctctgtgtctatagatccagtataacctggtgggggctgtccagtcccgtggaattctgggtggacttaacaggctgcaactttggaaatttactgaatggatttctttctgtgtaattggaacttcaccatgtaactgtttttgtggtattattacacagcttttgtcctaggcaactaagtcaacttacagaatgagtgaattttgttctttttctggatatgcaatattgtccaataattgagacttttagaacctagaaatgatcagggtgattcttttgggccaggaattcatcaggaactgggtccgtaggcactaattcttgggcttcttatggccattgatcttttattacagtttatttacaaacataacatgaagtgatatttagagattgggctacatgctcggctaattgcaaaaacaaatttttagtttttcctggaatctcaggtactggcacatttagttcatcatagaaagtctgaaatactggttctgaagagtgtttttgaacctccttttattagcatgcttatactaggatctagtccttttccatcaatgcctaatgttacattatattttttgttctactttgggtctgaggggtttgtgattatcgattttaaaaggttgcagctcctacttgtgcaggaggggctgacttttcctttttggagctaaacaggatcttttttatctttttttcaagtagcctaaatgacacaagactagtattgacacatcttagataaatatgattcttgacagatatatacatttttttttactgtgtaacttttttttctaatttagagaactgcatcttattccatgctgcttactatcaatagcgcacaagcaccaaattttaaggttacatttttggggacccctctttcttctgttctagctattactttacttgtgtcacttagaaaaggaccagtcctaaattttattttaaaaatgctgatcatgggaagcttaaaatgggtcataacatgcatcaggttatttcttgggctacataccttggatagaatagcattatacaaacaagtttcttttagagtcctggtacacctacaataactataaaataataggactgtagcaatcttttgtcttacttcagtgacttgatgtatatactggaaacagttctcagtctgaggaaggtcagttgaagtctttactgtacaagtccaaattttaaggaaaatgagtgctgcaatgagtttcttcatgctttggctatgtgtggaccagtcagcttctgggtgtgactggagcagggtttgtggtcttcttcagagtcactttgcaggggttggcgaagctgctcctatctatgtacagctcctagtctactgatttttaagggtagtctcggaggttgggcccactagaataaaatgagcctaatacttctacacagtttatgtttaactgggctctctgatactaggagtaaggtggcggggttagggtgttgcaatcttcaatggttgtgtggggattttcacagagcaagctttggtatctagttagtctagcattcattagctaatggtgtcctttggtatttattaaaatcaccacagcatggggggactttatgtttaggttttgtctaagagttagcttatctgcttcttgtggtaacagggccattgctactagggcctttggacatgggggctagcctttggaaacccaaactagttgttttgagagattggccactggccttggccagggcctcacagtctgagttaaaactctaactgccattttttttttctttctgacacatagagtgtaaacagttttgtcaggtcaggtagcctcagggctgtggctgacaagagttttttttttttaacttgtgaaaagctcattgctgttggttgtaatagatgtagtttatctaatctacatttttattgactgtcatctcctaaaatattgacttaaatcctgtaactatttgatttcaggctttaaattgatctggtattccttgcggggctctaattgcatctaaatagatgtgagagttgaaagacctataagggcttctcctgctttatgatgtcctattatttatttatttatttatttatttcctctggttgatgaaatgccagtgtgaaagggatagccaaatggactaaaacacaaatgccactctagttattcggcagagtgcccagtaaaggtctaccacaataccaccacacatccgctcaaggatgaagaagggctgactgattgataagctcttgaaaattcttaagctcactgtatcctttcaggtctctaaggaatgctaagtcttagtgttcctaagtgttaggaagtgaacttagtgttgggagatggaagctggatggccttcggggactgacctgcagggacttcagaatatagcagagagaacttggcatgacttattactctagactgtagaatcctggaaaagagctatcatgcagcctatgcctggtcaactggaggaccacattagtggaagggggacaatcagggcctctggcctgccatgtgcacaagcataacaattgcttttgtttaaggtgcagatggaatatgtgatctattttaaccaggaatttgcatcttggtatgctgtcttaattgccaaagtttgttttaactctttaacttttatgatcctctagtaaaatgaacgtctcctttagcaccaatttttattagtttttagactaaagaaagctaaacaccactttatatttaataatgtttcttgtatgatttttataccagataagctaaattttacctttatattagtgtgttattaatattaatcttaattttaacataaccttgtagacatatttatcaaatttttcatgtttgaccataagttaagattttatagactatttttaaccttttataatttttgttaaagagcaggtgatgctttaagaaaaacctgttgcatttttactttaatgtccagttcacagaaaaactggatgatactgttttaactttagctaatgtgttcacacacagaattttctttataattaacattttaaaacttgcttaaacttttaaaacaataatttttttaaccttttaatgttggtaaaaatctacattcttatgcccttttataatctttttactaaaggtatattttacttttcttatacactttgcacataaacttttttttaaatagtacttaggaggctttattacttttaaattatataacatttttgaataaatttttttataacactttttctttcacaactttcaccaacaattcttcaacatgtctcaactttttgacttattacaaacatttattttttctttaaacaactagttaatttatttcaggacaagaatttaccatataacactctttttacataaattctacctcccccccccctttttttttttttgaagataacaattcctttttttaaagcgaactttctttatgtctttggactagactgtctaaggccacaagattagaagttaccataatacacgttacactgttaacttttagcaaacttcacttttgttgaaaactttgtaagtttgggatttcatttaccctttgctattaataagaccttgtttagtttaaattaacttggaattggtataggtggcctttttttctctctgccggtctttccttgcctctgccagccgcttatgctgctgttctcttaattactgtaggggggaagagggtctaaaaccagctgtaactgtctatgtatggaaactggtctgggtgccttggcttgcagattacattgtgtcatacttttgaaacaagggacctgtccaggcttccttctgatggtcaacccacctctaatgctggccagtctatttcacacaaagttctaagttttcttggtgtcatagtaacactgtaatctctattaaatcttttcttgaaatttttttaacatagttcctaatggggtgggcttacttatgcctgacctatgcttctttgagacaaaacactatgcttacaccacacacacaccacaaaacaaaacaaaaaaaaaaacaggtaaaaagggcacacacacacttttgcagtttacaccaaactaaaatcaaaaccaaaatcagagtatccagaaatctaagccaggtcaaaaccaaaactaaagtatcatgcagtctaagtcaggtcaaaaccagaacaaaagtgccaatgcaggcacactgtgggtgatcaggccactcttccattcagatggggtggggcaagttccaaagactaatcttaccaagtcaagccaagtcaaaaccagaacaaaagtgccaatacaggcacactgtgggtaatcaggccacacttccactcagatggagtggggcaagttccaaagactagtcttaccaagttacagatgtccagactccaaatgccagttccttctgggtgttcagccactgtgttaatcctctgtggggacctgctactcgctgctctggtgaggtgttccgccagggcaatttcctacctgggagcactctttggatcatgtaactcaggctggctggagtcccccgcagagatgctccacagggcaggcttaagccacctgaggggctgcctcagctgcccatcagttacctcatttcccagtcagagaaccaagaaatgtagcaggacaatccgcagaaaaaaacctctcagacactgagttgtagaaggaagggctttattcagctgggagcatcagcaagctactgctttaaaatccgagctctccaaatgcacgatttctgtcctttttaaaggctcacaacgctaaagatttcacatgaaagggtcagattgatttgaacaagcaaggggtatgtgacaggggctgcatgcaccagtggtcagggaggaacagaacagggcggggagtttcacagtgttcttctatacaatgtctggaatctatgaataacattgatttttaagttatgagttgatttttaactactaggtttaggccaggcaggcccagggctggttttgggcctggcgccaggctgcctgtctttgatttcacttccttgtttttttcttaaaacaggtactgagtataaaacaataaaacaatatgagagggtctctctcttccctcaccagagggggccaaagttttatgagacatctcctcatctgtgcacagatgggtggcggactctggagtccaggctgttgcttcccattctagtggtgaatcttccatagtctggtgagtgtaaatatatatacatctctttttccttctcctattcccattgcaatttgcttttatcaatctgcttattacattgatttgcttattatatctgaattgccatttatgtgggataaagtttgtttacccttaaaggtattgtgtgtgtgtcttttcttctccccttctgtgtttcccacacagaacatttttgtcattacaaacagaaatcaaaaacaaaagtgtgctgcttcttggccagaaggacagggctgatggctacgggacttcccataacctgggatgagaactcccgcagttctccccctttgtgatcgaatggtccaggggaactgacctttgtgagaactgggaatcttaattagtgcaatttaaacctttgcctgtgcatgaagtgctgcaggagattccagtcagcaaaggagctgctgagttgatctcccggagtggatggtgtttgcttactgcttataagttaatgtatcaagacaggggatggttgctacaagagaaatgtaagctggaaaagaaaaatgctagtctgacttccagactggccctggcccaatgccaggcctatgtcttgactgatcaggctcaaagatatccacctattgatgaaaaaagcagctgtccaaatggccccatcatggtaaaactgaagaactagttagctaggcttggagcaggtaaaaacccagctactggccaggcacagtggctcatgcctgtaatcctagcacttttggaggctgaggtgggtggatcatgaggtcaggagattgagacaatcctggcaaacacggtgaaacccagtctctactaaaaaatacaaaaaattagccaggcgtggtggtggctgcctgtagtcccagcaacttgggaggctgagacaggagaatggcgtgaaccagggaggcagagcttgcagtgagcagagattgcaccactgcactccagcctgggtgacagagtgagactccgtctcaaaacaaacaaacaaacaaacaaaataagcaaaacccagctcctgtctcaaggatgggaaattaaccttagtaaaattcaaggacctgcacaaagtgtacaattccttgacatcttatggaatgcagagaaatagcccattttaccaaaggctaaggctaaaataccagaatttgcaacccctagcaccaaaaaggaggaccagaaatttattggtttgtttggattctggaaacatgatattccccacttgggtaacattttacaacctctgcatgtagtcactaaaaaacactatgactttcactggggagagaaagagagcatggcttttaacaagctaaacaagtggtgcaactggccctggatctgtggcccatatgggatgggccagtagaactgcaagtaactgtcccagatcaacctgctaatttgagccttaggcagaaacctttcgggtttgggacccagaaactgccagaggctggcaaagcttatacccctttgtagaagaaattgttagcttgtgattgggctttgctgaaaagagaacaccactgcttcaaccttgatgtctttatgaggcctgaaattcctatcatggcttggtgtcatgaattccccaaaacccaccagataggacatgcccaaggaagtagcatcataaaatggaaatggtacatacaagaccaggctaagccaaaaccaaaggggttatcacttttacatgaggatgtacgaaacttgtccgctcaaaaaaccaccaaactatcctgcagataggaaagaaaccccccccacaatccacccaaaggggccaatcttttaaataactaagcccaaatgatcagaaacatgcttaatttatggatggatccacaaaatacattggtgggacccaatgctggaaggctgtggcttctgttaatcctgttaaaacataagcattactggccagatgcagtggctcatgcctgtaatcccagcactttggtaggctgagttgggcagatcacgaagtcaggggttcgaggccagcctggtcaacatggtgaaaccccatttctactaaaaattacagaaattagccagggtggtggtgtgcacctgtaatcccagctactcgggggagtgaggcaggaaaatcactggaatcccaggaatcagaggttgcaatgaaccaaaatcacaccactgtactccagcctgtgcaacagactgagactcaatctcaaaaagaaaaaaaaaataa

SEQ ID NO: 277 - DNA, 403509 bp, Homo sapiens
ttacgttccaacagggcagggcatggtggctcacacctgtaatcccagcactttgggaggctgaggtgggcagatcacttgagctcaggagtttgaggccagactgggcaacgtaataaaaccctgtctgtaccaaaatataaaaaattagtcaggtgtggtggtgcataactgtggtcccagctactcaaaggcagaggttgcagcaagctgagattgcaccactgcactccagcctgggtaacagagttagactcccacctcaaaaaaataaaataaataaaagaaaaagaaaaaagaaaaatttacacaacagaaaggaccatgggaagggaaggagaaaagctgattgttgtattgttaccagaaaggggtcctgatccagcccccaaaagtgggttctcgggcaagaaagaatttggtgctagtccatggagtaaagtgaaagcaagtttgtaaagaaagtaaaggaataaagaaaggctaccccataggcaaagcactaccgagggctgcaggttgcacatttttatggttatttcctgattatatgctaaacaagagggggaattattcatatcttccctttgtagaccataggacaacttcctgacgttgccatggcgctggtgggagtttggagtgaggatgcccagaggtcactcttgtcgccatcttgggtttggtgggatttggccagcttctttactgcaacttgttttagcatcaagatctttatgacctgtatcttgtgccagcctatctcatcctgtgacttagaatgcctaactggctgggaatgcagcccagtaggtctcagtcttattttacccagcccccactcaagatggagttgctgtggttcaaatgcctctgacggtataaatatgtacagaagagaggcaagcatattctggtgagcattctgggctcagtaatctttttttctgccttaactagtaaaataaaggctccccacaaaaagctggccaaatacatggatttttcagtaagctgagaataacaccaataacaactggcctacacatttttcctaatagacattagtttgtccatgcatattttaatgcatgatgaagacgctcttaatattgatttaaatcacactgctccctaaaatcttctggtttttagagatggagtttcgctctttcacccaggctggagtgaagtggcacgatctcggctcactgaaacctcagacagcgagagaaagagtgtgtatatatatatatatatatatatatatatatatatatatatatataatatatatatatataaagtatatatatatataaaatatatatatataaagtatatatatataaaatatatacatataaagtatatatatataaaatatatacatataaagtatatatatataaagtatatacatataaagtatatatatataaagtatatacatataaagtatatatatataaagtatatatatataaagtatatatatataaagtatatatatataaagtatatatatataaagtatatatatataaagtatatatataaagcatatatataaagtatatatataaaagtatatacatataaaagtatatatacacacacacacacacacacacacacacacactttgaattctaagcatcagcactttctcttagaatgtaagagccaatgcagttatcaccatatggaaaaaggccagaaaaaggtgaagtagaaaatacaaatgtttcagttaggggcaatggcttgcttgctcactataaaacaaatgccttcatcctttgcacttctgcacaggcattaggggaaacttgttctgatcagaaagggagttttaaactcacatctctcactgcagatctttccagggaactgccctcagataatgtagacttcactaggaaatggctggttgttgggtttttgtgcaatgcaaagcggtaccttcaaagaggagctttgcatcagcttcattttcctcagaagagcaggagaaggctagtgggaaatttgatttcacacatctttattggagcttcatttgtataaaggtgatcactaggaagggaattttttttttttgagagggagtctcgttctgtcgtctaggctggagtgcaatggcgtgatctcggctcactgcaacctccacctcttgggttcaagcaattctcctgcctcagcctcccaagcagctgggattacaggcgcccaccactactccaggctgatttttgtacttttagtaaagacagggtttcgccatggctggtctcgaactcagcctcccaaagtgttggttttacaggcgtgagccacccatgcccggccagacaattttaccatccataacatagctagtgtttctcgtagtggtatagaaacatctgtctgccatgctggctggctcacacctataatcccagcgctttgggcagctgtggcgggcagatgtcaagagtttgagaccagcctggccaacatggcaaaacccggtctctactaaaaatagaaaaattagctaggtgtggaggtgtgcgcctgtaatcccagctactcatgaggctgaggcaggagaatcgctaaaacccaggaggcagaggttgcagggagccaatatcgtgccactgcactccagcctgggagacagagccagactccgtctcaaaacaaacaaacaaacaaacaaacaaaatctgtcaccagagtctaagggaaaggtgattgtattacttgcttactgggattaatttatcagtacctatgacaacactttaaatctttcactcagagattaggaggggaggataagaaaactaatttggaagtctgcctctccttgctcagacaacacatgaaaggttgctgcaactctttagtgctttagtgctcatctagtctttcaggcacttcctagccaaggaaacatcttctagctgtttcttcctctgctccactaaagctcctgggacttcatttatggcagataaaaaacaattaaatataagatttttaaatgacaataaaaataaaaagagcaattgagcaattgggttgtcttttttacaatttaaaatttcctgtctttagacatcctagagttgttgattccgggattcctggggagaaaggctcagggtcggctaacttgccttcatcgaggcaatagttttatgggcctcaggcaacaatggcttagagagcgtccaactaatcaatctcagctgtagggatggaagtgggtgggtgggtacagctcaagcccttggtacaaagcagcccgctagtctctaagatatgttatcttaactcccacaaagtgccaactcccttcaatatttaaagaacctgaggccaagcacagtggctcacacctgtaatctcagcactttgggaggccgaggcaggtggatcacccgaggtcaggagttcgagaccagcctagccaaaatgatgaaataccatctctactaaaaataaatacaaaagctagccaagtgtgatggagggggtgcctataatcccagctattcaggaggctgaggcaggagaatcacttgaacccagcgggcagagcttgcagtgagccgagatcatgccacttcactccagcctcggtgacagagtgaaactccgtctccaaaacaaaacaaaacaaaataacttgaaagagggcttagaggccgggcacggtggctcacgcctgggtggctcctagcactttgggaggccaaggtgggaggatcacgaggtcaggagttcgagaccagtgtggccaatatagtgaaaccctgtctctactaaaaatacaaaaaaaaaaaatcagccaggcgtggtggtgtgtgcctgtaatcccagctacacgggaggctgaggcaggagaattgcatgaacccgggaggcagaggttgcagtgagccaagatggcgccactgcactccagtctgggtgacagaacgagactccgtctcaaaaaaaaaaaaatagaaagagggcttcaaaagcattgcttgaagcctgacctatttgttttactcctgattttgttcgtgattcattgagaatatttgagttctaagcgctttgccagcaggtgatggtggtgataaagcacacttgcttcccgccctcagggaacttgcattgtaatgggtaagagccaagacagacaatgaacaagtcaataatcaaacatataattacaattgtgatcaagaatttgaaggttaagacagatgctctaagacagggaaataacctactttaaaggaggcctcttggagaagctgaaattcatgataaaaatggaggtgaaaggcagggcgcggtggctcacgcctgtaatcccagcactttgggaggccgaggtaggcggctcacgaggtcaggaggaggtcaggagtttgagaccaggctgaccaacgtggtaaaatcccatctctactaaaaatacaaaaattagccgggcgtggtggcgggtgcctgtaatcccagctactcgggaggctggggcaggagaatcgcttgaatctgggaggcagaggttgcagtgagccaagatcacgccactgcactccagcctgggcgacagggtgagactccatctcaaaaaataaaaataaaaataaatgaaaaggaggtgagaaggattaaggcaagcaaaatagataagaaaaatatttgggcacagaaaaaagtgagaatcaaagccgggcacagtggcagaaatggtatgtcttcacttagaaagggtatatatgtctagaaattcaataccagaattctttagcttcataggaatttctctgtgacataagaacaaaataaatatttttatgtcttcttttgtttctcggttgccaattatccataaacgttttggctaatacgcgttgaatgcgaaagtatgcctatataatgaagagggaatttttcagaggaagctagtgagttttccagaggttaggagacaatggcttttatgtttcatttgtagcagggaggaacttaagtgacctagaattttttacctttaaattttttccagtgtagaaacaaacttgtagtgcattctgtattgcttggggagaggaatatttcactttttctctgttgtataaacactttaagttctgcattggtgataaaatgaataatggtggtacaaatggaaagctatataactaattgtttgtcatacacataatcatcactgcaaaatgagctctgggaattccattctagtgaccaggaaatctctggtatgagcaaggactttttataatgttaccaagtatgttgggaattgaaatatttatatagattgtgtagtttttagaacttagagtgcgttagagaagagttaattctctatttaagatatttggtactgtagatagactatttaaaatctgatttgttccattaggttctccctttaagttcctgatttaattcagttaactggttctccctttaagttcctgatttaattcagttaactggttctccctttaagttcctgatttaattcagttaactgagaaatgtaattttaatttcttatttatttcactccttcagtaaacatttattgactgtcagctgtgagagtcttcatgctaaagcaagtgtctgcaccacgggattactgatattatgggctgaatcattcttgcttatggggcgcggtggtcgggggaggctgttgagcagcatccttgatgccagtaacattatccccctaccccactgtgacaaccaaaaatgtctccagacagtgtcatatgttccctggggagcaaaatcatcaccccagtccagaagcattggtgataatgggaaggagcagatgagagttggaggtgggggtgggaaggaggcaagagaagtggcacttggggtgggacacatgaatgcatttaagagacattacgaaaaaagaatagagaagtcttcgtgactggtaaattatagggactggggaagaggaaggagtaagcaacaacactggtttgggaaactggagggattgtagcgctcttactcaaagaaaaaacaaaagaagaacagatatgaaagaaaatatgagttcagttgcagagacattggatttgactggaggcatggtgttctctaggaagtaggttcaggagtcgagtgtgttggagtgaagtcaggactgagaggtggattttggagggcaaaagattagtaattgacactagggcaaaaaagtgtcattcacctgctagagaaatggatgagttggataattaagatgcaaactaattgttctattagagattctaaagcattccaccaaggttaagcagaaataaaaactaacaaaacagagcaaaacaccaagtatcagaaacatttcagtgtatcttatagtcaattaagagggtaaatgaggaggaagagagctggaagaagagagaaaaggaaatgaaatggaattctgacagacaggtaatcgtgaaggagaggaagattcatttagtatcttttttatttttatttctttgagacagaatctcactctgtcacccaggttggagtacagtggtgcgatctccgctcactgcaagctctgcttcccaggttcaagcgattctcctgcctcagcctccctagtagctgggactacaggtgcccgccaccacgcgaggctaattttttgtacttttagtagagacggggtttcaccgtgttagccaggatggtctcgatctcctgaccttgtgatctgcccgcttcggcctcccaaagtgctgggattacaggtgtgagccaccacgcctggccatttagtatttattaattgctatcaaccattacataatttaatttcaaaaaatctgggaaatgcatgtattcttttttttttttttgagatggagtcttgctctgtcgcccaggctggagtgcagtggcatgatcttggctcactggaaagctctgcctccatggttcatgccattctcctgccgcagcctccggagaagctgggactacaggcgcccgccaccacgcccggctagttttttttttgtatttttagtagagacggggtttcaccgtgttagccaggatggtctcgatctcctgaccttgtgatccgcccgcctcggcctcccaaagtgctgggattacaggcgtgagccaccgtgcccagccacgcatctattcttgtaacccactttcttcttcaacatttgagcatgaaaagtttcaaacagtccaggtgtagtagcttatgcctataatcctagcaatttgggaggcaaaggcaggaggatctcccgagcccaggagtttaagcccagcctgggcaacaaagggaaacctcatctccacaaaacaaattgaaaaattggctgggtatggtggtaaatgcctgtagtcctggctattcaggaggctgaggtgggaggatcacttgagcccaggagctctaggctgcatgagctgtgatcatattacagcagtctgtgacagaatgagaccgtctcaaaaaaaagagaaagtttcaaacatacagtaaagttgaaggcagctcccagtgaacacccatatatctaccatgtaaattatataattaacattttattatatttgttttatcacatatctgtccatgcatctgttaaagtatcttattttttgatgcagtttagaataagttgccaaaatcagtacacttaagccaactacatcagcatacatattctcagctagagttcaatatttgtttagagttttctaacctacttttactaattgaatttttaaagcccatatccaatttcctttgtgggaaaatgggtggtactttattttataaaaatagtttttgtgaccattttggaatgctaacactgaagacttttattgataattacactagaattactctagatacatcaatatagaggctggtcacttttgctgtttctcgtctgtgtcttgctaccaggatgtggccaggcgtgaggtaatatctctaattatctgttaaatctagttttgcaaccacagatatgatattcttacctgatcaaatggaattaaggttaggccatgtttcaggcatccttaggaatactaaatagctattaaataacaagaaccctttggcaaagctttgtagtttgcctttatgatatccttaccggtcccccaagagtaaactatgcagtgttttatgttataaaaaaattgtggtctaaatttgcaggttccagtattctttctgctgctatgtgatcttggacaaatctcttagcctctctgagcctgagctcatgcttcaattatccttgagttaagagcacctatgtgtatttgatacccacacttgtgaatttcaaatgagcctttgcatgcaatagagatttgtcagctgtgacctgctgcacaactgtcactgtgaaaaaaaatcatcaattctttccctccctccttctttcccttcttttgtcttctgaacgtctagaatatagcacagaagaaaacaataaggaaatcagtagttcagaatcaaagacgttctgctaaagaaagagcaaaaatcaagattcaaagtacctcagcactcaaagaagcagaaaattctaatagctgcaggcaaattgtgccctctgaggagcctagattctagaaaaaaggagagagcagtcttgtgaaagaggtgaaacaaaggcttttcatgtactccggaattgcttggagactgggatataaccctggcaaagttattaaagttgatttctctaaagcatttactcgaaagggccacctaaggataactggctaactgcccttaaattacatttatttttaaaaacatagtttgaaaaaggttagtaaccaaagacttacaagaccaaccttttttaaaaaagaattttaaaggctggttcataatatgcaaaggaagactacacatttgcttgctacatttaagttgcacagtataatatatagcttttctccctcctctgggttattttgaaaatattaataagttggatgtctattccatattttcaaagtggttatcaatgacttttacttaaatacttgtaaaacttattaatgccactttaatctcagtttactgcttaaagctttagatatccatatttttttaaaaaaactattcttaaaaaataggtaactaaatttaataaataatgaaaacaatgacaaaatattcaatgaggaaaaatgtttatccccatattgtggccagaacgttaagaaacttttacaggacgaagtctgcctggaagggtttgcttgggaaagtggtagtttatagcataacatctgattttgtgtgtttgtgccaagggtgtttcctttctgtctttttcctttttataggcagccacaatagtgacatgtttaatattgatgagtttgacctcctgggagttatcgtatatgcaccctttttgaatacaaatgctgtttaatttatatggtaaacacatagaatttggagactagcattttaatcaacactaatctcagtattttctacttctcctacctctccttctgtcaacaacaacaaaaaaatcacaaaccaattttataaatgacagctaatgtcctctcctggagaagcagggtctgtgtgtgaaacataaaagcagcaccatgtgtagtaacctctcctaaaccatatgctcaagcacattaacagtgttcaattagatgatcaattattcaagaaacagaacaatccattcattcaacaaatatttattgaacagccatgcagaggcagacagggggttgtgtatgtggctgtgacccgatggcacctctaaactggaattgggcttcagtttttctccgtgtaaaaatttcttcttttttatttaacttttctcttggcaggtccagcagctttgaagatcagagtgcatcttccagctgacgatctcttcggtcggggacaatgcattcgattcgcacggtggagattaaagtccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgcgctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggaccggttcctgctggggccgagcggcggggctggggaggccccgggcagtccggacaccgagcaggcgctgtccgcgctctccgacctgcccgagagcctggccgccgagccccgggagccccagcaaccgccgtcccccggcggcctcccggtctccgaggcgcccagtctcccggcagcgcaacccgcggccaaagactcgccctcctccacggctttcccatttcccgaggccgggccgggggaggaagcggccggagcccccgtgcgaggggctggggacacggatgaggagggtgaggaggatgcttttgaggatgcgccccggggctctccgggggaggagtgggccccggaggtgggagaggacgccccgcagaggctgggggaagagccggaggaggaggcgcaaggacctgacgcccccgcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacaggtgagcgcgccctgctgctggcctccgggtctcaagtcgcctgtcagtcagggccttcccctgccacccgccctccctgggctctggaaggcggtgacctggtagtggcacatctcttctccgtagggaatccttttccgcccagcgagctcaccccccacggtgaaatgacttggacatacttgttggttttctgtgttcttacaagatcttaaagggaacaacttagttgtgtctgtcctaagttgctctgcccatttcaccaaaatacctgctattcacaaagtttcgggtcacgccagggagataaactcctttttcgtctcgttagctaaaccatcattcttctctttcatttttcatcaccacagcattaaaaagaaaaaaaattgttcatggttctttcgcaagagtcggttttggaggcacaaatcatttattccggtacgatccaaaggcagtctctgaccgctctcatagctgtgtgtatttgtccacgtttggtatgtatgtgatatgtagtttctatcttgcagcagtctgggttccgctgcttagtgaagttaagcggtcactcactgctgtttgctgctgcaagaaaatccgatacatgctattagaaaattaataaataaatagaatagtagggataattttcattcagtttcatggtccagcccagaacagcctgtagtttggagacagtgaaggtggaaaggtcaaaagcacgtctagtccaactggtacctcccctccctagcatatgttatagactcatacccagggcggcataaagcacagccagagtatgtttgctctggtcagtgtcaagcagtccaatgagtttatcctagcttacaggcttacagggcccaaggccttaccttaagagcccaacatgtttacctaacctctattcttaattattaaatgaaatagagtgttagaatttaatgaatcgaaaaatatgaaaagttacatgactactgataggtttatgataaatatttgaaggattaaacatttcaaatgcaatctgaaaattttaaaatcttatgttctattattttaataaatacattatctgtaaaacattgcttagatgaaatttctcggcacagacagcgacttcttagttgactaaatgctggtaatattggggtagctacttttattgaccacattttaattttcatctgtgggccaccttttattttgcccttatagggtcttacccttaaaagtagcttcttccattcatttcacatactcttatttttcttcttttccaccttctctttattgtgtagattgttaaaaagaatgtttgtagttttatacccactagataaattgtaaaaaaacaaaaacaaaatgcaaaacaaataaaaaagaaagatcacttttgatagaagaagattggaaagtttttgcattaatttttgtgaatttaatgttggtaagaaatcacatattttctctttatctaagtgacattcacgtatatagtttttgaaaagtgaaaataattcaccataatgattatcaatcattaatattaatgatagctattcctactagcataagactttggaaatttatttatttcattcatttagcaaatatatatatgtatatacatttgtaagcatatatgtgcatacacacacacacacacacacacacattgagcagccacattgtgctaggcagtattctaaatagtagcacactgtgctaggcagtattctagatgtaggtgatacatagaccattaaatcatgattttgcctttctaaggctcgctgactagtgaggaggagacatgacataagtgcagtgcacagaaatatctgtatagatatagacatgcaaatcactgctgggaacatcacggatgcagtggcttatctgcttggtggcaaggggtgagggaagaggacttgagagaggaggattgaacagagtcctggaagatcacaagaccctaaataggttgaatgtttgttttcctttaaaaaaacaagtgtcttcttggaacttgcattttagtttaatttgctaagtattcccaaatttgaaatttgggactcttaaaagagtcctgtataggaaccacctgggttttgttgacctctccaggtgatttgttttttaaattgtgcaaagtaaaattgcagagctagtcgtttttataaggacatcacctattttgtatttgatggttggatacagctggttggtaatcagcaaatatatttttgtgtagcagcttccgtatgtttatgtcattcactcagcattgttcaggaaaagaggatcagtaggttttacctaactttgtaactggtgggaaaatgtagatagagaaagaggtgaaataactttctcaaggtcacactgtgattcattcagaggcagatccagaaatagaaactgagtcaatgaatcaagtctaatgtcattattatttctgtttggatatacaatgttttaaggccatatagagagtaaaaactgtttataaaaaatgtgatcagatttagggcctttctttaattagattttccagttcctgtttttaataaggtgtcctcctttaatggttgaacatctggccttccttgagctggatgaagggtgattgttggccagagtgaaccagattttctctaagcagctctcatggaaactgttcttatggtggtcaaatgaatccagattgacacaggcccttgtgtctcagctgtcaactcttcatgtcatctgccactacgtttgcttctttactctcctctgctatttttttacgggtgtcttggaaattaccagaggcttggggaacactggcattgtccttagggaaatttctttttggccttaattttgcatgtatttggatcaattaattgccagctgcctttgaagcaggtgatcattatatctataagcttccataagcatcttttatttttaaaccatagaatgagggttgtcagcattacaggaagaaacagatgtttttcgctttttaccgccttccaaatgtagggagaaaatacaagtgaaaagggatttctatggcacatgtctgtgtctctttggtagatctaaaaacatttagcaatgagggagaccaaactttatcttgttttagctattaagaaactgatgatgccttaggccattgcatttaagtatttcataattaatgtgtttgaaatacatctttttcagtgtttagtagaaaaaatggcgtctgaaattcgggaggttcctttacatattaagtataacagaagcttggtactggagttttgcagttaattaaagtttagatatccaacgtgttaaatttgtgatgctaaatcgcttttgataggaatctttcccaagtcaattatgtgcttatctttttttttaaacacatggaataaaagtttaatctgttttaaagggcttaatgtcatcttcaggcacatcattgttacatcttataaaaacattagtgatgtcctcaacagctattgaagtgtgtgggctgttggcttcagtctgtagtttctgagtttttgtgtctgtgtagtttcttgattgttttcttgctgccagctatttattgttatagctgccttttttttttttttttgagacagagtctcgctctgttgcccaggctggagtgcagtggcacgacttctgctcactgcaagctccgcctcctgagttcacgccattctcctgcctcagcctcctgagtagctgggactacaggcgcccaccaccatgcccagctaattttttgtatttttagtacagacggggtttcaccgtgttagccaggatggtcttgatctcctgacctcgtgatccgcccgcctcggccgcccaaagtgctgggattacaggcgtgagccaccgcgcccggctatagctgtctttagtctctttgctcctgtccctcaatttttttgtaatttgacttttctgatcaatttgcaattggcttacaattcctgtaattatgatattggttacacttattgtacttctaagtgccagactctgttggtgcattacataactatctgtaatccttaacaacagtcttgaggtgtagctgtttatcctcatttttcgaatgaaaaaacccaggctcagacagtaaagtaacttcttgtctaagggcattaagctagtaagtggcccatccaggatatgtccttagaaaaccaaatctgttgttaatatgtataagatgaaaccaagtagatcattgagcttttggaggactagctaattaataaagtgcataggctctagaacttggattgtgcaactctgattttggcctttctaaaggttatcttgaatttttttttttttttttttttggagacagatttcactcttgtcgccaaggctggaatgaagtggcgtgatcttggctcactgcaacctccgcccactgggttcaagcaattctcctgcctcagcttccagagtagctgggattataggcgcccatgaccacacccagctaatttttgtatttttagtagagacaggatttcaccatgtaggccaggctggtcttgaactcctgacctcaggtgttctatctgccttggcctccccaagtgctaggaggcctatcttgatttttatatcagtagagggaagaacccactctaggagtacacattttctcatacggcttggtaaattgctacattggatttttttaaggccaggagtagtttgatttccagcagagcccctgacagagtatagatgtccagttaatgtctgacgaatgaaggtcagaatctgcctgatacgtataaaatgtcttattataaaaggaaaggggtttatatgaatgctatgctttcccctaaatactgccttactgggttccatatatcagagaagaatttggcgatgtaagcggggaccagaacactgatcttcaatcattttagatgggtctgaaacatcctttctcatggtttctttaggcctgtggtttggattgaagtcaagtgcaccagtagcttcagggatgggttttaatgactgctttatgagttgaggatgggcctagttttaagagctttaggcgtttggatataagccatgcgtatttgaaatggagcaggtacttttagtgcttttccttctgattcttctgaaaagatacagaaaatatacagttggatgaaggtagcagtagttattctaactacgtttattctaggtatatttgcaatcctagttttgctgtttagctaagtgagtctccagtaatttttcctcatatctatgaaggtagaagaataatttcaaattaatactattaagatgaaatgaaatagcatacataaagcccctacaattctgcctggtacatgagaggcacttaactggggctatttgctctcctgactggatttattatcttaaaaaaaaagtcattgttcaaagtgatcagagccaaatttgttaaaacaaccctgaaattgtatacaaaacttagcaggatatgaactgaccagatactagttgagccccagttttgttttgttttgtttttttttgcaaattgtttatgtattattttttcttttttttttctggaattgtaagcattttgtcacttatcagatattctgtggtggggggttggataagaaaagcatatgatggggtgtggctgtaagatttgggggagggtgctgctttccaaagaaggggtgggaagaggaggcggtagctgacaccctcagtgtttctgctctgcacagcatctggctgcaaacccctgactttgcagctttaccttcccacggtctccttcataaatgctctactttacactgttttatgaacatgcatttcattttcccgactttgtgcctttgtcttgcagctttaccctcttggaatacatgattcgtctcttttgctttagcatttgaaaagtgctgattgaattccgtttcctctttgtatcttttccagccagaccttactggctgtcatctcactttctctgtactttactgtctagatcatattatatatgcttcttggatttagggattcttctggtcttctttcttgccaccctctgcctttccttcctccttgcctgttcacccgattccatccatccatcatctcctctcctactaatctgtccacagatatctcttccgtgccttgctctgtgcctgtcaatatgtgtaaagcaccgactgtactgaggtcttgatgaatacttgctcattcaccatttttggcagtgatatagacaagttgagtatccaggcttcctactggcaattaaaactagttgaattgaagctggaaaattgctaacctttctgggcagtcaaaattaattattttcaatgaggtgtgattgaatcaatgatactttatagaacttatgttgatagaagaatagctattcttgtttctgcaggttaatgttaaaatagtaatgacattacagcaactgaccttccaaatataaatgttattgtaatgaaagaagaggtaaagggaatagagaaaattgtattcctctgttcattcctgttttgtattctaagtactaacctaatgctaataaaagttagcattaaggaaccattaggaagaaacaaaaatgtactgcctgtgacttgatagttattagatatcattttagtgacagtagaaactttctaaggcttttttatcttaaaatatatggaaaatatgacctcagtcagttcggaatggtagtaaagcaaggtagtcataacatcaaaattctaagaatgagtaacaattatttctggatgctataataagatgctaaccacactagagatttattatccttttgatacctactgctccactatgggtgagaaggagggaagaatttatgtcttcttcctttgtaaagatgtacttggaagtgttgattggataggaaaattactgcctctattctgtgatccagtcaggctccaacctaccaggaacccactggaagctttattatctgttaccctagagctgcaatggactgaaaacagtcctattgttttcaggaggaatggaatactttcttgagaaaatcaagcctatattatgtttcaaaattatgcttaaaaaggcttaggcactactcagttgagtctttttttgtacttcatgcagaagggttctttgttgtagtacctggtgatagagtggacacatacaggaagaaattctgtgtcatttaaatggttgttttaggtacgcaggaggggaaagaatgtgtttcagtaagctagtgtcagcactatgggaagagtgcaggctgagaacaatctatttcccttttccgttttaccaccagcttcctattagggcacaaggcaatcatttcttgcctcttgttaataccctggcttcccagattggaagagtgaatgcaatcttgctgggaagcgtcttccttcaagtcaatttcagcactgtggttctatagatatggtgattccagcaggtaccttttctccctaatagggatgctctgtgtatttagagctttcctttattggtagagctgaagaaaattcctatgccggaagacccgtttataccacggagtaattgatggtgagagtggtgatgttttgactttgatagttttgatcaatttttgattcatgctgaaggagatttgcattggttagactgtcattatctgacaataggaccgtgtgtgtgtgtgtgtatgtgtgtgtgtgcctgtgtgtctgtgttgtgtgtgtgtgtgtttgagacagggtcatgctctgccacccaagcgggagcgcagtggtgtgctcatggctcactgcagcctcaaactcctggtcccaagcaatcctcccacctcagcacctcagcttccagaatagctgggaccacaggcgtgagccactatgcctggctaattttttttttttttttttggagagacagggtctcactatgttacccaggctggtctcgatagggccttgtgtttttgaacactgatataatgattatgtatgatggttgatcgtgtgttatgaaaatgtatgaaatggaaagctatgttatataatgtatggctcgaagatttagaatatatgaaggctttctaatattggcacaaaatatactgagtcattacttttagtttcattatctgcaatgtaagtcatctcttgttcttggatggattgtaggctttgaatttttcattatagtttaaactgctcaataaaagcagtactattaattctcttacttcaatatactttaatatattggtttttgttatgttttcagtttttcctactattgaatatgcttactgaaatactttttatgagtctgtggtattccatttagaagtgtgcattgatattaaaaatttcttagaaactagaaggttaaaaggtgttgagaggtcctaggttttttactttaaaaagaaaaaagttccattggccttaaacaagtacagcttgtttgagcccattaaggactagaatagaactatttcaggatcccaaataaatgcatttgaatactctgtggagagttttgtaaggatgctcttcattattgagatacaaggtttatcttttaaaagtataataaaagaaatgaggtaacaatagggataatctttgaaactcattttttaacctatatacttgtagataattggcttctttttcttatagaccaatacttgcctgtttggagagggtaagttatgtgagctctctgtgggaagtgttacattttgcagctaaccaaaatgttcttctataagccaattatatcttctgtccttttggtgctattttggttaaatggctttggggatataaaatgtgtggatggtatccttgcagtttctttcagggtatagggattgatctgtctctgttcaatttttagaaaaatccagaagtatgttgactctgttggattcaatattttggggataggcagagagggttgtataagaactgcagtgatttaagtggagaaagtggagagacatttgactgggctgacaacgtgatatcagtaaaaaggtgatcctttaattttttttttttttttttgagacagggtctcactctgtcacccaggctggaatacagtggcgccatcttggcttactgcaacctctgcctcccaggttcaagagattctttcacctcagcctcccgagtagctgggactataggcacatgccaccacacccggccgatttttgcatttttttgtagagacggggtttcaccatgttggccaggttgatctcgaactcctgacctcaggtgacccgcctgtctcggcctcccaaaatgctgggatttcaggcatgagccactgctcctggccaatgcctttaataacttggattatttctctaaggagactcatttgactctaaattcacagatcattttcatatcatctgcttttggataataaaagctaggcatgtggctttagctttagcttgaggctaagcccttaaggttgagcccctgatttccttttgtatgtgtgcttttgtctttgtcagttaccaatagactgctagagttgtgtctgcagtttctgtgtttctctggacctcagacatatctcacttagacatcacaagcctaggatattcaccgtgtctaaaactatacttactattttacccaccctcttaacaccctccttctgggtttcccaaacaaggcattgccgtctagctttgccatattcttggattcctccatccttctcatacttcacacccagttaatctttccattttctcttttcttttcctaagtatctctttaaaatgtcttccaatttctgtttccattatctctacccttcctagtttaaatccctatcaacagcctcctcaacattcttttgtccacaacctgcgtttctccactccattctgcatgaagcaagagagtaaatgacttaacatacaaacttgaatgggttccggtatagaaacatgtcattggtcccctatcaccctgaggctattgagtttaaattctttactatgtacatattaaatatattaatatagacattattattatttttttttgtgacggagtcttgctctatccccaggctggagtgcagtggtgcgatctcggctcactgcaagctccgcctcccaggttcacgccattctcctgcctcagcctcccgagtagctgggactacaggcgcccgccacctcgcctggctaatcttttttgtatttttagtagagacgaggtttcaccgtgttagccaggatggtctcgatctcctgacctcgtgatccgcccgcctcagcctcccaaagagctgggattacaggcgtgagccaccgtgcccagccgacattatgttatatagcatatataagctatatattatatataatagacattatatatattttaatatgtattaatatttaatctctgtagttttgtcacctcattgttcaggatctactattcctcacctcgtcctaagtgcttcagtcatttttcagatagctcatgctctctctggtaattttaggtattattaacactttttcttcctggtcctcagagaaaaaaagaatccatgtagttgtattcatgagaatccagtctgtgacacactcgcatcatcagtccaggcaaaactcgttttgtccttatcatactccctgcattttcacttcccattccgaagcctctagtagacatacagaactgcttttatctattgctctctttgaattagtctgcatttttctaaagtatatagtatttctgtttatgtttggtttatacaaatactctgagttgcagacctcattctgtttcttaaaaagaacaaaacaaaactcaaccacctttggaaaaaaatctacgaacttttctgggtgaatttccaccttgttttttgcttcccactgttatatactattcctaagaatgaaagtcctgctgggttgttcaacaccagggtcaccattcaccttttattgtgtgtgagtaatgttcccctagagctgttcaatgtggtgtctctgggcacattccctagattttatttaaacatgagcatggtgataaacatctagattcctgtacttctcggccaccagagaaaacagtctgatgaatatttccatacagggagctatgggagaacttctctgggatatacatttggaagtggaattgtcaggtcattaaataaaaggttttatttgagtaggtactgtcagattagtttccagaatgctttcctagtttatgcttcttttttttttttttttttttttttttgagaccgagtctcactctgtcgcccaggctggagtgccgtggcgtgatctcggctgactacagcctcaacctcctgggttcaagtgatcctcctacctcagcctcctgagtagctgggattacaggcgcccaccaccatgcccggctaatttttgtatctttggtagagattgggtttcaccatattggccaggctggtcttgaactcctggcctcaagtgatccactcacctcggcctcccagagtgtgggagttacaggtgtgagccactgcacccggcctccatataaatttagaataaaattagaataggttgttgagtttcttaaaaaatcctgaagttgtttgattgagattttagtcaattcatagattaaattgaggactgtttccacttttgtaatatcattttatctgagaatgtgaaagatctcttcatttattcagatcatcttttattcattttaatagagtttagacttttctccataaagagtttgtgtttcctttgctgaactatttcctgatgcttcatatattttattactaatgggaatgggatcttactttagttttatttctagttgattattgttaaggtaaagaaatgttttcagtatctatcaggtataaatactgtatgatttcctttatgaacgttatttaaatgtaaagtttatttagtaaaatctatagcttacagttatatgagattttaaaggtagtgcttttttttacagcaaataattgaaatataatcatagaacagtatacattgtgtagattcttttggaattattgtggctttccttttagcattaaatatggtaagtttttgtggatttccatacactttttggggagccatattcctaaaacccagaaacattattaacgttttaatttagtacgttgtgtcttacattgaacattaataaaaatctcactaattatttaaaatacttcaaaagcataatttaaacaactctatagtattttatccaatcagaacaccattcatccccgagtatccattgcatactttttcttagattgccttctgccttttgggatgccttttagacaccttcatatgatcttcttccacctataactcttcctaattaaatgatgctttctccccaggcttcatatgtagtctgtgttaacatccaccctgagtagtctatgaaacatccaacatttccctgcatgttgataaatcatatttctagctcagatctctcttgtgaatttcaggtgccaatttcatattgtcttttaaacatctttatatagatacgggaatagtttcaaactgaactcatcttttctccaaacccaacctgctcccttatgtattattggattcctggtagataataccatctaacaaagctctttacccagtttcttaagccagaaatttggaagtgcaagttagccaagctatgccactcttcctcctccttatatttaattagtctctacatcctgttaaaatatacctccaaaaatatgtttttaaatactcatcccctcctttccaggaggatttttttttctttttttttgagacagagtttttgctcttgttgctaggctggagtgcaatggcgcgatcttgctcactgcaacctccgcctcctgggttcaagcaattctcctgcctcagccttccaagtagctaggatttcaggcgcccaccaccacgcccagctaatttttgtgtttttagtagagacgaggtttcaccatgttggccaggctggtctctaactcctgacctaaggtgatctgcccgcctcagcctcccaaagtgccggttttacaggcatgagccaccatgcccggccttttccaggaggatttttaatgccactctccaaattttccagtagctttccattgactgtaggaacacaattgaaacctcagatttatattcaagcagaagactgaatgtgttcaggatgaaggagctagatgtgatagcagtttgtatgattcaagtcagcataagggaagccatcccttacagaatgtccagtgttggcatgcgtggtcttgagaagagcaatttcatcatcactggagatgttaaaatagagactgagtgaagatcaaatggggtggtcgtagccctggagaggctgaatttgaccactgatattctttccagctcggagagtcaatgatgtatgacttgaaaagtaagagcagcagctgtggtctgtgtgactcattccttttatttgagactgctttaaatatttatttaaaactcttcaaccaagtgattttagaagctgccatttattagagtcacttttatggatttaacttaatagatacaacaattaaattaaaaaaacatttttcttttgtctttctatagtttttcccttttaatcttgatttatttcatgaccttttaaaaaaataccaggaaattcataacctgtcataggtcctgaaaagtggttggtagttatcatcatatgtgttctatgatattcttttttcaacttcattagatttattagattaaatttctctatttatttttgtcattttcagcctttggtaaattgaagttggatagtgtctttttctctcttccccaggaaaaaaaatcccttgatgctagtcaaattgaactttatataaattttaatagacatgtagtaccgagaactctctataacaaagtcactttttgaatactctcagtatgatgtttttgctataattgatgtggaacacatcttttaatacccttctcaatatccctagtgtcaagtaacataaatgcatcaaacgtgcacctcagttcaccacagagaacagtcaacttcttcaaaacaattatgaagacacattgtaggcacttgttcttgaagactaagaggatcttcctgtaagagtgtctaaatcaaaggtgtacctggattcagtgaattttgattcctccaggggtagtagagtttcactctgctttatgttggtccaaatccctttattagccatggtcatctttgcagatgagggcagggagttcatcatccttgtgtgttttgtgacttgttttccttaatggtttgtctagctattggatttcacgtttgttttctttctttgagacaaccctagatatttatccttgtagcagtcttctttttactataaaacctgcagcattttggacctaaaactagacatggtaatttctatttgatcataaatggccctccttattttttttcttatttggcaagtataagccgttagtatgtgagatacagaatatgtgatatctctgtattcagtgacatcataaacttaagcaattatcattaatgtcttataatagatttgcttgtcaacatccttatttcctcctaatatttcaattgatagataacatgggatatcagggaagtttattagatagttatgtctgagctataaggtcagagaaaaatttaacgtgacaagacatctgttttaattctcattttgcataagatatagtggcctggaagaaacagaaacctgtgttgacaccttttaaaatacagcaactgtcttgttcatccttctaccattaaaaaatgcacagaaggggcctggtgcagtgacttacacctgtaatcccagcactttgggaggccgaggcagatggatcatctgaggtcaggagttcaagatcagcctggccaacatggtgaaaccctgtctctactaccaatacaaaaattagcctggcgtggtggcgagagcctgtaatcccagctactcaggaggctgaggcaggagaatcacttgaacccaggagatggaggttgcagtgagccgagatcctgccattgcactccagcctgggcaacagagcgagactctgtctcaaaaacaccccaaaaaacccaaaaaacccacatgcacacaaggaaaaaatatcagtgacatatttgtaggctattaaaatataagtttcaaacagatgattaaaattgaatgctatcataggacataaaactcagtacaaaacttacacttagccctctcatgtatataaccttagacatatgactcaagtatttgggccttgatttctttacagtggaattagtggtttgaacgaaatgatctctaagatttcttctggctctaacatactgaagatgaacatactgaagtggattgtcactgagtcacttgatcgtcctcatgacaatgattagtctttggaatgagtaaaaccagaaaggttacatgcaccatcaagggtattgggagaagagcatctcctactgtctgtcatcaaagcttctattcctgtttggacactttcttgtctcagtaaaatgggagactctccctgctctatgttgaactcactgaacctatgtacacccttcatttagatactcttgcaggaagatcctctcagtcttcaagaaaaagtgcctacagtgtgtctttaatattgttttgaagaagttggctgttctctgtggtgaactgagacgcacatttgatgcattcgtattacttgacactagaaatattgagaagggtattaaaagatgtgttccacatcaattatagcaaatacatcatcctgagacactgactctccctgcggtatgttgtcagcagttagcaaccagcctgtactctgcatctcttctacaagagtatgccagctacatcatcttattgtattattattactattattattattagttaagggcagggagcatgttttcttcagcttgtcttcctctagtaggcctaggacattctttgggatatgacggactcctaagtgcttggttatatcttatctttgctcctccccaacctcccagttccactaaggatgtttaattaaggcagtgtgttctacacagactgcttttaaaatgttccttcttgggctttggttgttgtaagtaggttgttagcccctgcagggcacagaccgcatggtctgtttcttttatatccgaatgcagaaagttggtcagaagcttttcccagagttgctggctgagtcagaagtagaagatccctggaataaaaatgaggagagcagagtgtgcctccagttttggcactgccactttctaatcttatgacttcgggcagactctagaaccttttcattcctcagtttctttgaagttgtgatgataaatcctgctctgcctacttcacagagctgacagtagatgcagaaatgccttttacattgtatagccctgttcaaataaaatactttttactttttatagtgtcaatggtcacaggcccaataaaaccctagtgcaaggagagttgattttacttcttcattgtgcaagaggattgcaacatttgttctgatggtgaataaaaacttaccccctaactgcggtgtccatgtttatctaggcttgtgagttttgcttctcaaggtaagaggagtatttatagctagtgtatgactgcaaagctgattctacaagcttcacttttgattagctacagtgtggaagaatatgtgggaagagcgtgaggggattagtacagcaataattggagaacattaatgattaataagtccccgactctcatttaatgaatattatttttgatgtgaatttaataaatatagtaaaacaaatatgcaagcccttttttttaaaaaaaattgaggctaggaattctagcaagcagtgtcttaaatattaccttgttgttaaaatctactaaatttaaggaaaaaaacccaaaacttggtggatgaagatatttgaatctgtgattaccttgcctattaccgtactatttcaaatgcttttagatccaacttatgatttccttcttttaagttgaaccaacatttttaatcacatttacaagtagagagtatttgaagtatatcttgatcataataataacaggtaacatttattgggtactgttaagcctgttacaaaaattgtttcatttaattttcacagtaatcctcggaggtaatgaggatgattatttccaatttctagatgaggaaacaggattaccaggggttatgtaacctgtctaaggccatacctagcataatggaggcatcagtgttatcggaaaggggtcccaatccagaccctaagagagggttcttggatcttgtacgagaaagaattcagggcaagtccttagagtaaagtgaaagcaactttattaagaaagtaaaggaataaagaaaggctactccatagacagagcagccccgagggctgctggttgcccatttttatggttatttcttgatgatatgctaaacaaggggtgaattatccatgcctccccttctttgaccatataggggaactccctgatgttgccatggcatctgtaaactgtcatggcactggtgggagtgtaacatgaggatgaccagaggtcactctggtcaccgtcttggttttagtgggttttagccggcttctttactgcaatctgtcttatcagccttatcagcaaggtctttatgacctgtatcttgtgctgacctcctactcatcctgtgactaagaatttcttaacctcctgggaatgcatcccagtaggtctcggtctcattttacccagcctctattcaagatggagtcactctggttcaaacgcctctgacatcgggattgagatccaggaagtagcttctgttgcttaagctatggctgcaatcccatgcctccccacatgggtgtacttcatgaagtcaaggtacagagtccacgtgttttcaggggaaaggaataggcagaaaataaggaacactttccatcctataaaagaatgagagaattcttcatggttatactattctagatttcttcagttctgcataattaggtatataatatgtaatatgtgtgatcaatgacatgggcctttcctagataaagataacgtgacctttgacaagacacctaacatccttaggcctgcattttcttttttttttttttttgagacggagtctcactctgtcaccagctagagtgcagtggtgtgatctcggctcactgcaacctccacctcctgggttcaagtgcgcctcctgcctcagcctcccgagtagctgggactacaggcacgcaccaccacacccagctaatttttgtatttttagtagagaccgggtttcaccctgttggccaggttggtctcgatctcttgacctcatgatctgcctgcctcggcctcccaaagtgctgggattacaggcgtgagccactgcatctggacaggcctgcattttctagttcagaaaatgatattagaggctgggtttgaaggacaggaagatggcccctcccactgagtcttttatttgggtggagggaggaaagggagcagaaagagcccaagaaactttgcccgtctcctgcccttatctttatagagttataaatttctcagaaactagcatttatatacttataaagtttatagcaatctgtgctatagagatgattttatcagcttttgagaattttctccacttgcagtgttgctgcacctgctgggggtgtgttctctaggcagtgtcagagcctaactcttcctttatggggattgcacttgcgttttcctgataagtgaccctgggacagtgtgtgcttctgaaggcctccctggctgaccctgtggtccgggccctagggactgaccttctagctggcaccagctcctgctgtgaaatggctgctgcccacaggcagtgttttgtgagctgttcattcagcagatagatttttggcaaattgacttagtgctgttttgcaaagagtaggagctcaggaaatatggttgaataaataaacgtaagcaaatatgaagtaaaatgcaggcttgaatagctggacacttgaaaaagttaaaattactctagggccaatgattttcatttattggtgtggttgacatgtctgtctaggaacagtgatttgaccaaggagtagagtgaggggactgggggataccttgactgggggatactgtggtcatggggtgtgaaagcccgtgtcagagggaaccgggaagcctctggttcctggccccagccagccagtttgcacagttaagaagtaagattgtggccgggcacggtggtgcgcacctgtaatcccagcactttgggaggccgaggtgggcggattgcctgaggtcaggagatcgagaccatcctggctaacatggtgaaaccccatctctactaaaaatacaaaaattggccaggcatagtggcacacgcctatggtcccagctactcgggaggcaggagaatcgcttgaaccggggaggcagaggtcgcagtgagccgagatcacgacactgcactccagcctgggggacagagcaagactccgtctcaaaaaaaaaaaaaaaaaaaaaataaggttgtgtttaaggcttcagggcagtccattctccctagtttagattcaaggcatcctaatcctatttagtaggtgagtgtctcctgattaaattctcaattatcaaatgcaggaagagaaataaaagttcatgtctctgtccactccccctgacctggttggtcaaattacattccttgaacagaaaaggagttcagtatagtccagctggagtgtgtgtcctggaaataacaaaaactgtttgccttcccaccacagcgattttgactctttaataaactgtgttcgtatctcttggttttgcaaaatcaggaacatgctttgtttagttttgtgatcttgaattttcacatgatttttgtgtcacatatttctgtgtaagtaaatgtttttaatagtgtgatttaagatattttattgtgaaagtggaatatacacactcagagaattacaatgaattcccatgaatccattactcagcttcagtaatcatcaatattttcaatgccataatagttttatcaaccctttttttccacttctaccccatgccacctacttttttgtgaaataatttaaaacaagctccagacatcatgttattttaatatcaaatatgtatctcaaaaatggacttttaaagtatgctacaatgtcattctttatattgaaagcaaatagagtaagttgttcaatattacctggtaactagtccatcctcagaactctctgatactctagaatggatgctaggtgcaatctgacagttgaattggttcatgctgagttctcctttcttttgttccagaggctgggggacagcaggaaagctcgatgggggatgctgtgtactttatgatcacccccagcaggggcccaccatgtctggctttctcagttgtcctgaagctgtgaatgatccctgggtttggggctgacagcttgatcctttctttgcaagagtttcaattgaccttttctctaatggattttccatccacttgctgttctttaagtgaacccattatttcattagggattgcaaaatggtgattttctaattatatcatttcttttttttttttttttttgagacagagtctcacactctgtcgccagactggagtgcaatggcgagatttcagctcactgcaacctccgcttcccaagttcaggtgattctcctgcctcaacttccagagcagctggaactacaggcatgctccaccatgcccagctaatttttgtatttttagtagagatggggtttcaccatgttggccaggatggtctcgatctcttgaccttgtgatctgcccacctcggcctcccaaagtgctgggattacaggcgtgagccaccgcgcccggccaattctatcattccttttgcacattttggctggaatttttctgtattgaagactttattcactaggtatggttgttaccctgaaatacagttctttctagaaaggcagcataaatgcctcattatttcctattctgttatcagtgccctagcattcttcagtgatagctgatgttttatttttctggtttctttaaatatatttaatatgtttaaatcaattaagtgattattctttctgtaatagcatggcttttaatggctgtatagttagcagtcatgtgtataaagctatctttttttatttatgtctgtattgttggacattttagttcctttgaattttggtactattaataatctatttgttatagtaccaggaactgtgataaatacttgacatgcattatctcatttagtcatcataatactcccatgatgcatcactctgaggatacctctgaatatttacctagaatagcttttataaagttgaatttctgggtcaaaggggtgaatttttaaagatcactgacacacattgccaaattgccccttaaagctttccttgtcggtgctgatgcccacttctgggttttgggataccttgagttcaggttgagggacactggaggaacaaaactggtaaacctgctggtttggtggttctttgaattctcatctttttccccagtcctcctgctattacaatacagtcttgtcacagagccaaccccaaaactggggttctgcctgggagaaaacatgggttcttggcttccctcaggaagcaattcaagagggaaccacagagcaaagggaaagcaagtttattaagaaagtaaaagaataaaagggtggctaccccataggcggagcagccctgagggcttctgactggctatttttatggctatttcttgatcatatgctaaacaaggggtggattactcgtgagtttttttggaaaatgacaggagattcccagaattgagggcccctcccccttaaagaacatacagggcaacttcctgaggttgccattgtatttgtaaactgtcctggcgctggcgggtccatgctaacgattcctttagtatgctaatgattatctttggcatataatgagcagtgaggacaaccagaggtcgctttcatcaccatcttggttttggtgggttttggctagcttctttttcacattctgtgttatcagtgggtctttgtgacctgtatctcaggaaagcagtcttgtggagctccgctctgtcttcagaggcttcacgtagctgccccaactgccccatgcattccgtccaggtatggggccccttcttccatactctgttagtgcgttcacaaaggtctgcccggtttcaaagaatggggtatttagagactgggcgagattatgggagagaatatagaaagagttgagagaataagctgtggggtgagccaggaagcactccgacattgccgtgttgggtagagaagccattaaaagggacttgggagaaaatggctagcgagttagagaaaataggggaagggaatatcatgagctgagagtaaaatgctttaaggagtaggagtaaatcaacagtgaaatttttctgaaagataaactaagtaggatgaagacagaaatgttggctgggtgtggtggctcacccatgtagtcccagcactttgggaggttgaagcaggaggattgcttttgtccagaagtctgaggctgcagtgagttatgatagggccactgcattccggcctgggtgacagagggagaccttatctttaaaaaaaaaaaatggaaacaaaaagttattgataccatgctgcccagcagcttctggcacatcatgggcatggaaatcaaattagagcagactgagcaaggagggagaggtagcaaacgtagttaattccggttagtagttttgatgtgaagggaagccaagaaatggaatcgtagctgggagcggagagtgatgtggctcaagggaggatttgttctttcggttttttttttaaagcatgtttgtgtgatactgggaatgtccagcaaagagggaggtgtttgtgtttcaggagagaagggatagccaaagaagtgagatcttggcacgcaataaggaattcagctcagaacacaagggaaagaacttgctcttgtttgtcacagggcctctttccattgtgaggaagacaagtgtgagcatttttgcatatttggaatttgtctcagattcttccattgtctcagtaaatcatttgacaatatcatctcatcattgggaagaacgggtcaggtggggagaagattgtttaaacattgtattggagtggaagcttacatgagaacccacagcagtgttggcctccttgaggtatatagctgtgcactgaaagtcaagacagacaacacctgtgtggctttcttttacaatgttcagttgttcaggtgcaggcaaagagaaagtggatggctgcgccgaaacaggtcgtggtttcacctgacaagcgtggtggagggagagagggataagaaagctgaagtgtttgaagtatgtaattatagtgatagaacatggaatttaagccgctgcggaaggaagtgacacagcacgagtgatggattgtgcaacagtagtagggacaactgattcaaggtcagcatgctggatggagcagtagaaggggttctagagtaagagcctaaaagtagaaggtagttctcaggagttagatgctgcattcaggcatttgtacatagattcattgatgatcgaaaaattaattgattatcccgtctttgccagccactccttgaggtcctgagtagaaggtggtaaacacacagcagggactgctgaaatggagtttacgctccaggagtaggagacagatcacagacttacataaattcaagggctaagctctctgaagaataaagtggataatgggaacaagagtaatggggtgtgctccttcagaaagggtattaggaagttctctcagtgaaagtgaccactgaccagagacctgaatgagatgaaggagtgagggagtcattgatgtatgcagaagaagagtgttctagtgcaaaagtcttcatggtgagagtgagctcagtgtgtttgaggaggagaaggccagtaggcaagagtggtgagaggtgggaggtagggaggtggctcttgcatctggtgagtgttgcgggggttgtgactgattggggctgttgccttgggttataaaataatttactgaaacagtagtgaggtgaagaatgcaagtttattagagagtaagtacgttgcaaagggcaacgggtagcacagcagagaaggggctgtctgccaagagacaggggctgggggaaagtttgatagggtcctgcttgtggggccactgtgcaaataaaatgacgctgctggggctgcatgcagagtgaggtgtctgggaacaggatagtgtgcaagcaggttgtttgtggttagcagtcactcagaacaattgttctcccccacctgggaccccccttcctcgttgttgctaacttacctatcaggactgcacagtgagggatttgattttactctgagggtgatgggaacccactggagagtttggagtaaactttggaattgatcttctggaggttgtacggttcctgatagtgaccaatatgaggctgtgagatgggaatgggtggctgttttgtggtggagaaaatgttagctggaggcaaggggatcaaggtctcgggcgaggtatcctcctgagcaatggtttgctctccatgtggatgtccaaatcactaagaatgataggagcagaggtggaacgtggggcagtgaggcaggaggtgagttatttagtgaatgacgaagggagggaataactagaggttagtggatggcagaaaggaggagggatagtagggtctagccagtggcaggaattttcagaaaagctcatggttttgaaggagaataaatcatctggaagtgttcatggggaacaaggatgttacccacgttttttgcctcagatgtgaaggatttgacttaaaatgcctccacctggccgggcgtggtggctcacacctggagtcccagcactttgggaggctgaggtgggcggatcacgaggtcaggagttcgagaccagcctggccaacatggtgaaatctcctctctactaaagatacaaaaaattagccgggtgtggtggcgcatgcctgtaatcccggctactcaggaggctgaggcaggagaattgcttgaacctgggaggcggaggttgcagtgagccaagatcatgccattgcactccagcctaggcgacagggcgagactccatctcaaaaaaaaaaaaaaaagtgcctccacctgagacgattgcagggcgaggatatcctcaagggaaagcctagttatcactaaagaaggaggtgaagtttctttagagagaggttaggcctggggttctcagcctggggttatttttgccccctgccccaggagacacttggcaatgtctggagacattttgggctgttacagctgggggcgaggtggctgtgccaccgccatccagtagtaatggccaaggatgctgctaaaagcacaggataatttcccccactaccgctaaacacggaaataccaggcccagggtgatgatagggttgtggtacagagacccttgattaaggatttcggggcatatgctttcatggaagtagagttccagcaggtcatcattttctctcctccacactgttctggaactcctttgataatttttggctggatgtgcacgtacacatttaccttcagtcacacacatgcaagatcctgctgaccttattttttgtcatatacattatctgagcggtaggaaagaattagtcttagggctattttcagtaattcggtaacatgaatacaacaatctactgttatgataattaatcacttgagaattgagggatgccatttcctagatatttagttccagttagatgcaggcaaactgaagttctgtaggggaaaaatttgttatttcccctccaaaaaatcctgggagaccaaagaatgttctctaatgaccagaagaaatggagaaaatagagagatctcttgtgtcctgctttgtcactcgaaatatcaaaggcagcttttgagattagttttgttttatagacagaaatacaaagaggcataacaactgcatgactagtatcctggtagaatggaacatttagacatttgaaatgtagttattgtaactgaagtatagacttggcctggttttgcaaagcctggagctaagaatggtttttacatgttcaaagttgctcaaaacaaaattaaaccagtgaaaaatatgcgacagagaccttacgtgtggctcataaagcctaagatacttactatttggccctttacataaaaagtttgatggtatagactgataaatcatttccagttctgactatgatatgaatgaatctatcacagaatcatagcattgtatttattcagaaatcctgaaaatatttattgatgctttttatgtgcaagtgaccaagtttgcaaggtagatgctggccatcagcaagtttatatgtcagtgaggaaggtcaactttaaacaaatgattgcataactaattagataaaataattaattacacaaagaaactatgaagggttccaaaagagcatggaaggggattactgaagacttttctggataacagttgatctaaatttgaagaaagaatctgctaattagaaggaggagaaattgtggccctggaagggaccctagagattttccatttcctctgatgaaagtttgtgaatgcaaaacaagctacataaatgtttgaaagttaaagagctaggccaggcacggtgttttacgcccgtaatcccagcacttcgggaggctgaggtaggcagatcatttgaggtcaggagttcaagaccagtctgaccaatatggtgaaaccccatttctactaaagctacaaaaaaaattagctggacatagtggtgcatgcctgtagtcccagctacttgggaggctgaggcaggagaatcgcttgaacccgggaggcggaggttgcagtgagccgagaccgcgccactgcgcgggtgacagcgaaagtctatctcaaaaaaaaaaaaatgtgtcagaaaaaattaaggcctatagctatgactctgcactctcgctaacattagaaccaactgacaaccagtagaaaactgatgcctgagcccggcttccagcaattctgttctccccaggtgatcctcagtttcagccaagattgagaacccctgggctaggtggacccaggccctctaggatcctcagccagtgtcttattttttttatttttatttttttttttttgagacggagtcttgctctgtcgctaggctggagtgcagtggcgcgatctcggctcactgcaagctccgtctcccgggttcaagtgattctcttgcctcagcctcccaagtagctgggactacaggcgctggccaccaagcctggctaattttttttgttttgttttttgtatttttagtagagacggggtttcaccgtgttaaccaggatggtcttgatctcctgacctcgtgatccgccagcctcggcctcccaaagtgctgggattacaggggtgagccaccgcgcctggcccagtgtcttcttattatgcctctcttgcctttttttagggaaatagtaaaaaaaaaaaaaaaaaaaaaaaaaaaaaaagtccttaagttcagacctatgctagagttatatttctgaggagcatctgagagaaatgtgaatttttatcccttttctgggtgacttatttttattttgctggccagctctcttcttgtgggttggtgcctttgcctgcctcttcgtctcttcattctctgtccccgccatgatggacactgtgaatgtcagtcactgatatttctgagtctaaatggcggcatgatgcgttacgaactgcttccttcgagaaccatctgcaattaaattcaagcggtttagccttttggatccaaaattaattaattaatttatttatttatttatgaattattttttgagacaggcaacactcttgttgcccaggccggagtgcaatggcgtgatcgcggctcactgcaacctctgcctcctgggttcaagcgattctcctgtctcagcctcctgagtagctgggattataggcacccaccaccacggctggttatttatttatttatttatttatttatttgagatggagtttcgctcttgtctcccaggctagagtgcagtggtgcgatctcggctcactgcaacctccgccacccagcttcaagctccgccacccaggttcaagcaattctcttgcctcagcctcccaagtaactgggattaaggagcccgccaccacgcctggctattttttgtatttttaatagagacggggttttgccatgttggccaggctggtcttgaactcctgacctcaggtgatccacctgcctcagcctcccaaagtgctgggattacaggtgtgagccaccatgtctggccttggatccaaatttaaatccaaaattggatttaccaattaaatccaaaagggagctgagtgaggtggtgtgtgccagtagctctagctacttgggaggctgaggcaggaggatggcttaagcccaggagtttgaggtaagcttcagcaacgtagtgagacctcatgtctattaaagaaaaaaaatctgagctgggcgtggtggctcacacctataaatctagccactcaggaggcttaggtggggggattgcttgagcccaagagttcaaggccagcctgggcaacatagcaagaccctatctgaattaaaaatcttagatggaagctgtatagcccataacttcgcctgttgtcttttgaggcaggaggtatttagggggatgagagagcaaaccagttctgcagttttttatgtggtaactctggcctcagactacagagctttctcctagcttgagaggctcctttctgcgctgtcagtagccttggaaacggtgttgttccctggcagtgtttacccagccgctgtcccctggcgagttcagagccaggtgatcggcagtgctcgctcttaatgactgtgtttcatctgcagggcgaacgctgttggagaagctgttcagccagcaggagaacgggcctccagaagaagcagagaagttttgctcccggatcattgccatgggtcttctccttccttttagtgattgcttcagggaaccgtgtaatcagaatgcccagacgaatgcagcttcgtttgatgtaagtaggagaattcacttctgtccgtgaggcagatttgctgtggaaatagcagctacgatgtgtatctgcccagtcaccctataatttaaaaacaacatgtgattcaagcattttttttccttagctgctcaacagctcggtatgtctgtttgtacacaaaaaaaaaaaaaaaaagaaagaaaaaaaactagcgtattaagtacatttgccaaacctccttttcttgacagatggtcactcaagagttctctagcctgctttaatcaacgatgattttaaaaattgatttctaaattatttttaattgtggtaaaatacagacaacataaaatttacctctgtaaccatttttaaatgtaccgtttagtggcatcaaatacattgacgtggttgtgcatccaccaccaccatccatctttagaactcttttttatcatccaaaataaaccctgtacccattaaacaataactccccatcctcctctttccccaagcccctggcaacaaccattctctttctgtctctatgaatctgactatgctaggtagctcatataagtggaattatacagtatttgtcctgtttgtggctgacttatttcacttagcatgatgtccttgagattcatccatgttggagcatgtgtcagaatgtccttcccttttaaggctgaatcatattccattgtatgtatatgttgcattttgtttatacgttcatccatcaatggacatgtgggttgtttccaccttttgctgtaatgctgctatgaatatgggttcataatgagtgaataatgccgctatgaacatgaggtacaaatacctcttcaagaccctgtaatcagcgatgattctaaagtggctgtaagtccatatgtatgacttggctggtcgtaggcattccttcagaagcagctccacggggcacagttattcttcccagtgggccggaggtttccatgggccctacgatgctattttgtgcgttcctaactcatgtttgtgtgaagtacggacgtgaagcagcattgtctgcttcatccccagctcccattcaccaagagagttaatactgtacaacagtaattcaccaggcatattcacaattcataatgaatatgaacacagctggattctcattgtcaaggcagagtattgccagtcgttctcaggtatgtggtatgtgtgtggcattggttgggatgagtacgcctctaaaacccagatgtgtaagaattctcgtggatgaaattctcataacaaaattgaaggttggctcacttgtgcagagcccaggatttttagttgaggataatgatttttcttttttttttgagacgtagtctcactctgttccccaggctggagtgcagtggcactatcttgacacactgcaacctccacctcccgagttcaagcgattctcctgcctcagcctcttgagtaactgggattacaggtgcgcaccactatgcctggctaatttttgtatttttagtagagacggggtttcaccatgttgttcaggctgttcttgaactcctgacctcgtgatccacccgccccggcctcccaaagtgctgggattacaggcgtgagccactgcgcctggccgtggtttttcatcatatgggttagttactttgttttgttgctgccaacagtgctctcttatcagccttcttcaatatataggaataaaataatgatgagctttaaagacaatgacaaagccccagctgaggtcaagatacgataataaataataaagtgtctatatctgcctgttcactttgcttcctcttctttacccattacagcctgcagtcttcctcaatcttcctttagtattaagaaaataaatcacataaaatattcagagagcttcttgattcttgatgcttcccatttgaaagaaaattccccatgttgtgctgtgacttgtgaagtttccttcctgagatttgtttacatttttcctgctgcaattttttaaaatgacattgcagctaatcgctgctaggtagatctctttctcttatgggaaaaaatatataacttaaatgttttcctcccttctcttgtatgacaggtctgtgttattgtagaggcagaacgctagaatgatggtgtgttaaatgttatagagctcagttctagaagatatattgatttggcaagttggaactataattagtatagtgcaggcaaaggcaaacactagccatgtctagcacttgctttttgattcaaactgttcccaagttaacggcattttcctcctttaaagcccagaagtgaacagtcttgccagtcgataaatgtagaattggataaacagaaaagaatagggtaatcctatttctttctctctctcttttttaaaatcaactaacctggttgtttcttatactcacctcactccatccttgtgttagagactagtaactcttccccatcatcttattttggagggcagctgggtgtggcatcgagcgtgaaaaacaaacaacaaaggtataaaatcccttaatgttgtgtgaaggcatttcctcagaattgggaatttctttccttcaacttgatgtgattgcattttgtcttcctttattcattggctctgtacgacctctctactcccccatcaaagtgaacataaaacaaagaagaaaattaaagatactcttgtatgaaatgttatgccctatacttaaatagcagctcagtaacagaactatgcgttcattggatgcgcagtcaaggagtttcttgaaaactggagagggcgacgatataatgatacagggggttctgaggactggggtgtcaatgagggatgaggaagaatgtgcttatctatggggagagaaattttcgataattagtatctctgctgatttccagaaaatggctgttggggacatttctaactaacaatcctcttgaggtcagttgcccttcgagacagaacatgctgtgggaataatgtcataactggtacccttcctacctacccccccccactttgttcccttccctgatgggttcctctcccccacctccttatcctctccgttctcatctttgcacttatgtatgcaattacagcaataaagatcttcagtttggggctcttcactgatgtagtttatgtattagcctacttgactcaacccttctgattttgttttatgttattttatacaattttagggcctaacattttgctttatcgagtgttatagaaagtatgaaaagacttcacattttctcttacattttaatatgattaagatgtcaagaactttaaaagacaaagatggctttgagggatgctgttaattcattcacagatttttaccaaatatattcattctagaagccaggcagtgttttaggctctggagatgtgttagtgagcaagagaatgtgttctgttgaaatgtgtttcctattcaaaatggagagagacagattttttttcagaatgcataggctaattaattgctctcagattctaataagtgatatgaaggaacacaggaccaacaggatggagtgaatggcgtgggggtaggatgagcgcagaggggagcctgtgagatgaggtctgtgggaaggccattccaggcagctcccagggcaagtccaaagggccttggaggagcacagacatgactcagaggaagctggggcttcaggagatgaggacagcaagggctcaggccacagcacaggcagggtctggaaagccgtggaaggaatatggcttttttttttttttttgaaacggagtctcgctctattgcctaggctggagcaagatcagaggcatgatcttggctcactgcatcctccgcctcctgggttcaagcaatttctagctaatttttgtatttttaatagagacagggtttcgccatgttggccaggctggtcttgaactcctgacctccagtgatctgccacgtcggcctctcaaagtgctaggattacaggcatgagccaccatacctggcttttttttttttttaaatgggagcttttgggaggttttatgcaggggaagaacatatttgtcttatatttcatgtggatcacctggcctggtcttggtttgcttgttgtggtggtggttgtttttgagacagggtcttgctctgttgcccaggttggagagcagtagcacaatcatggctcaccgcagtctcgatctcctgggctcaagcgatccttccacctcacccttccaagtagctggaactataggcatgagccaccatgcccagctaattttttaagttgttgttatagacagggtctcactgtgatgtcccaagttggtcttgaactcctggggtcaagcagtcctcctgccttggcctcccaaaatgctgggattatagacataagccaccatgcccggcccccagcctgctctttgaatgattgagtgtaggcaggcacagaagtagaagcaggaaggcaggtgggatatggcagtagtttagttctagatggtggctgtaggttggggcaggacggtgacaggggagatgaagaccagttagtaggttggggtggattctggaggtatggctgatgggacttctggtggggcagacatggcgacaagagaacacaaggaaatcaaggatgacttcttggtttgaagcagctgggtagatggttgtgccattcactgaggtagagaagacagctgcattttgggaggaggatataaggatagaactgctagcaagagaaaacagggatcatactaatgcttgctacttggcagattatattgttgacttgtagatcatggtatatttcagtggtctgaagctaggcttctttgtgtatttggaacctactctagtcatttctctcatgcctttttccaaatgagatccctttttttgggtcatatgcatattttccagccaaccacacttatcttacataattgttgattattcattaacaagctcttctaggatttctttaatcctaactgtggcatatattatatgatctacttacatcaccaagagttaagcaagtttacttgacccaaccatttttgcaggggtaggtgattctaaatctacttaatccttcatgagcttatctttaaatgtctgcctagcaggatatttttggatgcatgtttttggttgctggacttgtttgggtttggcagatctgctgattttgctaaacatgtggtgatcccttgctcaccagatgggcaagagctccttgatatgtatgtaaatggacatcggtttggatgaatatgtgagcgaagctaaaattaaagacaaggaagacataacaattcaggttaaaaagaaacccaagaaataagatcttgaacctgttgaaagatgaagctgttaatcaaaaccaacagcagccagtcccggaaaactaatgaaatatgctctactcattgttaccgtagacaaaaagaagacttaagtggacaaacagaaattattatgtgcatttgaattcatttttttttcttttttgagacagaatctcattatgctgcccaggatggagtgcagtggcgcgatcttggcttactgcaacctccgcctcttgggttcaagggattcacctgcctcagcctcctaagtagctgggattataggcaggcaccacgacgccgagctaatttttgtatttttagtagtgacgaggttttaccatgttggccaccctggtcttgaactcctgacctcaggtgatccacctgctttggcctcccaaagtgctgggattataggtgtgagccacctagcccagccttgaattcatttttttttccagagcaggaaaaacattttaatgctatttagtcaagcccacacagatcttttcctgagaagcaacaaaagccttgccacatctttcagctctaagagaatatagatatacgtatatattttttgctgtatatttatttttgaaacgttgtgtacagtatcaactttcaaagttgtttttattttaaagatggtattaagatgatacttaattttttcagaccaactttaacaattattttagctgatgattttgtttaccaaaatttatataagctatgtggacttgctgtatgttaatgcctgctgatgcctttttttttttttttttttgagatggagtctctgtcacccaggctggagtacagtggcgtgatctcaactcactgcaacctccgcctcccaggttcatgcgattctcctgcctcagcctcctgagtagctgggactataggcacataccaccatggccagctaatttttgtatttttagtagagatggggtttggccatgttgcccaagctggtctcgaactcctgacctcaagtgatccaccccctcagcctcccaaagtgctggaattacaggcatgagccatcacgcccagccaccattattgacattgctcttgccttctggcggtcatgcatgaggatttagctcctttatactccttccttgtctctccttcttccttctaatataattaatattgctattttgagttttctttcataatacttctttgaattttaaataatatgcttatgattttttgatattgtttcatcaaattcagatcgtatctcttgccaccccactcaccgtgtaatagttacactattagtgtctctacttttgccttcatttagtctgagccctgtttacctcccagcttctaccagatacacttttatgtttagggcatacttttaaggttaatagtttatctataagttgaaagacatatggatgctgtgtgaatattgcactgcagaggcagatatattctgattttgcttccttttcagtattccaatatcacaacccccaggccactcaaacaaggattttcctgggtcaagttcaaaagaattttgtggttttatttatttatttatttattttgagacagagtctcactcagtcacccaggctggagggcaatggcataatctcagctcactgcaaactttgcctcctggtttcaggctattctcctgcctcaccctactgagtagctgggattacaggtggatgctaccacgcccggctaattttttgtatttttagtagaaacagggtttcactgtgttggccaggctggtctcttactcgtgacctcaagagatccacctgcctcagccttccaaaatgctgggattacaggcgtgagccaccacgcccagctgaattctgtgtttttagtaaacaatcacttgctcaaaagtatcccatatttagtttagtttacatttggcttatccttttcttatacagggaactcccatccagcacaacaaagttttcgactgcctcttattttcttttttgggtgaagaaacatagcttttccccctgtattctcaatattttttatttttcagctcattcttgccatttcatggaattcttaaattctttctcttctaatttaggtcaggttcttcgtatttaattatgacttccgcttgtacttctcagctccctctttcccttacaacacctgtcccccaagcccctgccctgttattaggaacacaaagatgaaaagaaaggttctatcctgaactggcttacgattcactttaaagaaataaacacatggaagtaaattattggagcttagtggttgaagtgggctccacagtcaaagtgtccaggatttctcaactatgctgcaagcttaggtaaatggctggatttctgaaagtttatttcttcttgggtaaaatgaggaataaatatagtagtttctgagtgagaggaaagtatggatacgaataaagcattttgcacactacaggcatatagtaagtgttcaatgccctttgcctgttaccatgggtcacaatcgtgtttaggctccaagtggagatatttatagtacaaggagcaaaggggaaggtttttaactgggtctccttgataactcaggagataacacctggggcaagacctgaggcatgcgtaggagtttgctgtggggaacagccatgaaagaagtctataggtcgggtgcggtggctcacacgcctgtaatcccagcactttgggaggctgaggtgggcagatcacctgaggtcaggagttcgagactagcctgaccaacatggtgaaacccccgcctctactaaaaatacaaaattagccaggtgtcttgacacatggctgtaatcccagctactcaggagactgaggcatgagaatcgcttgaacccaggaggcggaggttgcagtgagccaagatcgcactattgcactccagcctgggcagcagagcgagactctgtctcaaaaagaaaaaaaaaaagtctgtatactgggcagcacatagaaaggcacaggggtgcatgtgagcacagtttctaagtatttccggagtataaattgggagaatgatgcgtagaaaggagaccagggatgtaaacaaagacaacctgggggtgcttttgaataattttgagtagttaagccataaacagattggcatttgtaaaatatcactgtggtggcagattggagaatggattgaagaaaactaaaattagcatctgagtgatcagaagagtgtctgaactgaaacagaggcagtgggattggaaagagccagctatagggaatctttaggatttagaaccgacaggacttgccatttgattggatgtgaggaagtggagtagatgatttctttgagtttctggttcacatttctgggatactgtactaaagagttagaatactaaagacggaacagatttcagagagaatgatcattctcttttgacatctagaatttgtgattatttgggactttatggaggctatacctcaagggcaagggaactgatattgctggcatagaccataggttgtatggtaaaatcatgagcaaataaatctcgtaaattaagagaaagttgaccaatcaaaagattaaagttcttaaggacagtggagaataattagatgtagtgagaatatagagagaatgaattcattggtggttgtggccagagggaaggatattggtgtttaagacttcagaggtggaggtgttctactcattccaaagaccagtccatggtggagaggtaggctcgttgtgattagaattgagaagctcagggtgttggctgggacttaatgtcccatagaatgtagaagagtcaaccttgagaagcagagagaggaccatgtggtaaagtccttgacatgtgaaggctataccaaggaggtttgtcagggtctgtgatgaggaggggtagatgctgatacccctgggtgatacgggctttggaagtggagtgggttacgctcaggatggacgtggaatactctctagatgatcatggagggctagattagagggtcgcggtatgagggaggattggaaaaatcacctttcaggttcagtcatcgtttggcttggatgatcacattggccttttcattaccttcttgggtttgcctgttactggtttccagtccagtctcctcagccttgtctagtggttctcattccagggttatgttgccctgcagaggacatttgacaatgtccaaagacatttggggttctcacagtagggagaggggtgcaactagcttctagtgggtagagactggggcactgccaagcattctaaatgcacaggacatctccttctttcccctaacaaagaattacaaaatgtgcaaaatgtcagtagtgccaaggttgagaaatctagtgatatatgtctgatcatgttgttttattttattttttgagacagcatcttgctctgtcatccaggctggtgtgcagttgggtgatcacagctcactgcctgccttaacctcctgggctcaaccgttcctctcacctcagcctcccaaatagctgggactaaatgcaaatgccaccatgaccagctaattaaaaaaaatttttttaatagaggtggggtctccttatgtggccaaggctggtcttgatctcctgggctcaagtgagcctactgccttggcctcccaaagtgacgggattacaggcatgaaacaccgcacctggccatgtcattttaattgtttctctatcagaataaactccagcttctttggatctccatggtcttccttctgcctttcaatactttcccacttctacctctcctgacccactttcctttccaaactcttttgccacgctgaagtgttattgattttcctaattgtccatgtcttctctcacttgtggggctctgtgggcacctctacttctgctccccactattatttcccagttagcctccactctttctcataggatgctattcagagttagatgccattccttcccagacatcttctttagccatctcagtctgcattttctctctcaaaggatatattacacatattataattgcctatttaccctgtaacacctgaatgcaaattaaatattgtgtgaaggttccttgaacaatgtaatgctgtgtccttgtgtttacctgacagatctccccagagtagttaggagtggtctctagtcctagactggattctaatcccatcttctccacccacttaagaggtgaaaacatttacccaaggtcacattaaaatttttcatgtctaataatctctggagttgttttgaagattaaatgagattaatttattaggcatttagcacaatgtctagcacatcatcaatgctaggtaattattagtgattggtatttaatattattgcctttcaagttcttattacagaatcaggcataactgtttaataaatatgccttgattttgtaaagaagagagctgtaggaaagccatgatgactgcagtgaggaggaactggagaatctattcagtgaattgtcttgaatgatcaaaggttgcctatgtttgataatcttgaaaacacttggactgggtgtggtggctcacacctgtaatcccagcactttgggattgggaagctgaggcaggaggatcgcttgagcccaggagtatgagaccagcctgggccatatagggagactctgtctttacaaaaaatttaaaaaattagccaggtgtggtggtgcacacctgtagtcccagctattggagaggtgggaggatcacttgagcctgggaggttgaggttgcaatgagctgtgattgcaccactgcacttccacctgggcaatagagtgagaccctgtcccaccaaaaaacaaacaaaaacaacaaataaagagagacagagagaaaaaagaaaacacttgaagagggagaagatgggagaagggatgggatctggctgtgttctggaattaatttattagtctgggagttgactctgtattggatctcttcttctgggcttattgccatcctcctttctcaatccattttacttaattttactgctataattaccacattccttcaccaaccctcatgcccccacatctttctggatggagtggaagggaaatggaaagagtagggaaagctacggggaggtaactgcaaattgtgaagggaaatctgtcatgcccacttggtgttatgttcatgaccatcccgtagtgactccatgctttccctaggtcagtctgtggaagtattgcacttgaatattgacatgcgttgtgcttatttagctctctgtgtgtatgtgtgcaagtgtctggcatacttgacagataacgtggcatggaagaatgaatcgttttgctttccctagcacctcaccaaagaatagggacctccatttcatctagaattcctaagacagggaggaaccagagagggctggagattgttttgctacacaacattgctcttctctttcaaagagttcattttattttcttgattggataatttcttgtggggtaaaatcatggatgggaacagtcaatacatataaataggaagaaatctgcttactgagttttctgtaagggatattttccaatccaatattacttttttcttatgaagtcaatttatttcataaagaatataataagtggatatgtatccagaagttcctactcgatttctttctttgaaggctatgcacttgttatatggtttgaaaaaaattgcctcgtatggggaacttttctttaccacaatattgattgtatagtgagttaaattatgtcccctctgtttgtagtcagatagttcagtgtgaagtagaaggctttcaatatatattttaaaaattgttaattctctggaatctatcattttcgaaaggactttgtcatgtttcttttttttttttttttgagacagagtctcactctgtcacccagttggagtgcagtggtgcgatctcggctcactgcagcctccgcctcctgggttcaagcgattctcgtgtctcagccttccgagtagctgggactacaggtacatgccaccatgcacagctaatttttgtatttttagtagagatggggttttaccatgttggccagagggccttgaactcctgaccttaggtgatctgcccaccccggcctcccaaagtgctgggattacaggcatgagccaccatgcctagtcatgtttttttttttttaatcaatttatagtaatttgtccccagttactactcagtgaatgtttgtatgactggatcttgtagtaatcagtaaccaagtttttatacatatgtgtttaagcatatgtatttttaagcatagttggagattattatgtttaagcctattttgagattattttatttttctgatccggtacgtgatttaataaatttctaatatgtgttgccatttatgtatcttatttcagagggcaaaacgggtgatgtttttcccccgttatgctcaattcaagtgcatcgttgcaaaagtagtaatgatagttattgttattcccccgatcatgaagttttctgagctcagaggaagtgctaccagtcagtagtttcatagattttagaatgcttcccaacagtaaagttaattgaagcttagaaaaatagatttttaaaaaacacactcgtggcaatcagactttttaagacaatgacatactttcttcatgattgttttttcctcctttaagaggattatgctgttttagatatccattttgactttcacaactggtacttttttttaatcacccatttggcaaacagtgttgggtgactcagaattcattttgaatttgtatgatggacttttattaaaaggggtgactcagctcgacttttctgtcatgattttcttttcttgtctttctcctgtagatgcactgaatattaattagttctattgatgtgacttgtatttcttctgacctccttttccttttctcaagagccaggaggagtataaaattgggaatctggcctggtgcggtggctcacacctgtaatcccagcactttgggaggccaaggtgggcggagcacaaggtcaggagtttgagatcagcctgacccacatggtgaaaccctgtctctactacaaatacaaaaattagctgggcgtggtgtgggtgcctctaatcccagctactagggaggctgagggaagagaatcgcttgaacccaagaggcggacattgcagtgagccgagatcgcgctactgcactccagcctgggtgacagagtgaaactccgtctcaaaaaaaaaaaaaaaaaaaaaaaaattgggactctatggcaaagtgaaggaccctgtacagagaaaacatgacttaattcaggagcttaaagggtttttttgtttcttgttttttgtttttttttaggtcctcccaatttgtactggactttggaaatctgaaagaagatttattctcctgttattacctttattgtctagatcaggggttggcaagtttttctgtaaagggccagatagaaaatattttaggctttagtaaatattttacagtgcctgtcacaactactcaagtccactgttgtggtgtaaaagcagccacggacaatacgccactaataagcacggctgtgtttcctaataaaactttgtattacaaaacagagcacctggccatatttggctggcaggctgtggttggctagcccctgctctatactcatgtaatacatagatagtaaatttattctctgagcttttctttctgtctcttaccatgtgtgctcaccagccagtcacacaatatttatggaatttttctatgaaaaatatagggccttttcttgttcttgtgtagcttactgtggaaaggggctactgggtgaacagacacggtggtacagtagttgataaagggtgatagaagagttttcaggttttgagtggtcgaggatgcccggagcctggagcccagtgtacaggaggaggaacagaagaggcgtcttaacaaatggtactgtggccaggggcggtagctcacacctgtaatcccaacactttgggaggccaaggggcagatcacttgaggtcagaagtttgagaccagcctggccaacatggtgaaaccttgtctctactacaaatacaaaaattagccgggtgcagtcgtgtgcgctgaggcaggagaatcccttgaatccgggaggcagaggttgcagtgagctgagatcacaccactgcactccagcctgggtgatagagcaagactccatctcaaaaaaaaaaaaaaaaaaaaaagtaaaaagaaaagagaaatgctgcctgggacccagaggcatttgtgaaggcttctggaagaaacgtttaagaagtgaaccctattctcaggagcagtaggaagccggtggagggtgttaggtggaggagtatgacgtggtcagtcgcgtgttttagagagagcattctgggtgttagaggagtagggactgaggggtgtgctgtgtttgtggttaggatgctggaagaccctgaggaaaccgttgcagcaatccaggagagaacagtgccctcaactatgaaggagttaggtagtagaaaatccttttatttttaaaaagtattacatgtgggccgagcacggtggctcatggctgtaatcccagcactttgggaggctgaggcgggcggatcacttaaggtcaggagttcaagaccagcctggccaaattggtgaaacctcatctctactaaaaaaaaaaaatacaaacattagtcaggcatggtggtgcatgcctgtagtcccagctacttgggaggctgaggcaagagaatcgcttgaaccaaggagctggcggttgcagtgagccaagattatgtcactgtactccagcctgggcaacagagcgagactctgtctcaaaaaacaaaaaaaaattgcatgtggtcacacaatttgtttttcccccttttaaaggacttccaagtatccagggagttgcactagtacaagaattggagcttttcctttaacaaatcatacatcttaattttcttctcataataccacaatagttaattaataaaataatcttacttatatttgggaaagaaatttgggattaaataaaaggcagattctaattatacttggattaatattgttactcctactaatctcaaactccaagagtcagaatcccccgaagggcttgttacaacacagattgctggccccacccccaagtttctgattcagctggtctgagttgagatcagagcatttgcatttctaacaacttcccaggtgatgccaatgatgccggtcggggaccacactttaagaagtgctgccttagagggtagacgtgagaagccttggggatttggttgctcatgtaaaggtaagggagtgggcagagacaaggagaatgtccaggtttctggtctgagcactagggtagatagagggtgatgcaattcacactgtgtgtaaaattcacaatgaggagcaggttgtggggatgattggttcaattaaaatcctactgaatttgaggatacctctttaaatatatacaaaaaggccattagttttttgtatctgaggtcaggagagagagcctaggagaagagagattgacgactcttcagtgtgtagatgatacttgaagccattatgctctggaaagtgccagtagaatgggaagcaagaagagactgacgtatagataaatacttacccaataaggggaaaaaagctacaaagagaatgataaagacaaaaaaacaagatattttttaaaaagaaagaaggagtgttaagtgatattcagtgttgccaagaaatcaagataaagactgaaagctactgataataccctagtagagaggaattccagtggagcgctgagagcgctgcccagatttcagcaggctgaggtttggagacgaggggtgtagggtgtggtgggaagatgggaggtgaagtcagtccacgtgtgtgattagctctgtgcacttgggctttttgctcaggtagatgtatcggaaggttagtgagggtgggaattgaaggtatcagcctaaaggggtggtttaaagagtaggctacaaagtcagaagaccagagagggtgaatggtagaaaggaggggagccaagattctcaaggtctggaggctgagggggttcggataggatgcctacaggtattattgggtagataaattggtttcagttggtaagctgctggagggtgtggcctggtgagtggtctgctggctaagattgcgtgaaggtgagtgcttgcattggcttactctcactttctttcttcctctgggtgtgaatgatttgctaatcatggttcccattccagtgtgtaaccagtttgcaggtcattgtcagttttttttgtactggtgctttaaaaaacaaacaaactgttttcagtatttaaaaacacattaagctttctatgtaccaggctctgttttaagcactttacaattattaactgttttaatcttcattacaagcctggtgagatagtttttattttccttttgcagaatacactgaagcacaagaaaattacgttcattttcttccttgctttgaagttccattaccaacacaaaaccttcaactgcatttttgcatttctggctatctctgaccctaacttgccacaacacagatccacgcaggttggaacacaaaactgtttcctcctttggatatatagtctgtaaaatgactgctggggcctgctgttttcctgagagtgacttctctttctgtgctttgtaattttacttcatgatatttacaggattttatatgtagaacagctcatgtccaggttaaattctgtggggggtgggtgggaagtctcttccattttgcagaagttttcaaggtatttcctgatttgcctatcaaacatagcctatcccaggatatgggaagaattttcctcttttaattatttcaagccatgtgtctgtacagtgtacatacttgactaatttgctgttttatgagggaataataaaaacaccaaaactgaagaagacaagtatttaatatagcccagttctcttaaattggcaagtgaagacatttgagctgaaaaggtgaagtgacttttctgtccaaaatagctttgacagagccagaatcttagtctcctgctgttcagggcagtttgctttttccccatgctgcactgacttctattagaaaaggaaaatttctttcatttacaacagagtctaactttcctcatactattggtagttaatggccctgtacatttgttaaatgtagttgggtaacaagtatttctttaacaaactaattacctgacttctgggtcaggtgaatgtgttatgaagaatcctggacatttttagagatctttgaaaaagatgtcagggatacttttaagaaaatactagggattcaaagatggaagacagcctaagacaagagtgaagcttagcatgagtaatctgcatgaaaaatctgcatgaaaaataacaggcaacggtattttatttatttatttatttatttttgggatggagtctcactctgtcatccagtttggagtgcaatggcacgatctcggctcactgcaaactcctccccctgcaaactctgcccccacggttctagtgattctcctacctcagcctcccgagtagctgggattacaggtgcccgccaccacacacagctactttttttatatttttagtagagatggggtttcaccatgttggccaggatggtcttgaactcctgacctcaggtaatctgcccaccttgacctcccgaagtgctgggattacaggcgtgagccaccacgcccagccatatactttaaacatcatggtgaaatgagaactttgaaaacaagaattttaagtgtctcctatgtttgcattttgtgcaatgaaatgaaggggacaggatagttgctgagactggatttcactatttactcttaggacaggagagaatgtgtctatgtggcacgttggacagggctcacatggtgcttctgagggaagtcctcagaagttgggtggttgagttgggacattcggcctgggggaaccagatgctcaaagccaaatctgaattggaaccacaatttctaaggtaatttagacttagttcccatgatgctatgtgtgaaaaacttggcaacactgattcattctgaagtcgctacatgagaggaggacagttttgatcacagactgatggaatgcactttggatgcagatcagaaatatatcagagtctccctgtagctttgaagttacaagggtgctgcatttaagcctgtaggtaggagtacggcggcttcattgtcatcagtgttttctgatattgagcttctcatggtcccagttaggctatattgaggctcctgctgacccagtcaggagcatgaaaagagggtgtctttgaaaaaaataaagctgctagtgcaaagccaaaatataactgagattaaagactgtaatgaaccgagctattttgaatctgaaagttacctcaggttttggtaaatattaattgtattttgattatatttactgaagatggatggacaagaagacttctgagccatggtcccagggtcataggacaagtggagaaaaccttttcatatttatttatttatttatttatattttttggggggggataaaggtctttattgaacaaccttatctcactcagtaacaaaagagcaggaggcaacaattcccccggaagtctgcagctgtgtccacccttggcagcaggatgcatggcccactgatacatcagctgcagttcagagcccctggtggtcacttagagatcataattggggttcttccgaaggataacaaaactttccagaatgggggtaacaggaagaaactcctcagtggccaattctgcccgttccccgtgggccaacgacactggggttgtatgtgtctggaaccctgtgatggtcttaggcttgccagcctggcccaccacatccactgcctggcctacatggacagacactggcaatggcctcagctcctcatcaaacgtaaccagcattcggggccgcatggcagccaccagcccatacaatacatagtgtgatttgcctagaataatgtttcgaacatccaggaaagagagaggcacggtgagcagcccagccatggccactggactcataagctgccagtcactgtggtaggggcagagggtaagtgtacccttccctaaatgtgtcaggccctgtgccaagtgcaccatgaagaggtcgttggggtccttggcatgatattgagctaactggcgcaacattgcagccagacgggcattattggtaccactgcccaccatgcccatggcaaaaatggagttataggaaacttctggatcagcatcatgagataatttgcttagggtatccaggatgttgatttgaaacagagatgagggccagtgctaaaggtacagccctccggagtgcaggctccccatatctcagcaagtggccaaaggttcatagtgccgtctctgcaccaatctcccccacagcaataagggcaatccccagaacagccactccctgatgtgctcccatgtcagcaggggtttcctttttgtccttgtccttcttttccttcttgcctttgtcttcctccttctctttggagtcaaagtgttcgctgcaaacgtggagcagctgctgcaccttcagcacattcccagagcctgcctatgcacacacatctaccagtgtgttggcaaaactgcggaatggctctgatgcaacctccagtgcagccaggattgcctcgatggcctcacccttccccaggtgattgagacccagtccaagaggaagccaacgagcataagagtccttgagctcagtacttctccctgatggtctgaaggatagtggaagttacatctccattgcaggaccccactgctatcattccacaggctagagctgtcacacctgccacctccatgctggactttgaatctcccatcacaggcagcagcagtgttaggacatcttcatgatttgagccagcgtaggccaagcctagcccaaagatggaaccaagtctcatggtgttgctgttgtggagaacatagtctgaaagcagtcccagagcagggacacactcattccagaccccagagttcactatgccacaggcaagaagaattcctgacttaatgtagtcctcaaaggagtacaggttacttctcaatctgaatgaggccaccatccacatcccacagcagcagcatcccaacagatgcagctgcactcaacattccgtggtccttgttcttgtaaagccatttgttgccatcatcgttagcagcttgtcttaaacaaaagctgcattcacaaagccactcacaaaagaggaggccaggttcatgcgggcagagtccacctgagagccactgcccccaaacctgttgttctctaggtgggttttgtagatgtcatcaggcaccttgggctccatgatgtccagctcccgagctaaggccaagaagttgctgttgagctgtacattggacatgatctctgtcaggtgctcatactccttgacatcttcactcagctccaggaacaccccatgccagcctagcatgaatgccatctgtttctgtactaccacatcctcgcaggatgtgaagatgtcttctaccagctccatgtcattgcgcatcagtgccaatctcagagctttaggaaagcggctaaactttcagaacacacccagggcacaacgcagtaggactgagttctcaggctcagacacataattcacacaactggtgagataaaggcagacctttgtgtatgcattctcatcaatgtccttctccagcatgtccacctgctcaatttccataaggtcacaggcctcatgctctgcgtcgtggaccatgttgtaggggacgatttccttcaccagagtgagcagtggctcctgctggaccttctttgcatcatccagctcctgccactccttagccacttctcctgccaggtgcctgatatactcatgactccatgatgccaattccttctgggagcctactagccgatacttgaggcactcgcactccccactcatggtcatggccaaaacagagatgatgtcagcagcaaaatgctcattctccccaggggccatgttctcatacatttccttcagtttgccatagtgtggacgcagacatttgagagacttggtcaccaaagtcatggaagttgtagaagaacgaatctgccttcgcatttcctccagcgctggtcgatacagggatgtgtccttctccccgagtcattccacaagcatctccagttcatcttgaagctgtttatcttcctcagacagctcctgttctttgtccttgtccccggcatcccgccgctccttgccgcttggcttctcatccatgccgctgagggccgccgctgggggctgctgggactgcaccagcgtcttgtcccatcctccctcctccatctccgctgccactgccctttattttttaattttcatggatacatagtaatatatatatgtatatattataggggaaaaactttttctttagtattgtatttgacatgcacttaatgtttttactacaatgaggcaatttttctttttctttttctatttttttttttttttttttttttttttttgagacagggtcttgctctgtgacccaggctggagtacaatggtgcaattatatgacactgcagcttcagactgtcgagtagcgaggaccacaggcacgtaccaccacactctgctaatttttatattttttgtagagacaggttctggctatgttgcacaggctggtcttgaactcttggcctcaagtgatcctcctgcctcagcctcccaaagtgctggaatcacaggtatgagtgagggtgctgggacaatgaggcgattttcatattcaaaatagatggcagccaaagccaggccaagggtcgaggcagaaatcttgcattatgtgtgttagaatgctacaacatttgacacaatagcctgcagacaggggtgctcaggagacaggttttgagcttcatgcatcaattagctggtctttgagggtgacatctgttggtacatataatcactcttcttcccaggtgtagattgtgtaactgaaggatagggtctacatatgccacgttcaaagtgatttaaaaaaatagtatggctgggctcagtggatcagtggatcacacctgtaatcccagtactttgggaggccaaggtgggcagatcacgaggtcaggagatcgagaccatcctggctaacatggagaaaccccgtctctactaaaaaaaaaaaaaaaatacaaaaaattagccagacttggtggtatgtgcctatagtcccagttacttgggaggctgaggcaggagaattgcttgaacccaggaggcggaggttgcagtgagctgagattgtgccactgcactccagcctgggcgacagagcaagactctgtctcaaaaaaaaaaaaaaaaaaaaatagtatggccaggcacagtggctcacacttgtaatcccagcactttgggaggccaaggcgggcagatcacttgaggtcaggagttcaagaccaggctggccaacatggtgaaaccccatctctactaaaaatacaaaaaattagccgggcgtggtggcatgcaactctagtcccagttacttgagaggctgagatgggagaattgcttgaacccaggaggtggatgttgcagtgagctgagactttgtctcaataaataaataaatgaataaataataaaaatttaaaaaatagtatatagtgaagagtagagtgcctgatttactatttagtaataaaacattcactttccttatagactgttttgaatttatttaggaacttgcccccaaataagtgaacaccaatctagtatcattattgtaccatttcacttgacagttgttacagagtctgttctttaaagtggaatcttgatagaatgggaatttcagactcattttggagataagctgtaaagaactaatggtggatgatgttctcctcagggtaaggtggaagacggggcaattagaccccgtggtgaatgcagattaatgaatctaagtgagtctatttggttttttcagtttagttggccggagtggaggagcaagtcatagaaaattggggcttttttttcttgtttcttcatgccatgccattcagtactgactgagggtcaagcactgtgctaagtacttaacatgatctcttcaattagttggtcttaacttaaataactcagttaatctgacttccattttctgatgtgaaaactgagacttagggtaatttgcccagagtcagttgttttgtaagcggcagaagatggaattccaacccacgaaggctgactctacatcttgtgccctttctccaccctccatagccaatctgttggccttttttctctttctgttgccatcactctggtctaagccgccttagtgttgaggctggtctcaagtggtagtcccctaattagtctccatgggtccactctgctctctttagttccttctccacaaaagagtgattttttttttctttttaaaagataggatttctctctgtcacccaggctggagtgcaatggaacaatcatagctcactgcagcctggaatccctgcactcaagtgatcctcccacctgggccccccaaagtgctaggaatacaggtgtgagccattgcacctggccttgatttttaaaaaccaagtccaatcttgttacacttggagatgctttaccctagggtcatactgtagctcttatttatgacctacagggacctcccttagctacctgctggctaggtcggcagcttcatcttatgctattctgtgttactgtgctgcctgggaatatttataaaatgcaaattcttgggctctgcttctggaaagtctgattgactagatctgagactgggctctgggaatatgaatttttgataagccagattcgggaaagtcttgctctagaaagtgtgttctgtgaatattagttgctacttcgccatggaagctgctcttgtcttttgttctttcactcacctttgaattctcaagagttacagctctgctcatgagagatgctgtgccagagctaagccttgtcaacaaaacgttttccctggattgatcattatggctttggttaacttcttgtgtgtaactgagaaactgctcagccaagagagacggagagacacacggagagagacagagacagggacagagacagagagagagagacagagacagagagacagagaccgagagagacaaacagagatagacagagagacagagatagacagagacagagacagacagagacagagagagagagacagacagaaacagagagacagacagataaagagagaaagacagagagacagagacagagagagagagagaaagacagagagaaagacagagagacagagacagacaggaaagatacagaaagagagagacagagagagagaaagagagagagacagggagagaaagaaaaagagagagagaaagagaggagagagagaaggagagagagagactgagactgagtttgtctccaattggggttaacagaatttttggtggaattaacaccactttttatttcttacaagaactttctctatttaattttctctatttgaaaaaacttgagatgtaaaatgcagatgttcatacccaggtatgttgctgaataaaaactctgtatattggccaggtgcagtggctcgcgcctgtaatcccagcactttgggaggccgaggcgggcggatcacgaggtcaggagatcgagaccatcctggctaacatggtgaaacccctaaaaatacaaaaaattagccgggcatggtgacgagtgcctgtagtcccagctactcaggaggctgaggcaggagaatggcgtgaacccgggaggcggagcttgcagtgagtctagatcgcgccactgcactccagcctgggtgacagagcgagactccgtctcaaaaaaaaataaataaataaataaaaaactcgtatattaaatgtaatcttattcaatatatactgtactcataagcctaaaccccagggtttttcttcctttatatattaacatgtgttttgaaatgtgcttttgaaatacaaggggttgtaaaacattgaacctgcagaatgtggacaataaagtaaccatttttgtacttatcaaagtttcaaacaaccctagaaaaatttggaaaacttttgcaagaatcttgtctgtaaggtttatattctatattaagaagttattatgtaatgcacatacagatacagataaaattacttttcacagattaatttttacagatatttttatctgcctttatcaccaagtatttgatttgtaagttgtttaggtgcacctcatatgtgtgcataaaatgaacaaggtactattcatgtcacatccatttcagttctttgttgttggttaattctagcatttgtactgcattaaattattttattgcagtgttgatttttattttccccatttgcactgaagagaatataaggttgacatttctttttggcatgtttctaagctcagcaaatatagcaaccgaggtgctaaatttcagtcaaaaatagaactcctcagcctcattttggaaatttcttctcattcatgcacagggattctagtgtcaaatttttagctctgccctctgctggtcatttcaaattatgcagaagaattctcagaacagtattcatttccaaatataaggagttacaggaaggcgtcttaaaatttcaccactgcaaaatatattcacaggaagattaattgtaatagctttacattttaaaatcaaaaattctttgaggtaaatttttgaaattagagagtagcgaaagctttatagatttttcaagaaaatagcatttgtgttttttttcccctgagtacaggtgaaaacaaatatggttatagttaaggtatcaataacattagagaaaacaatctgatatgtataaatgctaatgttgattaagtattttttgtcctcttctgatacagcacttactccattaaagtctcttgattggttaaaataacacaacttccttttcagataaaacagatttttaattaagttgtatttgctaaaggttatatgctcctttagctaaatgattaacccttattgaaatatgttttcacttttaaggatttgaacaaaaattttgtacagaagcttacatcaagatacaaagatcatggatgcttatagatacgatgaactgcaaatgaaaattgaggtcagccagccatcagacatagtcaacaaatcacgcgggtggaaactgggtagtctcttctgtgtacagaaggaaaatgattattgatgaaacaagacatccatcccatgtgctcattaattatgaacaagaaacaatgtctgtaaacacaaggaaagtttttacaacgcgagaccaagaaaaacagggaaggcatatcttgctcacagccttgttagatcaaggctttaattaaggtcaagctgatatttaataataatttgagactaaagtccagctaaagagtactgagctaggtgatgaaaattggttttgtttctcaactcttaccaacggtgtggcctcaccagtaaaagtcaaactaaatccctctagtgacccgtttaatgctaatagtcaccactttttgagctttgctgagggttttacacatgtcatttgatctttaacaccccttggaggttttgttaggtgtattttttataaagagactggccataataattagtagagaagcattgagatctaggtatgataaactctgaaatgcctgctcttaactgctgtgtctattatgcagaagtccctaaatgtattttggaataatcattacaggctctacatccacacatgttagcatttcacaggtatgttcaaaggcaaagagatgataggttttcacagtaaccttccctatatccatagcttcagaaaataagaaatatatggtagaaattaaccatccttctatgggtctatacatggatattatggataaatatcctggtttctaagtcccaattgttatgttgatttaagggcacggtctttagaaatgacttgttcaaattctctactttattctattgaagtatatttgggctcagtagatcaaagcactgcacgtgaaggcctacctcatttttaaatgatgataataataactgtagccataatggctatatagtctactaatgggtgagtcagtgcccattctaagcaccaacaagtcaccctagtctataagtagcagagcatgtcacagatcttaatctcagttccagcctgtttcctgtgctatccgtggttggtgacagatcttaaggctgagcccttattttagcttttctttctgtgaaaagagacccaacaggcagctttcatatatgtgctacttctgcttggtatgcgctttcctggggcgaattgttcaaacctcaccttcagctaacacctttgagaaaatgtaagctccggtgtgggcgaagtctggattctgagagacaggagtcttagaaaattgtgaatgcagtttcgtacagtatttctttttgcttaagaaaatctttatgataggcatttagatgttgccccactcagcttgagacttgctgtctaattttaagactgaatcactgaaaagtgtaagtctacctctgaaggagcagaactctctgtgtggcaaagcagaggggccaatggactttttctttattttatttttttgagatagggtcttgctctgttgtccagactggagtgcaatgctgcgatcatagctcactgcagccacaaactcctaggttcaagcgatcctcccaccttaacctccctagtagctgggactgcagatgtgcaccacctagccaatctaattttttttctttaaatagagatggggttttgccatgttgcccaggctgctctcgaactcctgggctcaagcaatcctcctgcttcagctggcctcccaaagtgctgggattacaggcgtgaaccaccatgcccggcctccaatggactttttaatgcatgtcactgttctaaattaaaccctgctatcagcacttttcatattcccttttcttattccttcttgagggtaggtaccaccatgggctctggcatttacagaatacacataattctcctctctgtctaatccagtcctgatcctctgtcttctctaggccctgtctagaatctgtgtgctcttcactggacccttttgatactccgagctcatttaaaaaaaaaaaagaaaaagccttacattccttttattccttcccttaactcaaaattggtttccttttataaggctatagtttttgaaattcaccccactctaattccttcctttggatcttctgctctcatagagccaggaggaggatgtgtgtgtatgtgggggtgggttccatatgcttaaccttttgtttccgtttccaaatttgtcctagcagtagcatcatgcggtagactcatacataccacgctctcttcttcttacgcttgttcccataattgctggagaacctcagcacagtggccctgttgcctgtgcctacttctgggatgagctaggactaagcagagacaacatcccgagaaactaatgtcatgctagaataccaatctatgaaattctatttctggaacctttgctgctctactaagcagatccatgcagagagaagcctgccactgtcttggcatttctcagcctttcaaccctgtggagtgtctattttgcaagtcaccacctccttctcccttactcagagccatcagtgattattggagacagctacaaaacagtggcaataaaatccactaaactttccagaggcccagtctgagttgttcaccctgtagccctgtgattttgggtgagttacttatttgagacttagtgttttcatctgtaagatgaggaaaatagaagagttttggtgaggatcagataaaatatcaggcacttatgtaagagaacattatagagtaagtgtggtggaatccccaggcgggtctgagtcatggctttgctgagtgattgctgtgtggcactggctggctcatttgtcctccgtgggcttggttcctagttgttaagatggagggttagtgatatttacaacgtgggctgtaaaggggctatggcaatgcccagcatagaacgagggctgagtagatgctagagccattttatcatcatttttgttgttatattcatggcaggactttttcgggcaaaattcttatatcatctcatttaatctcactcggttctcaaaaagtacccattgagctggttgtatttacagtttttttttttttttttttgacaggcttgcagttgtacgatcatagctcactgcagccttaacctcctgggctgaagtgatctcccacctaaacctctctagtagctggtaccacaggtgcatgccaccatgcttggcaaatttatttatttatttttttgtagagacgaggtctcactatgttgtccaggctggccttgaactcagggctcaagtgatcctctcagctcgaattcccaaagtgttgggattacaagtgtgagccactgctcccagcctgtatgatgctattttataggccagggactaaaggttctcacaggtaaatttctagaaaaagatggagttatgatttaagcccagaagttgcctcatttaaatttcatgaactttttgttggattatgataaagctaacatgcagtaaggggttcaagaagtgtgaacaccagccgggcgctgtggctcacacatgtaatcctagcatttgggaggccaaggagggtggatcacctgagttcaggggttcgagaccagcctggccaacatggcacaaccctgcctctactgaaaatacaaaaatcagccaggtgtggtggtgcatgcctgtaatcacagctactccggaggcaggagaatctcttgaacccaggaggcggaggttgcagtgagccgagatcaggccactgcactccagcctgggcgacaaagtgagattccatcaaaaaaaaaaaaaaaaaaaaaaaagtgttactacctacaaggcctacccagttaagaataattcatgtccgtgtcttaggagaacgtacgttctcactggagagagggagcagacagacaatgcatcaaagagaattctcagttcaaacacagtcaatgctgacacagatagtacagagtgctctgggaacacagatgaagcaataaacacccgtgtaagtggaggaaggccccattctagaaaggtggcatttgaagtggcacatgaaggttaagtaggagttttcaaggtggaaaagacaggttgttcttggcggaaaacctggtttctgcctcagagatacggttggctgtgaaagatcctgacacattgaagaaatggtgagcaattccagttggcagaaaccaaggtgggctgtgaaggatgggcggagacagggatgggtgatacctgttactaagggcatcttcataggcacatccgcaatcccaattccatctcagaatcattagaggtctcaaatatttgtatttactcatttttaaaggctagtcaagtgtagtagtgagaagaaggaaagagtagaacaaggaatttgatctgtaactgattctgaacaatcaattgaaatcaattgaaataactcactacccttggaccaaccagagatctcagatttgtagtagcaagaaaggaatatgctaattttttccttccttccttccttccttccttccctccctccctccctctttctttcttccctcccctcccttcccctcccctccttttcttttcaacagggccttgtgctgtcgtccaggctggagtgcagtgttgtgatcatggctcactgcagcctcaacctttcagacttaagcaatcccccccccgaccttgacctcctgagtagctaggactagagttgcacaccaccacaccctgctaatttttgtatttcttgtaaagacagggtttcatcatgttgcccaggctagtctcaaactcctgagctcaagcaatccacccaccttggctgccaaaatgctgggattacaggtgtgagcaaccacacctggccactaatctttgctttcgatgaagatgattttctgcatagtggagagctagctaccaggatgtggtaatcatgaaagagactataaatcttgttttaatttttatttttttaaccaatctcattctgctgcccaggctggagtacagtggtgcaatcatggcttactgtagcttctaactcctagcctcgagtgattctcccacttccacctccatctctggaatagctgggattagatgtgcactgccatgcctagctatttttaaatattttgtagagacagggtctagctatgttgccaggttggtctcaaactcctggcctcaagtgttcctcctgccttggcctctcaaagtgctgggattatgtgagccactgtgcctggcctatcaaaatgtttttaaactagatttgagagcccaaagtgattgagatgaataagaaacacattctacagacatatctgagatggaaataattcattttggtgacttactagatttagaaggtgtgaggttgtcaaagatcaaggtttctagttttgcagattagatgggcaattctttattgagtaatgttttttaataattcatgctcttaatttttgatgagcaatgcacaatttgttagtatataaaaggactctttagctatatcattaaaaaaaaaactgaccatctggactggcacttcaaaattagatacttttttttttttttaataatgactaaaacttggaatttttataaatatatatcaccgtaaagggacagacgtggtggctcactcctgtaatcctagcactttaggagcctgaggcaggagaatcccttgagcctaggagtttgaaaccacctgaggcaacatagtcagactctgtctctactaaacaacaacaacaacaacaaaaagtcagccaggcacagtggtgcatacctatagtcccagctactaggaaggctgaagcgggaggatcacttgagccaggagtaggaggccgaagtgtgctatgattgcaccactgcactctagcctgagcaacagagtaagaccctgtcaacaacaacaacagcaagaagtatgtcattgaaaacagcctcatgcagagggaaatgttcagctgggtttgaggcagataaaaaaaatccatttgtttaaactccaaaccattcactacttccgaaaatttattttaggatacttaaaatttattgattgccttctcttaagatgtctcggcagaggcatttccttttaattcatccatgttgctcttgttacatttccaaaggaagtgctacagaggtaatgcagagtcaggaaactggttccagtaacgctgtgaagggagtgagggcagggtttagtctctgaaatagactgtgcacttgcttcacaagagggattttttctctccaacagctgagttagagcaggctaaggtggtgggctgaaatcctagttggccctaggatggtaagagaaagcatccactcttgtgatgggacggaattatgcaaagtagaaaaggtttgtcaggacctgtctccagaaaggatcaagcagaatgcattgaccaagaagatggaatttgaacatctacaggttagtaggaatcactgaggaagtgggatatgttagattaatagatgcaattcattaatcgcctgaattataatatacaggaaagacaagaagaaagaaaaataagatctagaaacaaagaggatttacgttgctatttgagcaagcttttgaaagctttaggaagagtggacagaataatagaattattcaatttaaatggatttactcttaattgtacttgctgatatctagaaaatgaaagttaagaaaaaaactttatttcttagcaataaaaggcatttaactattgactttaaaaagtctaccgcacagcttacattatttaatatgacaaattattgtttcctctacagtgctgtgttaatagctaatactttatatagctaccttctgaagctgtagagaggcttataactttaacgtttcatgctgacatttagttgatcctagtttatctggtataaagtagttgctcacaattaattactcaagaactgagcttcgtgtatgtctgtggtagaaatctgtgggagtatgtgagttcattaaaaccgtgctttcctagtcattgctattagtttaacgctttccttgaaatatcagtcactgagagaaataatagcttctgttatggctctgcacagctgtactgaaagattttgttttcacttttcagaagtattagaaaagttgcctccatgtctgggttatctgaaggtgaaaccagtcaatgattataataacttcttttttaatttagaagggaaataaaggaaggaaggggagaaaaggaagtaatgaagtgggggaaaggaaggaatgaaggaaggaaagaagcaatattaactatagtaactgtagttggtactatttatggaacacttgatatttcaggcattatgatttgcaaaaattatctcataatatccccattttacagagggaaaattgaggttcagggagattaactattcaagactggcacttcaaaattagatactttttttaaaaaaatgactaaaacttggaatttttataaatatatatcactgaaaagggccagacgtggtggctcactcctgtaatcctagcactttaggagcctgaggcaggagaatcacttgagcctaggagtttgaaaccagctgaggcaacatagtcagactctgtctctactaaaaaaaaaaaaaaaaaaaagtcagccaggcacagtggtacacacctatagtcccagctacttggaaggctgaggccttccaggatttaaaattaattttttaaattctaagagcatcccctaatccccataagatcctacctctctcatttttttttcttgcagctggataatgttagaagatgtgttaaatatttaatccagccggaatgccaagttagattcagcttggatttgaaaaacaaaaccaaaccaaaaagaaaaccactggttttcaaggcctcagagcataagctttgtgtattacaggaaagcttctatgcttggctggaggtaggagaacctttctgtctttttctgaatttgctatgaccttgggtaagtcaactgacctccctgggtgatgttcagagcattattgatgttatataatttattcttatcaatgccacaaggttggctagatatgtttcctctctaatgtatgattaggaaagagtcatttagacttcagttaattttattttcttcaaggtcaaccaataattcagacatcaagttgaatggaaatgagcttctaaatataggtcaaatacttttataaaaatcacataactgcatctcccccccaccacgcctgaatttgatccatctcccaataagctctcccaagctactacttagtttctattgttagtatgttactgaccaagtgcaccagtcctgcattttgtgtcgaactgattaataattttcttctgaacccctaatgcatcccctattttgtccacactctcataaagactctagttgataaaaatgacaggctgaatattgctaatgtaatatttcaattcagatgtaacatctcttaaagattgagctaattaataccatgtttttatgtttcatattgtatttattattctttggtagcttaatgattacccttctacataatatttatatatagtcttttatctggaaccaataagaagatttgagaaaagttataaaactgctataaaacattataaaaactgtttcccgttcaacctgactgctttgtttcccttaattctgggattttccatcatttgcattatctaattgatgatagaatagtctcatggtaccataaagtaaaagactaacaagaaattttaattggtttgcttgtccaactgctacaaaattataaagactgcctttttctgtgttttttttttaaatccaccctatgaaacttatctttatgtctgtcttttctctgatacgctggggtttaaagtgagctgctttagcctcattagaaataaaaggtatcgtgttaatgtcttctagatgacctttagtaatttgagagatattctccatttttgtaggcttgacactctattttttccctgctcttctaactcctgtattctgtggcttctgtatttgacagtagtagccccactcccagcaaacctgagccgtcacatctctctcttttggttatggagttcaaaatggggttcctcacccatctaagagtcaggtattactttgttcttgctgtgtgagaagtggaaggctagtgaaatgaactaataggatcttcaaagtgaaacagaccatatccaacttgtagccatgtcggaaagcctgtccacactatcattacaagctcagaacagagtgtggggagaacctattctatttaacctaacctgtttgtggggagccagccctgactgccatttattacttttaattctaattacaaataatgcatgctcactgagagggtttgaaagtttattttaaaaagcccaagtcatggtggtatgaatgtttttgctctctcttgagtgcttagattttcaatccctcttggagcatatgaattatttgcatacatggagagatatatatatatatctgtgtatatatatatatatatatatatatatttgtgtatatatatatatctatatctgtgtatatatatatatacacacacacacacacacacacacatacacacatattcttttggtcttcagtttgttcctcatcttagaattttttttttgttattaataaaataagagtgttaacaaaacctctggactcaggtagtttcattggtgaattctaccaaacatttaaagaagaaataaaaccagtcttagtataaactctttcagaaaacagaggaggaatgaacactgcccagcttattttatgaggccaaaatttccctgatactagaaccagatacagtcattagaaaactatagctactatccctgataaatgtaaatatttattaatgaaatatttgcaaatttaatccagcaatgtatataaaggaatgcaaggctggtttaatatttgaaaaccaaatgacatatcaaaaccaggttaggttgattccaggaaagtaaggtcagcttcacatttaaaagccacatatttttcattatatacattgtatgtatatatacattatatataatgtatataatatatgtatataatgtgtatatatataatgattctccctagagattatcagaaaagtgtttgataaactgtatcaccattcatgacagaaactcttaggaaacttagaaatagaaaacttgcttaccctgataaaggacaattataagaaatctacagcaaatatcattagatggtgaaatattgaaggtttgttcttttaagtttgggaatgagaaaacaatgccactattaccactctgtcttgtactgaacaattattcctatatggtctagaagataaataagaaattggagaagaaataaaactgccattatttatgatgatgtgattgtatatgtaaaaatttcaaatacatttacagataaataattagaaataaaatttacataattactgaacacaaaatcaatatgtaaaaccaatgccatttctgtatcagcaaacaaaaattttaaaaatacttaaaaaataatacatttaagacagtattaaaaacatcaaataatctaagaagacactgaacagacatgtgcatggcctgtatgcagaagcctaataaacttcattgagaaaaatcagaaatgacaagtatatgaacagatttatcatgtttatggttttgaatttttttatttcatttctctccaaactaatagattagatgcaattctaatcaatgtctcaagggtgtgcgtgaatgcgtgcttgtgtgctttagtgggatgtgacaaactacccctaaactttatgttggaagggcctagaataaggaagatgatctttaaaaaaatcaaagtgggaggccgaggcaggcggaatacgaggtcaggagataagagaccatcctggctaacaaggtgaaaccctgtctctactaaaaatagaaaacaattagccaggcgtggtggtgggtgcctgtagtcccagctactcaggaggctgacacaggagaatggcgtgaacctgggaggcggaacgtgcagtgaggcgacattgtgccactgcactccagcctgggcgacagagggagactccacctgaaaaaaaaaaaaaatacaagtggaaagagttaatattccaggtatcaagacttattataatgcaacagtaattaagcattctagtatttgtgcaaggacatagaaacacacagtggaacagagtcacctaacagactctcatgtatatagacagttaatgactgacaaaagtggcactgaaaagcagcttaatacagccttttaaataaatgagatggggtcaactgggtaatcatatgaaaaagataatgaaagttgatatccatctcacaaatacaaaactttctaggatgattataaatgttaatgtgaaagataaaataacaaaccttctggaagataatatgggaggtatcttgttgcttatggagtaggcaaaaacttcttaaacaggacaataccctggctatagaggaaaagactgataatttggagtatattgaaagtaaatgggctgggtgttgtggctcacacatgtaatcccagcgctttagggggctgagatggaaggatctcctgagctcaggaggttgaggctgcagtgaactgtgattgtactctagcactcaagcctgggtgacagagcaagaccttgtttcaaaaaaaaaaaaacaaaaaattgtcaaaagaaattatgaagaaagcaaaagcagctgggcatggtggctcatgcctgtaatcccagcactttgggaggccgaggcaggtggatcacagggtcaggagttcgagaccagcctgaccaatatggtgaaaccccatctctactaaaaatagaaaaattagccgggcgtggtggcagttgcctgtagtcccagctactcaggaggctgaggcaggagaatagcttgaacctgggaggcagaagttgctgtgaaccgagatcgcaccactgcactctagcctgggtgacagagcaagactccgtctcaaaaaaagaaagcaaaagctagttatgaaacgattcacattttcttttttgtatgttgattttggtaaattgcatttttttccttaaaaattatgttttatctaatatttttaaattttggtgtaaagttattctaatatcttactactttaaagcctgtaggatcaatgttatgtttccttttttatttctgacattagttatttgtatcaatacttgattatacttgccagaggtttttaatattattagcttttccagaagacttctttggaggctatttattaacacttaaatctgtttccttctttctcccttctttgggctaaattgctggatctttttctctcctaaattctttagatggatatttaacatactgatttttgtaaccttctatctttttaatatatgcatttaaacctacagatttctctctaaacatgactaactgtatctctaaagttatggcaaatatttatattatccttcatttaaaaaatattttaaaatgctgactctgttgtctttttcaataatgtgtgatttagaattgtattgcttgatttccaaacatggagactttgttttatcttcttttattattgatttctaatttaattcattatattaagagaaaacatactcttcatttcagtatgttgccatttattgagatttaccgaagatgtgatcagctttcatcagtgtgctgtgtatgcttgaaaagaatgttttaggttaaatgttttgcttcagtccattaggtaaattgctgattatgttgttcagatcttccatatccttactttttcttttcattgtagcagctattgagaaagttattgctactatgtttgtggacatgtgtttttccttagagctctgccaatttttgctatgtgtgctttgaagccttgttatttgaagcacgcatatttagaattatttattttccttatgaattacatttttatcaatagaagactctcactttgtttcttatgatgctttttgctgtaaatcattatctgttattaatatagctatacttgccttctttagtttaaaatttacatgttatatctttttactttctagtaatcttaatcatttttataccttttcatttgtatcttcaataaagagcgtaggtttggagctcattttttatcttgacagtcttttgttttttactgaagtataactaagtccatttacatttaatacaattgtttaaatgcttggatttaaagtactattttattgtatattttctatttgtcttatctgttctatagtccttttccttttgtgtcttttggatttatcaattactctttactatttaattgttctctctggtattttaaaaactgtaattttaccaactatcttttattattattatttttatttttattattaagacaaggtctccctctgtcacccatggtggagtgcggtggcataatcatagctcactgcagccttgaactcctgggcttaagccatcctcccacctcagcctctcaagtagctaggactacactacaggggtgcgtcaccaccccaagataatttttatgtttatttttaaatttctaaatttttttgtaaaggcaagattttactatcttgtccaggctggtcttgaactcctgggctccagcagtctttccgccttggcctcccaaagtgctgagattacagacctgagccactacacctaagcttatcttttaaaactgcatacatttttgccttttttgttttttggtactttcacctatttcctgacaaattaagcaaccttaagacctgtttccagacaaattaagcaaccttgagattccctaacttaataaatttcacttccaagttacacattgttattttattttaattctttctatattatctccacaggacattaatactgtttatatgtttagtattcatttaatcttttttctttgttctttctttctgcatcttcaggaatctgtttgggattattttctttcagcctaaagagcatctttttgtatttcctttagtgcaagcctgctaggtgacaaattctttagtgtttttggtcttaaaataggtttctttcattttcttcttgaaaaatatttttacaaggtgtagaattctagtaggcagtttaaaaaagatcattacactatcttctagctttcaatgacactaacttcttaacaaaaataatctgtttattcattcattgaaggtcatctatttgtggctgctttaaagatgttatttttagcttttttatagcagttttactgtattcacccacttatagcatttatagggctttgaaatcagtagtagtttgatactttctttcattttatgttttcaggaatgatctttctatagataatgcttctaagttattctctttatgatatctttttttctgggactccaattatacataagttagagttcttcactgtatcttttatcctcttattttttctgcaatatttcccatccttttgactccatttcttcattctggattgtttctttttatccttctttgaatgcactaattttttattcagctgcttctaatctaccattaagtagatctgttgaggttttaatttggctatttgtcagttctagaattgctcagtttttaaaattatttctagttatctgttggcattttttctttctgtttaaaaatttaaatcagggtctcatgttgtttcccaggctgaagtgctgtggtgcgatcatagctcactgcagcctcaacctcctgggctcaagtgatcctctagcctcagcctcccaagtagctgggactacaggtatggacaccacacctggctagattttaaaattttttgtagggacggggtctctctgtgttatctaggctggtctcaaactgctggactcaagcaatcctcccaactcgacctcccaaaagtgttggcatgactggcatgagccaccactctttgctgaagtctattttgtcttttatcttcttggagagatttaacatagctattttaaaatgtgagtctgataacaatctaggatccctgtgtgtctttttctgttgtctgttttcctattgatttttgtttattttttatttatgtctccatttttctattttttttttttattttatgctgtgcaaatgcttagtttgatctcatcttttcccagataggatttatgtttgcttttgccggggacctggggcactaatattccaagatcaccttgaggtatgttcaaagatttagatgctttgaagttgaattttagccctgaaaatgttcgacctgccttcttctagttaatctttgttactagtgtgatggaattttagattctaaccccaagtgagaggtgttggtagggccagtctctcttagaggtcagggtcctccagtccctttccccggataatgtgtccacaaactctcacaggaatcctgtagggtgttgaggggtgggggcaaaaggatcccccatgagccaacctccgctcactaggtctgtgttctcccttgaatcctggcttgctaattttttcttaatttaatattccctttcctcttcccttcaagatatatataaactcacatttatgtgttccatgttttttatatatatgtatataaatataaaatatatatatataaataaacgttacctcattatataattatacgttatgtagccattagctcatgtattattattattaatttttttttggagacagagtttcgctcttgttgcccaggctggagtgcaatggcacgatcttggctcactgcaaactctgcctcccgggttcaagcgattctcctgcttgaacctcccgagtaagtgagattgcaggtgccagccaccaagcccagctaatttttgtatttatagtagagatggggtttcaccacattggccaggctggtcttcaacttctgacctcaggcgatccacctgcctcagcctctcaaagtgctggcattacagatgtgagccactgcacccagcctcgtgtattatatttacaatataaatttatagccaaatactttcacttggcaacataccataaacagattttacatggcattcaatgagatgtgattttaatagctcttgattgtcccactatatgtacaaattaaattttttattcttactgctatttttggaaactctactttttttcttttgtaaaaatgcaagtaacattggaataaatatattctagtacataaatatttttgcatatcactgatatattctccccttagagaagacttctatgagtggaattggtggttcaaaacagatgggttgactgggcgcagcggctcacgcctgtaatcccagaactttgggaggccgaggcaggcggataacctgaggtcaggagttcaagaccagcctggccaacatgatgaaacccaatctctaccaaaaatacaaaaattagctgggtatggtggtgcatgcctgtaatcccagctacttgggaggctgaggcaggagaatcaaaccaacttgggaggcagaagttgcagtgagccaagattgtgccattgcacttgagcctgggtggcagagcaggactccatctcaaacaacaacaataacaaaaaacaaaaaaaaccaaaagggataggtttttaaattattttgatattaaatttttctgtagaaaatttgtgccaatttgtatctcactggtagtaatgttagtgcttcttttaagcacagctaagaaaacactcctttgtcatttttattttattttgggtgggggggacagaattttgctctgacacccaggctgaagtacagtgatcacagctcactgcagcctcaaactcctgggctcaagtgaatttcccactttgtcctcccaaagtgcttggattataggtgggagccatagtgcctggcctatttgtaaacatgtcagagatctcagttcatcctggggtttaatcttttgatgttatcttattattcttttacatttgtcattttacatttgtcattttacatttccatttttaaataagcccttttatttaaaagccaaccatagatgctttgggcaatcacatttatgtgttccatgtagagctgttttaatggctatgttatagtgctgtgtgaagattgtggcagaaatagaaattataagtgtgaagatcatgcaattatttaaaaaatctgtattatttataaaaccatgtgcactatgattacagctacataaaacattcaaagaaaatttagaaaataggctgggcacggtggctcacacctgtaatcccagcactttgggaggccgaggcgagtggatcgcttgaggtcaggagttcgagaccagcctggacaacatggtgaaaccctgtctctactataaataattggccaggcatggtggcacactcctgtaatcccagctcctgaggaagctgaggcagaagaatcctttgaatgagccaagattgcgccaccgcactctagcctgggtgacagagtgagactctgtctcaaaagaaaataaaatttagaaaatatacacagtggatgctgtggtattatgatactgattagttattgtttttcttatcttcccctctcaaaacaattctatagggttgtgctattattttttaataattaaatgattaacgcaaacccagatattgtgagttcaattcaggctactgtcagtagatctaccttttatccagccagtcagtcatcttataaatggttcaaatgagttaaaataaatggacatctcagctgggcacagtggctcacgcctggaataccaacattttgggaggctgaggtggaggatcacttgagctcaagagtttgagaccagcctgggcaacatagcaagactccatctctccaaaaaacaaaaacaaaaaagctaggcatcatggtactcacctgtagtcctggccacttgggaggctgaggtgggaggatggcttgaactcaggaattgaaggctacagtgacctgtgatcacactactgcacttcagcctgggccacagaatgagaccccatctctttaggtaattaaataaatacggcctttttgttatttccccaatagtaataatgtgtttattgctacctagtccaaaaagtatttacaatgattaggaaaaaaagatatagtaagaaaataaaaaggtgctattttagtgaaaagattaaagaaaagaaaaaacaatactgaagtggaaccaggaatgagactaatcaaaaacacatattccagaatctccaaacatgtggcaggtgggccatatgtgaatttcactgtttttttaaataacaaaaatgaaaagcacatctgatcaacacaatttatattgtccctgagattaaaaaaaagaaaacacaaatggccaggtgtggtggctcatgcctgtaatcccaacactttgagagggccaggcaggtggatcatgaggtcaagagatcgagatcatcctagccgatatggtgaaaccccgtctttactaaaaatacaaaaattagctgggcgtggtggcacatgcctgtagtcccagctaatctggaggctgaggcaggagaatcgcttgaacccgggatgcagagactccatctccgtctcaaacaaacacaaactcaaaataccatccaactatttagttctttagacagagctgtgaaattataagatcaggaataaatgtgtcttcagagccctcctacacgagatattctgtaatgggatgggcattttcagtagtcttctgtggacttggcagtcttgtctcagatatcacacccaagcccaattcagttgaggcaattctttttgaggtcagtaggacaaggtgtagagccctctgctggcctgagatagatttatctacataatctagggatagattttatttgatttgatttgatattgttttgttttgtttttgagacggtttcactgtgtcgcccaggctggagtacagtggtgcgatcacagctcactgcagcctcgacctccccccgggctcatgcattccttccgcctcagcctcaagtagctgggaccacaggagtgtgccaccacacttggctaatttttttatgtaaaatttttttttctgtagagatagtcttgctatctcgtcctggctggtctccatctcctgggctcaagtaatactcctgcctcggccttctgaagtgctggaattataggcgtgagccaccagcacacctgaccaggacagattttagagtggttataaagaaatcagtgagctgcatacttcgaggcaatttttatttttaatatttttttccccttcatgcaaactgtggcatcaggtgggagatagtactttatggaatatctgggatatagttaccatattttgctactttaatatgggtctgctggccttgatagacaattgagctggggcagtgctgatagtttcttattaagagaggaacttaaactcagattaattcccacacagatggacattctgtctctactcacagataagccaatcatggaatgagaatagcaacagttcctctcagacagtaataatctaggttctgcattaatatacagtccatccctggcgccgaccagaacccgtggacatggtgaaccaggttatcaagtgcaaggctgcagttgcctgggaggctggaaagcctctctccgtagaggagatagaggtggcacccctaaaggctcgtgaagtttgaatcaagatcattgccactgcagtttgccataccaatgcctataccctgagcagagctgatcctgagggttgttttccagtgatcttgggacatgaaggtgctggaattgtgggaagtgttggtgagggagttgctaagctgaaggcgggtgataactgtcatcccattttacatcccacagtgtggagaatgcaaattttgtctaaatcctaaaactaaccttgccagaatataagagtcactcaagggaaaggattagtgccagatggtaccagcagatttacttgcaaaggaaagacaattttacattacatgggaaccagcacattttctgaatgcacagttgtggctgatatctctgttgctaaaatagattctttagcacctttggataaagtctgccttctaggttgtggcatttcagctggttatggtgctgctgtgaacactgtcaaggtggggcctggctctgtttgggccgtctttggcctgggaggagttggattgacagttatcgtgggcggtaaagtggctggtgcatcccggatcattggtgtggacatccatcaagataaatttccaagggctaaagagtttggagccactgaatgtatgaaccgtcaggattttagtcaacccatccaggaagtgctcattgagcggactgatggaggagtggactactcctttgaatgtattaggaatgtcaaggtcgtgagagcagcacttgaggcatgtcagcagggctggggcgtcagtgtggtggttggagtagctgcttcaggtcaagaaattgccactcatccattccagctggtaacaggtcgcacatggaaaggcactgcctttggagggtgaaagagtgtagaaagtgtcccaaagttggtatctgaatatgtgtctaaaaagataaaagttgatgaatttgtgactcacaatctgtcttttgatgaaattaacaaagcctttgaactgttgcattctggaaaaagcattcgaactgttgtgaagatttaattcaaaagagaaaaccagcgtccatcctgtcgtgatgtgatgggagcagcctaacaggcagagagaagcgcctcctagaccttcagcagctactccagagaatggtgtgatgtgcgtcattcatgaatctctgtaatcaaggcaaggataattcagtcatggactggactctcctccacataaataattgctagctcattaaggaatattttaacataataaaagtaatttctacaaaaaaaatacagactattggacaatgaaattttcttgcatatggaagaaccagaaaaaatgttgatctgaaatattttaaggtgggaaccaaaccctcatcttacctgtaaaaatctcagcgaagcactcttagaatgcctacctttgagcattgttattttctggtggacacactatgataaattatttgtggattatagctctgagttattttaggtgttgttatttataacctagtgaaaagatggggaaatagctgctaaaagtaacttttctctttcttaagctagcaggcctgtagcctactttacgccacttttaggttgtgtttttaaagtttctcatatgcctatggtagaaagtttgttttctttaataggaagatacaatgtcattccgcaaaagccaaaacagatctgaagaatttaaggatgtggagtggagtcatgaaaatgcatccctgctttaacccaaaaataaaactgtgatttgctctgttaaacaattcttatccatcctgaccttgtccttaatactcacagtatgttgattatttatacttgacattcctgagaaaacaagggaatgtaggatttggtaactggtagctagaaactcatataccctattcgggaaaataacacatttgtgaaatattacacatacacatacacacacacacacacagaaaaagacatttatggatggttgaggaaatatcacagggcaattgttaattgaatgcaaaactggttgacaaacagcacaaatgccaagaaaactcagtttgctcaactacttatagtcatgcaaagagcacagaaagatttagtgctggttaagtagagatgatgtgtaggtgagataatgattttcaattcctctgaaaaggatttttttaaagaaataaagtgtgactattgtaatcaaacatagatttttaaaattcaaaacaaatagtattcatggcatattacatttgaatatcaccatgtaattttcatagttcttttcacatatcatttactcttccctcatgcaagctcccccaaaaagacaagggacacatttttcctgatttactgatgagaatattgaggctccaaaaggtgatgaggtttgcttaggggggagcaatgaatatatcttaggaattttatctattccatgttttttctttaaatagttaattaccaataggtttagacataccagataacctgataccttcctttttccatatgatacccacaaagtttccttttggttccttggtaaacaaatgaagaaaatgagattagcagctacagcctctgcctatattgaccagccatctcttttatttatttttacttgataaatgtgttaattcagtaggcagccagtggcccttttttttgttttttgttttttgtttttttttagatggagtcttgctctgtcgtccaggctggagcacagtggcctgatcttggctcactgcaacctctgcctcccaggttcaaacaattctcccgcctcagctttccgagtagctgggactacaggcgcctgccaccacgctcagctaatttttgtatttttagtagaaaaggggtttcaacatgttggccaggctggtctcgaactcctgatctcaggtgatctgcccggcttggcctcccaaagtgctgggattacaggtgtgagccaccacgcccggcctcaagtggcttttatgtagtcatcatagcactgtccagagctaggggagatttacaagacctgtgtccacccttctcatcctgaagtcgtttgcagtcaatttgaggaaacatgatatacactcaggactaggggacaagccactgttttggatagtacaccattaagtgttgaaatgtggggtgacaggtgtgctgagttagctgtcccattcaggagtggcctttcagcagaggtgggtctgattcaggtgaaatgggacttcaactagattttttaatgattgattagactccttgagtgggtagagctggagaaggcattctagtggcatgaagcttggtttaggaaacaagaaatgaatctgggaaggaagatggtgggaatataggaacgttgaaatgatatttaagttgaagagttgggatttgattctgcagacacggaggaaccatggaagaaatctgttttgcttattttctgctagtggagctacgtgatgaatgggaggctttgagattactgttacagcccagtaatacattacagttctgaggtgtggttcaaagacagggggactgaccagatacttttgtttgtttatatgaggttttatagagtgcttttagcatgctttgtattttggtgaatgatgaaactcagtgagatagtttatccccttggttgttggtgctacctcttttatatggaaaaaactatgtctgaggctgttagtaggatgatggctctctaggcaaaagtctttttgtggttgatcatgatgccaggtctggagcctctcagtcactccagccctgcttctctccaccaactcccagaggagctggtaggccaagcatttttctaagcatgctatagatagcatattttacacatgaggaaccgaagctcaggcttagaagcatgctgttgtggccaatttggttctgctactctggaaaatattaggagggcaatggctgcaaagatttaagataggctgttttctggggctgtgtagaagaactgtagctaactgtagctaaaataggtatcattaccactaactggagggcggtgaaggatagagtggagagggcattacatttcagaaacttcttttctttctgtttttttgagacaaggtcttgctctgttgtccaggctagagtgcagaagcatagtcatcattcattacagcctcaaactcccaggctcaagtgatcctttcacttcagcctcctgagtagctaggaataaaagtgtgtgccaccatccctggctaattttttaaaaatttttaaatattctgtagaggtggggtctcactgtgttgcccaggctggtcttgagctcctgggctcaagcaatttacctgactttgcctcccaaagtgctgggattataggcgggagccacatgcctggctacagttcagttgttttcttaagccatcacagtatccatgttacctcttaagaactgacttgtcaattttatcatgtgctgctcttgaataagtgcatcttagctatccccaacagccttgcatttactgtttttaaaaaaattattaaaaaaattttaactgttgcaaaatacacagaacattaatttaccaccttaaccattttaagtgtccaattcagtgttgttatgtatattcacattgttgtgcaatcaacctccagaattttttcttcttgcaaaactgaaagtctgtacccgttacattgcaacaacttcctatcccccatctctccaatccgggcaaccaccatttgactttctgacaatatgaatttgacaatgttatgtacctcatatgggtagaatcatacggtattcgtctgtttgtagcaggcttatttcatttagccaaatgtcctccaggttcatccatgtggtagcatgtatcagagtttccttctatttaaaggctaaataatttcccagtttgtatatatatcacattttgtttatctgttcattcatggatggtcacttgggttgcttccacctttcggctgttgtgaacatgctgttatgaacataggtgtacagatgtttctttgagatcctgtttttaattctgtggcatatatatccagaagtgtaattgctggatcatatagtaattctatttttaattttttgaggaactgccatatattttccatagcaacagtatcattttacggtatcactaatagtacacaatgctttcaatttctccaatccttgccagcacttatgttctatcttgttgttgttgttttggatagggccttgctcttttgctgagctggagtgtagtggcgtgatcatggctcactgcagccttgacttccggggctcaagtgatcctcccaagtagctaggactacaggtgtgtgccactatacctggctaatttttatatttttgtagagatgaggttttgccatgttgcccaggctggtgctttattttgttgttgttgttgtttgtttgttttttaaatagccattctcttgggtgtgaggtgatttcattgtggttttgatttgcgtttccataatgattagtgatattgagcatcttttcatgtgcttgttgactattttgtgtatcttctttgaaacaatgtctattcaagtcctttgcccattttaaaatcaggttatttgctttttgttgttgacttgttaggagttctttctatattcaggatgttaaatccttatcagggttgatttgcaaatacttcctcccattttgtaggttgccttttcactctgattgtgtcctttgatgcacggaagttttaaattatgatatagttcagttcattgatttttaaaaaaatttttgttccttgtgcttttgttgtcatattcaagaactcattgccaaaaacagtgttaccaagtttttcctgtatgttttcgtctaagagttttgtagttttaggtcttatgtttcagtctttgttccattttgaatttttgtatatggggtaagaatttactgggttttaatgaaagcaaatctcaaatgaagttttgcccaacatgtaaacatttattaaacatacaacattagtttgcacaagagcctatccaagctgacttgagagtcagagcgtggccagcttgccactctggtaggtgcttgacctcaccttgtgtgaaaggtccatgtgatacaaacaccaaggaataggattctgtgaccgactgttggcaacaggcaaagagacatcctcctaaactagaggtgggaggtagcactctccggctgtcacaccttgacatcatcccttgcctgagttttatcctttttaagtgtggggatgttctctgatgttgtactcaatctacttacattgaattccttcaggttctccaatgatagctcattgtctaacattcattatgttaattaaagccactaatttcaccaatgaaaaactatttctgatattcagtatgctaaatagcgcagtttctggtgttggtcgagataggatagctggaagatacatgagtagctcaaatgcttagccaggtctgaaatgtggtcctttctgatccaacgctgaggctaaccccaggaatctgaattctcagttaggaccaatgactgtccctaaatgtaaagcttaaactaactggtctatacattgtatcttcctgttcatgctggagattattttatgaatttcttaatttgttaaatacagaaatagcaacatccatccgataactcatttactttgtagtctcgacccagtgattacagtggttttttgtttttcacttccaccatactgttcttctctttgctttacttgatgtggatcaaaggtattagggaaatacaaccagttaagaaaaatgtcacaaatatagggcatgcatatattgagcatatgcatcctaaaatggttgaacacattgttattctgaaatcctaatgagcagttttccaaggtgtttataggccatggagcaggcttccctgtgagatttgtagtttgtctcctggccctaggtatagtactagctgctttctcattctgtccagattctgttggtctgtagctggcgaggtctttcttggccagaagatccctattcaattctttttttttttttttttcttagcaggttcattcactgtttcatggtttctctcccagtttccaacctggaccccagataagtcggtttcctgggccttttgtggttgaaggcacgggagctattattgtcctgtggtgcccaagtacagcctgtcctttgacattcccacaagtatataaacaattttaaaagggatatcatattcagatgaattaaagatgctagttcagggagttctctgattgactgtctggactatctgattttataattccctgcagggctacatagcatctctccctccaaagaaagaggcgtaggttttactatagaaatgaagttgaggcaaatgtggttataaagataaaatgactgcgtgaaaaaaatgtgtatcttaggaatctacactgaatagtataaaaatgctgttttaatgtttcatatatgtatgcatatataagtaatttacatagaaatgattttgcaatgtattagtcatggcttatttttttgtaactgaattaatagcatttcaacattttttatttttaaatatagcaagatcaactttatacctgggctgcagttagtcaacccacacactcattggactattcagaagggcagtttcctaggcgagttccatccatggggccaccatccaaacctcccgatgaggaacacaggctcgaggatgctgaaacaggtaaccctttcctttgtcttcagagataactggaagaggcaagatagagagagagaagttttattaaatcttagttttaagtaatcttttatttttaattgcatggcattcagatataatcttcaaaaagtttttactttggggtcttttctctctttgttccttttgttgtcttattttgtgttattggctgggaagatagcgtgagatcagcctcaggtttatttggaggagttcagcaggatgatgaccccaagcctggttttaagaaaacactttatatttgtcatacagaactgagaaccatatttgtgtaacaatcaatgctttatggaatatggttgttttgtccttttttccccccttcttcttcttcttctttttttttttttttctggacaaggtctttctctgtcacccaggctagagtgcagtggagcatgactcgctgcagtctcaacttccctggctcaagcgattctcccaactgagcctaccaagtagctgggactccagccatacaccaccacgtccagctaatttttttgtagagccagagtctcactctgttgcctaggctgatccagactcctgggctcaagcagttctcctacctcggtctcctaaagtgctggaattacaggcatgagccaccgcacctgggcttttcttcattttgttgtaataaattcccaacttcctcctggtggactgaccaggcataaatattgatttctgaagcatgagtgaggagtaaatagaagaacatcattgctattcatagatttctcctccacccgattttcctaaatggtaacatagatattagagttaagaattttgattttttttttctcattggctcatagagaggaagacagtcattagaaacttattttggatgcatagtagaagagcataacttaaaagcatggagcttgggctctgccaacttattagctttgtaatcttaggcaaatttcctaacaactgtattcagttttctcatctgtaaaatggtgatgagcatagcatgtactgtgtagggctgttatgagaattataggcatttatatgaagcattagaatgtagaatgcagtgcctagctccgtgtatttaatattatttattacaattattatcattgtttcatgtcattgccttattcatgaggtccctttcaaccgacaatgaccaacaatgtaaaaggttttattccagtcccccacccaaagttctgcacttgcctcccatttgcatcccagtctctggaggaatgaatttgcgccttttttctttccactgatgcactgaaatgagggcccacacttgaccttgaatctcccttttgagatgtccagtgcttttgaaacactgtttgatattcactaggtgggctgtactccctgaaatgaacaacaaatgagagagagggtgtaggaagtgttgttccaggaagtgttgttccaggttactgagtttatcgtaacacttacagagagcagtttctcaaaggccaaggcagacttcctttaagcaaagatcttcagagatcagagacctctaacatgatagcacctgaaaatcaagcaagtaaaaggacttttcgttttcaaaggaaaacacacaattaaaagtattgatcccattttctacactactctatttatgataacatttattgatacaaaatacttaggggtagatatagttgaattaatcagttgcatggagagcccttttatcccatgttttgcatcattgattgggtgatattttcatgttttctgttccctactgtatcattctcaacttttctaactgaaacatttatatgatattcttaaattttagggaactttataaaacattatgaaacattttatgttgctggtatatatactggtggagcacttgactcgaagttaattgaatgtgataacctgaattttagtttggtaaaagatgatagttggaattgataccaggaagtttgtcacctggtttttgcttcatgatttgatgtagcttgcaaaatgctagagcaagtgatttttaatgaaataacttgtctcctttttaaaaatgcattcttgaagaggatgatggaggtaagaagtaatttaacttagtgacttatttttctcttgttgatctataaaccccagcagtcatatagcattttttcatcagagtgatctaatgggtctttctaaacttcttctgttgtgactccctgacgtaaatttggagagacacttccatgagacagcctcgttcccagaaccataccacactctcttctaatcagtcagttgtaagagtgggcatgtcagtatcataggtaacctttgcctacagtctcatgttttacatcaatcacaaagtttgataatataattattaatagtaatgatctatttgtagttaactgataggtgcacattcttctgtagtgacatcttggttaaatccactgtatataacacatgaccccttttttttttttttttttttaatggattcttactctgtcacccaggctacagtgtaatggcgccatctcggctcactgcaacctccgcctcctgagttcaagtgattctcctgcctcagcctccggagtagctgggattacatgcgcccaacaccatgccaagctaatttttgtatttttagtagagacagggtttcaccatgttagctaagctgctctcgaattcctgacctcaagtgatctgcccgcctctgcctcccaaagtgctgggattacaggcatgagccactgtgcccgggtgacccctttctattttaattcaaagtgaaagagttcagtgacattttctgaagaagaaagacttgcaggtctagcttagaaaattgaggacttttttttttcctgcgtgcttcgttcgttgtttttttcagctcattttttgttgttgtttgtttgtttttggagtctcactctgtcgcccaggctggagtgcaatggcatgatctctgctcactgcaaccaccgtctcccgggttcaagtgattttccctcctcagcctcccaaagggatgggattacaggcacccaccatcatgcccagctaatttttgtatttttgtagaaacggggtttcaccatgttggcccagctggtcttgaactcctgacctcaggtgatccactcccctcggcctcccaaagtgctgggattacaggcgtgagccactgcactgggccttttttccagctcttaaaattggttacccaattcacatgtccagctagttcagatttgtggtactctgtcttctgcctttttcatgtatctcactttaactgcatagggagcatctcactttaactttttcacgatctgttctgtgaaagatggtgttttcctcctttatggattggtgaaggaactgacccttctttgtatgaattggaagggctgaggccatggtgaggtcttggtgcctcttctcaccagtgagttgcagattcctggcagtcctttgttctcatcctggctccctctgcagttggcattgtctccacagatgggcctaaagtgttaacattgaccttttgaagtctgcagaacacccctgaaggataagactggctgggaaaaaaggaagtaatgtgcttcccatgttggtggcattaaacaaataaaaaacccaaaccagttggtggcaaaaacattgatacaaagaaaccctttctatttatcattttctctttatcttctccctcagtttcccttggctatacacagcagtctcccacccatccatggctgtttcccactcatggacccttttctggagtcccatgacatcctattcatctctctgtcatctgaatgctttacgtattgaatttttctgtttatacatatacatgtcttccccatcagctttcagaatttcaagactttctggcacatagtatgtacttaaatatttgagtgaatgatgaaattcttttgctggaaaagatctaaataaacatctacttagcacattaatgcaagatttgagggagagttttgtatgggctaaaacagttcttggaccaatttaggggctcaataccaagtttcaaaggtcattcaatagatttgaacaacatcaaataattaacttgagttttcaaattcatggagaacctggagcaggagcaaggtgtgtagatgtgaatagggacttgatcattgtcgtttcctctgtggaaaattaaatcccttccctttctttgaaaatgtgaatggctgagaggaaacagagaactgactttttagaaaggcaatcaaggcacagaaaatcctagaagaaaatatatggaagaggatctggtagaaatatggtagctgacttcctactgcaaggaataaaagaaaagaaagaaacaaagaaccatggcagaagattttcatgtgaaaatcctttaaaatgcagttgtgcactggctgaatacattgtaattcacctttgttccaaaaaaagatttgagcagcttataaatatgtaaaatgtacaaaaggatcataaaggaatatagatcaaacgaaaaggaatttaggatggaacaataaaatgaagctgagataagacagccaagtgaaatgtatctcataaggatctgccatttttaaaggtaattggaaatttagccctcaggtgcaaagcagaaaggggaatgtgagtgtcttcctcagtgtccatgagattgaaaacacagtcactcacagaagcacaactaatatcccaaagaagtgtctctaatggttcctaagagaagaaattctgtgccgtgcaatgtcaatacaactcatttcttttcttttctttttttttttttttgagacagggtttaactctgtcacccaggctggtgtatggtggcatgatcccggctcactgtagccttcgtcacccgagctcaagtgatccttccacctcagcctcccaaagtgctgggattacaggtgtgagctaccactcccagctaatttttaaaattttttgtagatatgaggttttgtcatgtagctcaggctggtgttgaactctgggcttaagtgatcctcccaccttggcctcccaaagtgctgggattacagacatgagccaccatgcctggtccatttctgtgttttgttcaaatgttttaacataagttcggttgagataatgcagaaattctataagggaccaggggagacttggtagtattctatctctctgagcccctcacttaatcaaggaataaaatgtactggaatagactgactgtgtctcccaaaaataattacatattttcaacatgtaaatatataatataatatatatattatatgattaggttatgattatataatataatatatataaattgaatatatattatatattgaattagataatatattgaatattatatattacatagtatgtgcatgcatgtatgtgtatacatacatgtatatatacacacacacatgcctacatatagttttcataaaattggccttgattttctcctgcgctaactagagcctaggtgtggctgtattttgttgacaatgagaggcagagcctcagtactattaaataatcaaataagcagatcatggaattggcctcatttaggaaaattcaggtatttaacctcatcttcatttgtggaaagacatggtatatcagaattaaaaacatcttgcatttattaggcagccaatcataagtcatgctatttaaatgaagtttaatgaattctgtttcagttaaattgactggatttgaatcaaactggtatataccattaaagaagctataatataataattttatatagctgcattttaacttaaaatgtctgtttagagactacttcattcatttttagaaggcatattttgtatgtatattttaaagggaggtttattttccattcttagctgagaggcatatcccgctcattgtcttactgtcttctctctgtaaatacacagctcatccaagtatgttttgtttcgtgagtgaaaggcttattttgtgatggtaaagaggtcagtcctgaaacatttggagtccatagggagtccagaattttagattatgctcggaattttgaggtaactttttaaaatggaatatttaaccttttttttttttttttttttttttgagacttgctctgtcgcccaggctggagtgcagtggcgcgatctcggctcactgcaagctccgcctcccgggttcaagcgattctcctgcgtcagcctcccgagtagctgggactgcaggtgcccaccaccaggccggctcatttttgtatttttagtagagacggggtttcaccgtattggcctgaccttgtgatctgcccgcctcggcctcccgaagtgctgggattacagatgtgagccattgcgcccggcctgttttttttttttttttttttttaagaacattctggtttcttaattttaaggatgggtgaaggaggtggccattttaaatgtacccttgagagctctctcaccaggttagtctttgaaaataataaccattctagtgatgaatattcgatggagatgatcagtctgtcctagagctgggtttaaggcaattcctgaaagtgccctggatcctgggaggaggagagtgttgggaacgtgggagtcgggagttccgggagtgatcactttcatttagggagctctatgaaagttggaactaggctgatatctcagattcacctatctagtgactccactcttcagccattactggtacatcaatttctctccgctccctaaaggacactttcgccatttttcatgttccctttactttctccctcctataccttccccttctctttctccctcctataccttccccttctctttctccctcctataccttccccttctctttctccctcctataccttcccccttctctttctccctcctataccttccccttctctttctccctcctataccttcccccttctctttctccctcctataccttcccccttctctttctccctcctataccttccccttctctttctccctcctacacctttccccttctctttctccctcctatacctttttccttctctttcttttattctgtattgttttctttttccttatcatgtatttttctcttctctcccagtggttctcatttattttccctttatttttcagtgaagttattctgtacatctctttcatgttaaaatcttgaccctctagaactcctattttccagcttatgattttgaagacagcatttcaacctgcaaatttctcttctgtgttttaacacacagattcaaacaaataaaaactataatgaaagggatgggattgggagaatgaattcagttcaggtagccattgaattagacagagaggagctgaaagtttgggtgtaggtgtgcagaatattttgctgatgcatctttctaatgtggttttctaagtacgtttttctgataaactgcacttgttctttaccatcagagcccagaagtttactttttgggtccagttaccgggtcaaggactatagaacaaagctagaaagcattttatgcatttctaatgtaaagaactctttgtgtaccaccaggagagcctttaggctcttgtggcacgatctaaatagaagaggaagagagacttttccccactggtacaaagccaagacttgtcttgagtctattgtgtttgggaggatttggaagtgacgaaaaacaatagaaaatgagagcgttccggagtttggatttgctttaatattaactgttaactagctttgctgttaaagatctttattaaaatttggctaactctggtgttaagttcagagtagagatttgtcaatataagagaaaagaatccatttttgattagctcaatgatatgctatatttatctgggaaaatggttgtattttaaggccagttgtttattgccactgtgacacttactggtaagtgactgcatcatgctattctcagtgagttttgttttaaaatatatactcctagctgagattcagaaaatagctaaaggcaaggcaatatctatattgtctcttgtaaaatccttactctctctttctctgcccaggataccccacttttcctggtggaacccactttcatgttcttatcattgttttgatctttcatttattctttcattcactcctacaattactcaacaaatattttaagcacctactaagtaccaggcactatttggatgtgggggacacaacaagaggaaaaactgacaaaaattcttgctttcacagagtttatgttctagtggaataagaggtataaataagtaggcaaccaaatgcattatggagtatatggtgtgatgatccaggttacgaagaaagtaagggtgagtgtgtgctgagtgccaaggagtgggtggggtcgctgcttgagcaaagccccgaaggaagcagccacagagtggggcttgcagattttgggaagaagagtgagtgcagtgctctgggcagaggcagtagccactgtggctttggcggccctatggaagaagcatgactggtgtgtgacaagacaagtaagctggccagggtggctggcctggtgagcaagttgggacagatggaggtgggtagagaggctagggagtaacagtagttgaaaccaggccttgtgggtccctgtggagacagattctcatctgagtgaaatgaaaactttcattgtagcttaacagtatgttaagctgtttaaatactaaatgccttttatttttctgtagcattgtcacatatatcagctaccatgtggctaaattggaaatgtcaaaatgaccataaagagtgactgctggccgagcacggtggctcatgcctgtcatcccagcactttgggaggccaaggcgggcggatcacgaggtcaggagttcgagaccagcctggccaacatggtgaaaccccgtctgtaccaaaaaaaaaaaaaaaaaattagctgggtgtggtggcgggtgcctataatcccagctattcgggaggctgaggcaggagaatcgcttgaacccaggaggcggaggttgcagtgagccaagatcgcgccgttgcactccagcctgggtgaaagagcgaaactccatctcaaaaaaaaaaaaaaaaaaaaaagaaaagaaaaaaacaaaaccaaaaacagtgactgctgtaccttgtgtccagggtctggtctgcatgccagtcaggggtgcaacgcgacagtcaggagatataaactctcgtcttcaccttgccaacaaccacttgcattatgggctttgaatttctcatctgaaaggtgcagaggatggatgagattagtggtttttcaggctctgattcatggagcatgaggaattccttgaaggccctttcatttttatttttatcctaaaggcccttttatttttaaatttgcacacaagcttcacttagaagaaagtgccctctcgcttacgaaaagaaatccctgacttggttatgccttaggtctttttagaatgatgaatttgcagtctcatagaatctcagatgacatgaggactaaaagagaaaaactgcttcagaatcccttcttactcagtgtctcttggtgacagtgttcgttatctcttgttgaaatcaaggggcaatttgacaacagttagatgaggcttttgagctcccatccttcaaccttggtgaagtggcttctatcgtgatacagacttcagctaagtgaataatataatctgtgaaagtcttagaaggactttctggcacaatttagaaactagcaatcgagacaaataaggatagttgatatatagagaagggcataggaatatcccaatttttaaaaatgacatgagcattctcattgtatgtattatatatattgaaaagtagtcatatcctaataacccagttatataattggaagagagactggatattttttggtacttatggttaatgatatattttagtgaaagttttattttctgattgaagaaataggaaaattgtcctttaagatactgactgtctgcttcctttccaatctagaatctcaatctgctgtttcagaaactccccaaaaacgctcagatgctgtccagaaggtaagatgatcttattaggatgtcagattcccatctgtcttatttgtcttaagattgtgacagactctgcgatttatctttccatctgcccggctggctaggatgcccttgttttccctaagcctgcagtggaatccagtcaggcagaaggggatgttttcttccatttattttttgcatacaaaatcagccttgaaatggaactgagtacaagcttttcagaagctgttttattctatatccagccaaagagttgggcccaataacagcgggctccagcaggaaacggtggccactccagggagaagtctgcgagatgtgcctgctcaaacagtcccatggctatgatctttaaaaagaaatctgtcagagctttgctaaagtcaaataaggttcttattactttggtggatgaaacattaattagtatctgtttaatttccaggaaactattttttttctgttactgtattagtccgttttcacactgctgataagggtgtacccaagaatgggcaatttacaaaagaaagaggcttattggacttacacttccacatggctggggaggcctcacaagttcatggtggaaggcaaggagaagcaaatcacatcttatgtggatggcagaaggcaaaaaagagcttgtgcagagaaactcccatttttaaaaccattagatctcgtgagacccattcactatcatgagaagagcatgggaaagatcagcccccatgattcagtcatctcccaccaggtccctcccacaacatgtgggaattatgggagctacaagatgagatttggctggggacacagagccaaaccatatcagttaccaaagaagccaaattttgtgggtttttttttcttacgctaaaatgcaagctatgctaaaatggatttcttattaaaaaaaaaaaactgcaagaaaggaaacgtgtatggaatagtaattgtggatagcaattgctcttttggatataaaaccattgcttacaaaccaatttacattttcacccaactatgcttttgtcagtaacttagtattagaaatgaacagtaaaaagatgtgttctgttctgttggtggtctaggagaaaatgaggagacacatacttgggttttacacccggatctatttctgattagtgtgatgacaacaagcttagattacctgggacatagggttcttctctgtaaaattaaattattgctgatctctgataactcatcaaataaagtaacttccctttagaaaagaatccctgtgttatacatgaaagttgtgctccccctggaggagaaattggggtacaacattggttgaaaacagcacctgggtgcttttcaaaaatgcggctaggttagctatccttaaggacagttcattgaaaaagcaagtttttccagcttattgttatgggagcagagggctacatcaacttggtggcacttggagaggcacggtgggctcaactgatggttccttaattatctgcaatgattagcccacagcgaataagagaaagaaagataaaaaggtaaaaagaaatagtaaagtcagcagttattaagaaagatagtaccctcaaatcttccctcactttttaagccttttttttggtgtggaaagcatggctaaattgtgatttaaagggatacattaagtttttctaaattcttatgttcaggacgtatatgaatcaattgttacatacgataatgtcaaagagaacctgaacaggaagtatttgataatatcaacaatgataaaacatgtacagcattgctttctatattatgctatttcaagatacatattcatgtgtgtaacattatagtgtttttcctgagcgatggaccatggtaaaatatattgcaataagcagaaaacctaatggagtaggttatttaaaaacacttgattttacaacttgaagactcaagggtgaaatagattgaataaatgttacatcttatccttgttgacagtgaagtgtctggaagtcaggaaaattaattgagagggaacaatatttggaagcaatcgattttaagcacccgacaatgacatcacttacttttggaatcattaactctttgtcatacatttattttacgggctgattcttttcttagatgatatggatatgtttcatgacaggctaaagtaactggccgtaaaggggatagggaaaactcaaattaattgtcaacctactgtatacctgttcttttactctattaccttaagaaatcctcacaataatcctttaaagtaactattataatgcgcatttaactgctaaagaaaatgattatatgagttaaaataacttgcatcagatcacaaacttgataaagggtaggctcgctatttgagtacagatctgtttgattttatacttatactatgataaaaattatacttttacatgggtaatcacccgatgccaaaatcgtcagatgaatgagatgagattctaaatttattttattatatgtaaactctaccatgtatcagttggatgtccagatacattatagaggcaaataggtatattagttcacttatacattttgaagttttactagaactttgatgtgctaagttgtgttaattttactaactttagtgctttgttattatgtaaaaaaaattatttttcatggaaagtccttgctttttccttcttagtcactagatggcagttctgtatctctaaatgcagctggaaatgagaggtttgaaggcagttttctcagtatgaatgatgaacctaagagatttttctggtccatcagcgttgcctgcgttcttctgtggtcgtaatgtgagatccccaggactgcttagtcagaggcttgcagccgagttggaaagcatcctctctaagttattcttcagatgtgtgttcagacacctgttctctcaatctgagcacattggaatttattgaatgagttttgacttttactctttctgtagttaataattctgagagtgcgatatccctagaaaaaacacatgactcataaagcctttcctcaactcacaggagtagaaggctgtggtgttgccagagagtctgatgcttaaagcaaatacagctggcactcaagtgaaaagaacggactgtagctactccttgaatgcttttattgatgaccctgtggaattaggttttcaaataaaattacattcttgagacctcacttactgattattttaatttcaagtaatatgctctgaaaatctgctctatctgaagaattatgtcataaaactgaaatgcgactgtcttttgattctgtttattaaaatctttgccatttgaaatatttaaactgtaaagccttttatactctgtagtatataatagcttagtgtcaattattttatctaagaacatttgcttctaagttaaagattggtgtatggtaacatgcttcacctggtagccacctagtttctaactttttgcttttgaaattatatatacaatttttgtttcaaagcatttttctaaaactcttggtatctttctaatatacatggactagctggaagggaaatagaataacattttgatttttaaaaactctagctttgggtaagaattgaaaataacaggtaattgaaagtcaggtctttgaacattataatatttatcatttatcaatagtcacatctattacaaagtgctagacaataaaaaggaattagacgatatcagcactgtcttcccccatatgttgtatgatctatatgcaaataaattctcaagtgtcagaaaaacgctttgctctgatcagccctaccgagtcccctcattgcccaatctaactgcaaatttatttgaagaagtaaatatttttttactggatctccttaaagtatctgttatagtactctttatgcagtggccactcagttccattagtttcagaaataatttaggaacaagtcaaggaaacagatggagtaatgtggagtagccttgtggatggtcttggttactcagaaacaaagtttgaagagcaaaagaagcattggtcagatcaaaagaaagtggagtaaaagtgattctgaagaaataatgctggagacttaataaaacaagccatttgaattggggtagaatgtcttagacatatagaaagtttctaaagaaacattgttgagtatgaggtctttctcaactccaaggcaaaaggtaatatgaatttgcaaagtaattggaaaccaacaaaacaataacccacaagacaagtaaataactaaaataaggcggagtaagaaatacaagtcttaaaggagatagagagagagatacttgggtctgaaaccatgagttagtcatccttgaagtcttcctcagtgtctaatcattcttaggtcctcaataaatagtttaaccactaaatactctgacctaatgagtctgggaaggggcaagcgagagatggttaggaagggaagagaagacaggatacccttagggcagtgctgacattgaagataggtaacattttgaaaggtattcaccatactatgttaagagaaagaaaggatttttttttttttggtgtgggaataatttttattctgtagaaactccaaggagctcagagaaaaatatagacgttttagcttagaaataatcacaaaagaaactcttctatgagttttaagaatgaaaaccagctaacatctggaaagcagttagaacttgagatgagaatgtgaagaaataattggatgtcacagattgtttttgtttttccttggggtggtcaggcttgggggtgaaatgaagtaatatctttgctctattgagttttagatggtgtaaaactagtttgcactatgcaacattattaatggcctgtggagaaaggcaaacagtccaagcagctaatccaatgggggtcgtggagctgataaaagttctctgcttataaaggaggcttgtcctttattgaacatctgctgacctactgtgtgcaaggtatttgtggtagatattgaaggaaatacgaagaattataagacaaaatcttgggtattaagaagcagacagttagaagaacatacctctttcacgtacatgaaatgatttgcgagatgcaatgtaattctgccaagataaacttaacaaaaagggtgaaggttgttgagagactacaattaagggcaatttcttaggaagggtgaaatttagatcaaatcgtcatttttggatagatggagggaagaagagtgagtatttcagatcagagaagagagtaaaggtagaaaattggaagtgaacatggcactgggtgtggggccagggagaagcgcaatagtccaggtgacctgagaggcagctcagctggcagctgccctggagacccaggttttgctttccttctcccgggcctccttggcctgcagcctgacagtgccttaacccagagcccagtcttatctggattactgcagtattctcccgatgggtctctctgcttccagtcttaacccttctaatctctcctccacaatgcctccagagttatctttctaaaatccaaatttgctgatgtctgatatctgcttagactcatccagtgactgctcatagcatttgagaaaatgttcagactcctgagtttgacacatggggttttcccttgccatcctcagtcttcagcgttatcactcactatttcctgtatgattggctggcttgttccaaccctaaaaaatacactagtttttttgttttgttttgtttttgtttgttttttgttgttgttgttgtttttttaatctttaggatccttcatatctgtcttatacatgtttcttctgcactcctctttttaaaaatctacttctattttttaatctaaatttgtctaaacttgattttgttctagacactggacttgagaagactcagtctagggtgcatttcaggagtggtagaacatttgcttatattcataccatagtggttgaggatctgggctttggaccagttttcctgggcacaaatcccagttattccacttttaactggggaactgtcaaagatgaacaaagtcagacattagttaaaatggtaaggacagattttatatcagtggcaactattgcgctagggaagagtccagcgtgaactaaactcaactttgatttgtacagaggtgaccaagcattttaaagggagaataaaggaatagggagaagggtgagtggaggctcaggagactcagaagtgaaaaactgcaagggttcattagtgtaaatgagattaggccagctgtgtctactaactggcagttataagttaggagtctgtcctccgccagagactaggaaagaggccccatcctcaggtgaaggctgaaacagtaagttgttttggcagccttgagttttcttaggcagtaatttaaagagcggtaggattatctttgggatgcagcctttagttggtagaaactatgttaatgtttgctcaagcctttacaggccaaggctaaggcctagttgagaagagggctcagaggagcctggctagagcttgatcaagaagagaatctttgttagaatttaagaatagcattttactctgtgtgccttagttttctcatctataaaatgggtataataagaattcctatctctacattttttttttgtgagttttaaatatatttatgtaaaatgctttggaggagttcctggcactcaaaatgttagctctttatcattattgttgttatagttgagcaatactctggttttgaaagttgctttcattgcataggtggtcctcattattcttggatttgcatgtatttgcgaactcacctacttgctaacatttatttggagcccccaaatcatattcatatggtgctttcacggccaatcacaaacacgctccaagtggcaagaaatttgagttgcttgacgtggactttcccagctgatgttgaatgaggtgaagctctgctttcttctttcagctctcattctgtaaataagagtgtttttgtggctgttttttcatgtttttgtgctttttcttgttggttttactgttcgaaattgcctccaggcatagagctgccgtgttgtctaatgttcctacgtgcaagaaggctgtgatgtgccttgtggcaaaaacacatgtcagataagctttgttcaggcttcagtgatgctgctgttggccatagtaaatcagcaatatatattaaataaagtgtctttcagcaggaacacacatttaaaaaaggtaatgcattgattggttgacaaaaatgtgaccaggggcttgcaggaatctaaacctgtattttttctagaagcaatattcagtattcactaatttgatgttcacaaagactttataggacaaaactactgtgaataacaagaattgactgtatctttttaaattctcacaataaggctgggtgtggtagctcatgcctgaaattctagcactttgggaggctgaggtgggaggatcacttgagcccaggagtctgagactagcattggcaacatagggagaccctgtctctaccaataataataaaaaaaacagctggccatggtggcatgagctacttgggaggctgagacaagaggatcacctgagcccaggaggtcaaggctgcagtgagctatgattgtgccactgcactccagctggtacaacagaatgagaccctgtcttgaaaaaaccaaaacaagacaaaaacccaacattctcacaatatccttttgcagtaggcagagtgagtgatggagtctccacattttatggactattcaaggtcttatgagcctaatagaggatttaaaacgttttatgctcagtagtcgggagccatgagtttttgaggaatgagcaagacagtttaaggaacaattacctggcaagggaatgtagaatgataggaagagggagagtggagccagttaggaccagctattaaactctcaaagtaattccattacttctcagctaaggtgctgatgtgatacaggaaaagtggcaaccaagaattgaaatgatgggtttggtaaccatgtctagggtataaattaggctgtgtggtttgcagacttcagtatcaactgggagctggttagatatgcagattctcaggccctacccagacctactgaactggaaactgtggaggtggggcccagcaatctgtgtgtgttttttggtttgtttgtttttgttttgatacagagttttgctcttgttgcccaggctggagtgcaatggcatgatctcggctcactgcaacctccgcctcccaggttcaagcaattctccttcctcagcctccctagtagctgggattacaggcacctgccaccatgcccagctaagtttttgtatttttagtagagacaatattttgctgtgttggccaggctggtctcaaactcctgacctcaggcgaaccgccggcctcgacctcccaaataatctgtgttttaacaaaccctctaggcgattctggtgcacattgagcttaagagacaatgaattagagaaatgatcgaaagatgttcccaagcctaggtaaactacaggacaggcaaaggagtattttgttggaggataagatgcttgatattatgaaacatacatttggtcttaattgccatctcctggcatacaactcctaaaatccttggaatcttcgaagaggttaagtgtctttttatatgctactgtttgttgtctggtaacttcaggatggggctggtccacagaaagaccaaagcatagtaatagggttgggactttctgccccaccccccagcctcgggaactgggaggggctgaaggttaagttggtcaccagtgcccagtgatgtagttaatcgcacctacatcatgaaacctccattaaaacccccaaaattgatgggatttggagagcttccagatagctgatgaacacatggttttcccggagggtggtgctccccttttcccaagcctctccccatccatctcttcatctgcatcctttgtaacatcccttctagtaagtcagcaaaagttatgtgtttccctgagttctgtgggctggtctaacacattgaacctgcggagggggtggagggatcctggatttatagccagttggtcagaagttcctagaggcctggacctgtggcttgcatatgaagtgggggcagttttgaggactgagccctcaacctgtgggacctgatgctacctccaggtagatagtgttagaattgatttgaattagaggacactcatctggtgtctataatagaattgattgcttgctggagggacgaaatctttgcacattttgatgatagaggtcacagaagtcctctgttttcattgttgagtgagagaatagggaaagcattgtggttaggttttttcctgtaccctcagatgcactttaaggaacctgggtacctcccaggttcaagcaattctgcctcagcctccagagtagctgggattacaggtatgcaccaccacgcctggctaatttttgtattattagtagagacagggtttcaccatgttggccaggctggtctcaaactcctgacctcaggtgatccacccacctcagcctcccaaagtgctgggattataggcgtgagccactgtgcctggccaggaagatttttcttgaaaaaacaaacaccaaaaaaaagatatttgagaacagttgggtgttaatgcaagggaggcgattaggaggtaaaaaactgagctgcactttccatccatagatcattcaaggaaagtgaagctggaataaaatagtgctttccttccttgcattacttgagacaattaagggatagattgctttaaagtatggtccagtacctcctgcaactctagctcaaataagtagaaagaaacttctcaatatgtgagcaggaaccaaaaaggctggttctttttgctgtttatctcccttttttccctaaatgtttattgcttccactgtgtttgttcactaaagatcattactttaaccttcccatcgtatcagctcccattctaaagagatgttaaaagtaatacagccaagtatgatttctaacgtacgcctcttccttccatatcacatttctcagtcatccgtgaaggaatggaaagagatttgccatgtccattccagttcagaaatattataatttccataattcatcatgtattttatactaaggattctagagatgccatctcagctccctgtgtgaggctctttcccataatatgttctattttaaaaagccctaggcaagttatttaccatttgccatctgttctaatattctttcttgaaatttccctttcaaacttaaaattgcttgtattttagttttgtgcaaaattatatctatataacacctcgatctctttccctatgggatcatgtgtagcagatgttaacatattataaactggaatgccattggttgttccaaaactaggatgtttcttaatttagaacatgacagcctggcgcggtggctcacacctgtaatcccagcactttgggaggccgaggtgggcgtatcacgatgtcaggagtttgagaccagcctggccaacatagtgaaaccccatctctactaaaaatacaaaaattagcccggcatggtggcttgtgcctgtagtcccagctactcgggaggctgatgagggagaatcgcttgaacccaggaggcagaggttgcaatgagccgagaccgtgccattggactccagcctgggtgacagagggagactccgtctcaaaaaacaaacaaacaaaaaacaatatgacaaatagagaatttatatgcttctgtgaagaacagaattcctattttacagatgtctagaggtatcctaacctgccagtaatgttgctttagaatttagcagaatttgaaaaatctaaatatggtagaaaattaattatatatctcatgttaaaatttataaaataaattattacagcgttaacttaccaataagcagcttttaaattctaggctttaaaagtatcctgcttacataataaacataataaagtttcaaagatgagcaaattaacttttcagcaaaagctttacttgagtgtatcttggcttcttttttgacagttgtaaccttaatgttacagtaatgttttctttttctgggaatcagataatcttctgtttggaaaaatatttttggtgaacattttattttttaatggaaacttgtattatgtgatacgcaagtgttcaaacaatttataagagctaaccatcaccacccacatataagattatacaggaatggaggaattttggctgacttactgtatataattattgagccaacgtagatggcagactctaccacttatgatttagggttttgaaacagtattttaaagtacaaataatctcaaaattggtaatctataaagcatattaattattgtattgacgaactaaaaatagatttaaccttcctccatttataaggatgcatccattatataggttctgtacaaaattgccaagcttacttttctctttttctttttttacaacaaaatgtatttaaattttttgataggaaaagccattagctttccgtaaactgttgcacaatcactggaaatgctgagtgagagtctttctgaaaactgtagaaggctaaagataatgaaaagtgtatctcttcattgtcaagtcctttgagaatctgataggctctatctagctgcaccctgaagagacaagattaagttccaggcgctggacacagaggaacaggctcctaactggagggctttccacggacaacagagcgcctggcagtctcttcgagattaaatctaggctgtgtgggagggtgggccccccagagcttcattccactttgtgtgggtcctgagagtagggtgtttgcttaaatggcaagaaaatggccctttttcctgataattactaatatctgccatgtaaatttctttataaatccctgaaagaaaacaacctatattagaaatcagctcttacttctgacaagcaatggagctttctctagagcgctttacaggaaatatctcagctgactttctgaactggtactctctgagagccagccggcccttgactgatagccctggataaggaaggccagataagattctttgaagactctcagctaaattcagagccccaaatcctacatacatttggctactctgtagtagtggattggtggccttattttacaggctagtcagttaaggtttgagatgcgcttagttgctctgcttgtgtggaatagaaaagggggattgtaacattaatacagggccggtcgggattttagggtgcaggtaaggataggtcatagggagaatgaagattctagcaggttggttttttgttctctctacagtgggaataatgtaagaagcagatagtttgttgcccccaactctttttccatgttctcttctatcaaaatgatctgtacaaaaaagttctgtttataaaaattttagtctttcatctttgcagtctgttatcatctttatgaattttttgactcttccaccttcctggcaccacaaggctagcattgctatatttattaaagattcagatttggaattttgtcctcttatcactacttcctctgccatttgttagctctggttcttattgtatcttacatttgaaaacctttgaagcttatggggtatatcaattctttattttctcaactttttattatctaagtaccctcaattatcaagttgtttaaaaaataaataaaatacataacagaaattgttctgttacgcactaataaattgatcatttataaaagtagatccaaccccaaatccctctccttttaacacagaccatctgttattatccaccatcctttagtttggcagggtcagtttatcaatgatttttggatgttttaaaccacatgacacaaatgcagcataaagtgaacttgttaatcatgcagaagttggagggtttcttgaagtcagagaaggtgatggtggagaacttgaattgcatgaactgtaattgatttgtgagcacctcgtggagttagctaatacagtaagaatgatgatgtgacagatgtatttaaaaaatgaatttgcatattaggattgtcagaggcctttggggaaattaatgaggttctcaaatactacaaaaaaggaccatcttttcataaaaggtgatatgatgtcatatatcatggcaccatatatttttgttaaaaattagcactgaaaataattttaattttaataatttgtgcatctttccattatgataaaaattgttttaaattaaaatgacacccttacttaatttttaatttcttttttatggaaaaaaagtgaatctttttttcataatttattctgaagtattggtacctgggtatatcagtcagaccttttgcaggaactggaaactatgctaggtgcatgaaacagaagtgtttactataaaatcaggtgttttatgggaagtttggaaggtttgaagcatctgtgtctaaggtgacacttttcaaagaaatcaaatacaactggattatcaggggagttaaaacttttgaggccaccattgcaatttgtagagtggacatttgaatgttgttgtagagaagctttgttttcagaccttaactgctaacagagcagtccagacacgggaatatgatccttacctcattcgactttctaaatctttgtgtggttgcatctaattggatgaatctagctgcaagggagtctgcaaatgtagtttttctttgtatttctgtaaacgggaaggggaggatggagattgcgagagccaatccaaggtaaccaaaagaaaatttaagtggattctacttaagagatctttttctggtactgggtatcatgtgtaatgatgcagttacatttttgactggctatgtaaattagaaaggttaaaaaaaatcccaggaatcttcacagtcactagtattatgacctctgttaccactaacttgggtgccatgtggaactagctggcctgtgatgtggggcagaaatccatgtagaaagaggtgtaataattgttactatgctaggccattattaggatcattttctttttattactattgttgttttttatatttttagaggcagagtctcactctgtctcccaggctggactcctgggctcaagtgctcctccagtctcagcctctcaagtagctaggactacaggcacacaccaccacacctggctatttattttccatttttgttgagatgaagtcttgttatgttgcccatgctggtctcgaactcctggcttcaagtgatcctcccacttcagcctcggaaagtgctgggattacaggcatgaccactgtgcctcatcagaatcactttttcctctgtgtgtgtatgtgtttatataataatatcctttaattttatgctattttcattatattcaaatttatgatgaaacagagctggcataggcaataacatttacaaactgagttttggaaaactcctccagaatctacttcttacatgctatttatcaactaacctttttatataatcatagttcatgaaaaaagaaaaccctagttatgtaccagcataactcaagaaataccttttaatgattaaaggtcacctttaagagtatgctggaaaaacgaaaatgatctgtgcattttactaatccagtcagaaatactaattgtactccttattaagataaatttgggtgctggttttttggcttctggtttcttcttgtactcactatcatcatacaattggagaatggaattatgtatagtggccatacaggatgttaaaaatggttatgttccattgtgaaagacagtgtggcaattcctagacctaggaacagaaatagcatttgacccagcaaccccattactggatatgtacccaaaggagtatacatcattctgttacaaagatacattcacacatatgttcattgcagcactagtcataatagcaaagacgtggagtcaacccagttgcccatcaatgataaactggataaggaaaatgtggatatatacaccatggaatactatgcagacacaaaaaggaatgcgatcatgtcctttgcagcgacatggatggagctggaagccgttatcctcagcaaactaacacaggaacagaaaatcaaacaccacatgttctcacttataagtggaagctgaacagtgagaacacatagacacaggtggggaacaaggcacactggggccttttaggaggagtatggggagggagagcatcaggataagcagctaatgcatgctgggcataatacctaggtgatgggttgatgggtgcagcaaaccaccatggcccacgttgacctatggaacaaacctgcatgtcctgcacatgtatcccaggacttaaaataaaattaaataataaaaaaaggttattttttttcccactatgggctacttaaaaactacatggcaatatagtttttccccacaaaatacataacacaaaatacacaaaatacaaactgtgcattacaaatactttagtcttttgtgtagatgttggtgaaaaataatgagcttttaaggggagagtgtgtatgtgtgtgtatatatgcctgaataacatataaattctcaaaaatcttgcctatgaaagtgtgttacattcctttattagttgaaaagtcaattatttttcagtttcctttcatagtaagggctacttcttttttttttaacaatagaaaattaaggaaatcaaccctttgtaggggttgtgtttctaaattactggttgtcttcagctgtcagcaaacatcatgattgaccttcagcaagttaaatgttgtagcaaaagatatagtttccagggaagaagtaacagaggttaggattaagactactaaatttagcagggtgcagtggtgtgtgcctatagtcctagctacttgggttgctgagctgggagggtggcttaagcccaggagttcgaggccagcctgggcaatgtagcaagactctgttgtggaaaaaaggaaggactattaagtttacatttctagaccatgtgcggtggctcacgcctgtaatcccagcactttgggaggccgaggtgcgtggatcacctgaggtcaggagtttgaggccagcctggccaacgtgctgaaaccctgtctttactaaaaatacaaaaattagccgggcgtggtggcacatgcctgtagccccagctacgcaggaggctgaggcagtagaattgcatgaacccgcgaggcagaggttgcagtgagctcagatcacgctattgcactccagcctgggcgacaagagcgaaactccgtcgcaaaaaaaaaagtttacatttccttcatagagatggggggaaaaaggtgccctaaagatttttatcacatctatcatagcacccaaaaatgcctcatttgtagtaaataccctttctgtcttgtccatctgcattttttccactgcaaatgggttggatgtctgttcagatttaataaagaagatgtttgcttttcactttgtggagatatttcttggatccagagtttaaccttagcaagcagggtaagagtttagttttatacttaatattatctttatattacctgttaattattcttccacaatatgtaaaaatcaagtctggagtataagtgtcagcctcccaggtgggtaagaagcgtgtgcatgtggacctatggctgtttaccgtggcctatggggatcatctggaacactctggaacactctgtagtgttgcaggaaaccctggaacactgaagaaatagttctcaacacaagaagtctctcatcctctctttcccttttattccagcctttagtgagcaaatccacatctgtatgagcagtaattaaagtacgattgacactgcagtttccacaaaagtgggagttgtcttcctatgtttgtttgtcttcctttctctctatcaattccttcttcctctcttttcatctgttattcatattaaataatttacccttaagaaggcaatgctctttcctttttttttttttttttttttttgagacggagtctcgctctgtcacccaggctggagtgcagtggcgcaatctcagctcactgcaagctccgcctcccaggttcatgccattctcctgcctcagcctcctgagtagctgggactacaggcacccgccaccacgcccggctaattttttgtatttttagtagagacggggtttcactgtgttagccaggattgcctcgatctcctgacctcgtgatccacccgcctcggcctcccaaagtgctgggattacaggcatgagccaccacgcccggccaatgcccttctttctactcaaaacgttttttttttcttgaagggttcctggttgattgtgagttttaggaaaggaagacaccacttatatgtcagagtgccccatatgttggccagttgttatcagccatcttttttttttttttttttttttgagacagtgtctcactctgtttcccaggcgggagtgcagtgcagtggcctgtgatcatagattgctgcaacctcaaactccagggctcaagctgtccttccgcctcagcctcccaagtagctgggactacaggcgtgtgccaccgtgctcagctaatttttttaatttttaggagagatgcagtcttgctatgttgctcaggctggtcttgaactcctgatctcaagtgatcctcccacctcagcctcccaaagtgctgggattacaggtgtgaaccaccatgtctggccatcagccgtctttataaattgtggagaactgtcagttatcactttctgaaataccctaggtaaaatattaaagttctagtaaacatgatataagcggtatggcacatgctcataatgcatttgtcttgcccatatggatatcaaaaatattttatatattattattgaacactcattcagtgatcacttttaaaaagcagtgactacctttaaaattcgggattacctttaaaatgttttcagggaacatcctaaaaaccagtgttcctaggctggaaagaaggctatcttagaaataaactggtttatcactcagagctttcttccctgttctcagtggtctatttgtcctcaatggtatcatttgaaaatgagacagatgtggacttaagattctgtggtaagtcacgtgtgttaaccactttgaaatctcagggtgcaagccaggggacacatagaaatattaataccatctttctgtcaaggagtccttctggaagtatgacaacaaacagatataattttgcttaattttttgctatttgcatttttccttatttcataactaactgtgtctgtccttgtcgcccttcaggaagttgttgacatgaagtctgagggacaggccactgtaattcagcagctggaacagactattgaggatctgagaaccaaaatagctgaactagagaggcagtatcctgccctggacacagaggtggccagtggtcatcaagggcttgagaatggagtgacagcctcaggcgatgtctgtctcgaagctctcaggttagaagaaaaggaagtacggcatcataggattttagaggcgaaatcgatacagacttcccccacggaagagggcggggtgctgacactgcctcctgtggatgggctgccagggcgtcctccatgcccccctggggctgaaagtggacctcagacaaagttctgttcagagatttctttgattgtgtctccaaggcgaatatcagtccagctcgacagccatcagcccacacagagcatctcacagcctccaccacctccatcccttctgtggtctgctgggcaaggacagcctgggtcacagccgccccattctatttctaccgagtttcaaaccagccacgaacactctgtttcctctgcctttaaaaacagctgtaacatcccatctccaccacctctgccttgcacagagtcctccagctccatgcctggcctgggcatggtgcctcccccacctccccctctccctggcatgacagtgcctactctgcccagtacagccattccccaacctcctcctctgcagggtacagaaatgctgccaccccctccccctcctcttcccggagcgggcatacctcctccgccgcctctacccggagcaggcatactccctctgccccctctacccggagcgggaatacctcctccgccccctctacccggagcggcaataccccctccgccccctcttcccggggcaggcataccccttcctccccctcttcccggagcaggaatacctcctccaccccctctacccggagcgggcataccccctcctcccccacttcccggagcgggcataccccctccgcccccacttcccggagcgggcataccccctcctccccctcttcccggagcgggcatacctcctccaccccctctacccggagcgggcataccccctccgcccccacttcccggagcgggcataccccctccgcccccacttcccggagcgggcataccccctcctccccctcttcccggagcgggcatacctcctccaccccctctacccggagcgggcataccccctccgcccccacttcccggagcgggcatacccccacctccccctctacccggagcgggcataccccctccgccccctctacccggagtgggcatacctcctccgccccctctacccggagcgggcataccccctcctccccctctacccggagcgggcataccccctcctccccctcttcccggagcgggcatacctcctccaccccctctacccagagtgggcataccccctccgcccccacttcccggagcgggcatacccccacctccccctctacccggagcgggcataccccctccgccccctctacctggagtgggaatacctcctccgccccctctacctggagtgggaatacctcctccgccccctctacctggtgctgggattcccccacctcctcccttgccaggtatggggattccacctgctccagctcccccactccctccacctgggacaggaatcccaccgccccctctgcttcctgtatcaggccctccactcctcccacaagttgggagtagcactttaccaaccccacaggtgtgtggatttcttcctcctccattgccaagtggcttgtttggattagggatgaatcaggacaaagggagtaggaagcagcccatagagccttgtcgaccaatgaagcctctttactggaccaggattcaactacatagtaaaaggtaacatgaaagtgagctcgtctttgcacagtgtgtgtcagtattagggaagtgtttaccttcaaactcgggaaaattactgttgaatgtatttttaagcacaactctaaaactcgtctagatttttacatcaatatatagtgcagcagtttgctatttaaagctttaagcttttctccagaagtaccaaagatgtaaaataaatacatatacgtatcaatgtataagatgtaggtatacccatctatgtagttattgatatatctcttaaagattgagggatatatttttcttaaaatacatgctctgttatctagttgtaagactgctacttatttatgcctaaattccagtgaaagtatgcttatatgccctttggaaaatgaatgagggcaggtaagcagagacatttgtagcgaaattattttccatgtaagaatctactctttgcttttactacttcaagtttccatttctgacaaacagcttaaaaatgtaaatcaaattcttaaatccttttttttttttttggaggggggacggagtctcgctctgtcacccaggctggagtgcagcggtgcagcctcggcccactgcaagctccgcctcccgggttcaccccattctcctgcctcagcctcccgagtagctgggactacaggcgcccgccaccacgcccggttaatttttttttgtattttcagtagagacggggtttcaccgtgttagccaggatggtttcccatctcctgacctcgtgatccgcccgcctcggcttcccaaaatgctgggatgacaggcgtgagccaccgggcacggccgcaaatcaaattcttaggtaaactgactctggagcatgatttagtgcacactttaaaatgcacagccctgtccgggtgcggtggctcacgcctgtcatcccagcactttgggaggccgaggcgggtggatcacaaggtcaggagattgagaccatcctggctaacacggtgaaacctcgtctctactaaaaatacaaaaaattagccgggcgaggtggcgggcgccggtagttccagctactcgggaggctgaggcaggagaatggcatgaacccgggaggcggagcttgcagtgagccgagatcgcgccactgcactccagcctgggcgacagagcgagagtccgtctcaaaaataagtaagtaagtaaataaataaataaataaaatgcacagccctggtttacagtcccatcttgtgggctttcttcagaaacatgcttcacaaaaatacacatatccataccccaagtgtgaaataatttagttttgaaaatttcatggcacttctgtccctcattggcaacacagcacaaagtcatacaatcatagctgggactgatcatcataaaagaatactttccaccaggtattctggtggtactttatacatttatgtgtcatctatagcccgtgttgcctagtcattgagacaatgctgtgatacttggctgtggaatgtgtaggtggcagggaaaaacgcacactgtaaacctcactggggcttccttgttctaatgtttcatgattccttgaatttcctttgtgtgaatttcctttgtgtgatgtggcatgcatttagaaacagggtatttgccaggttcgttttcatttcttatatggatttttctactcactacaccatatcgggggcaagaatctgtatattctgatgacttttaatttttcagttcatcttctgtgttgttaccacgccacttatgtatgtgggtgattcattttaaactgtgccccaaagtcattttctctagatatgacaggggaagttcttgtgttttgttgttggtttgctttttaaaaagatgtgtttaccctttttaggtggtactacacgaatctgcagtcactgagaagacaaataacaatggggtgatgggaggcagtaggagggagaggatgccatcctgtaaatatgtattttttaacccatgaataatctgcaaagttgttaagtcaagttgggattttgagagatcagacatttcttgcctccctagcccacactgagataagttttctttttacatttttatacagtggcctgatgactgaggcttcctggaaattatttctggggaaaaatttcattcatggatggtatttcaactttcccattaagttgatcaaacaaatggtggtcttaaagaaaaagaatattttttccttcttatctctcttctttttccctccttccctcctgctggccttcctccctccccttcttcctttctatttatgcttgctgtgatgtaagttcagtttgatggctgttttattgttcttttgcttaattttagagactccagtacttcacttatttgggaaaaaattgaagagccatccatagattgtcatgaatttgaggaattattttctaaaactgctgtaaaggagagaaagaaacctatctctgatactatctcaaagacgaaggctaaacaagtgagtatttttgtgctttatgaaattggacagtgtttctggcataagtgtgaactgtcattagagaaaactttgaaatagtttttgggctgtgtaaacctccatggatcttaggcagacagcaagggttagaactttagaacatgtggttaagtaagactagcccaaatagaacaacacataattatctccatccagtgataatgtcccaacttttatttgtaacatcataatacatatttccaaaatatccgccattgtttctttccagaattagttgcctagaaataaattttcatttgatttatgtccatctgagtgctcctatggatggaaagaaaggaaagagtgggcaaaggaaaacaatcaagaaatccaatccttagtaactgataatgtgtttggtattttgttgcattatatctgaagtggatgccattagaatccagttaaacagtcacactgtacttgaaatgtggaagagaaatcttgtatccatttctaacctctctattttatgttagatcctttgatctaacctgtgacatttttgagtcataaaaagaaagattggtgcatttcaagaaaaacatttccaagcaatttttttctactgatatatccattggacttgtcataaagggatattgttataaatttctcaggggtgtcatttggaaagtagagtaaaacctcatgataatgaactccagatagaaagaattgctaatggtgcccgtctttaccctgaaatggagagtggctacatttcttaacttttgcagggtggcaggaaagaggtcttggaagcaaaggaatggcaagcagctcagtcttgggaagcaaagagggaaaaatgaggctgatatccccagtgttctccttgcccagtagccccataggagttccagctaatggggtgattcctcgaatttgtgcctctgacctggaagtaatagctaggcacatgacctggagttgtttccattgatatttatttcagagcagacaattttcattagatggacattgccaaatccagccaggagaagatggatttcaatgggacagctagacccctgtgacccgtagttggctgggtgagcaggctcaccccaggcattttattaatctgagaataatgtaaacccaaacattatgcagttgaattcttttagaaatgcttgttgcattatcactggttgctggtgacctcaggtcagtaacatagtaaatgagatggcacctggcacattgtaggcactcaataaatatttattaaattaatcagctgactaagggatgaagactttataaatatcagtggctatgtccagtagtgattaaaaaccagaaggttactcatttcataataatcagtaagtccagggtgacaatgttaaaaggagtaatggaaaatcatattttctctggcagagataaatatttaaaaaatccttggtatatttgcatatagtacactgaggctgaatcatcgtatctcctcttttgggttgtgtcagagatgtaaaatctgtctgggcgaggaatatgggtggggcttacattgagaagagtcaggcagccggaactgtcacatgacaaacgtgtagatgtggcatggagcctctctcgtccagggaccaaatactcagaaaattgagccatgctctccttacttccagcaccccttttgtttttttgtgtttttttgtttgtttgtttttgtttgtttgtttttttggctaagggaatacagataaggaagaagtctcccaggttgcccaagactgtaggatttcattctctgtttgacatagtattaagttttagcttactgaaatatgatttacatgtaaatcatcaaacttcacattaaactagttggcatgaaggggtctcagcatataaacagtgcctctgtgttgagcatcatcatcttaagataatctcctcattctgtcattaaggcatttcataaattgtcggtaagagactttgccaatatcctcatttgtgtttattgatagtgacgctactgttgaccttcagcttcaaacagggtttatgggacagtctccatcatgactccagataaacctattcagcaactccttggcctgggtcttggtgctgagctctgcacttcagatctgtttttggagggacaaaagatttttttaaatgtatgttagagaaaaatcactacaaagtgatggattgctgaagaaacatagttttatttaacttcattgtatttggaagaaaaatctgtccattccatttacttgagacatttaaaattttgtttaaggaaagtgtattttcaggatgcatgcaaattgttcccctttttatgggaaatgtgcactgattgtatgtgcagacattttggtaccttatgattcatttccagtaaaattaatagcctttaatgccgtggcatatgtttatggaggtatttcaagcaattcttcttatatacaatggaagctggaagttctgtttttgtttaaatatttaaaaatagccaaataatttttctgtgatctctgttctccttgaaagtaagactgtggttgaatgcactggtgtttaacgaggtgcctgtgctgtttttaccgtcatggcagagacgttttcagtgtgataatagaagattcctcagctgggcacattgccgtttggcataaggagaaagagggttattttctctggatgctcagactgatagaaatgaagaatatcttgtatttccaaatccttttttctccaaagagcttaagacaaagcattttatacttttctcatggagcatggatttaagtttgttctatgatgatttcttcatttctccttctttactttgaagcattacacaaaagattagctgagaaggtacatagaagtttatcagaatatagtttgacatagtttttcataaccaaatgagtgtgacactttgacattagaattgtctgatgtagaaccccgtctcttaaggaataaagaggaaaatagaaaaagtgatcttggccgggtgtggtggctcacgcctgtaatcccagcactttcagaggccgaggcgggcggatcacgaggtcaggagatggagaccatcctggctaacatgtagaaaccccgtctctactaaaaatacaaaaaattagccgggcgtggcagcaggtgcccgtagtctcagctactcgggaggctgaggcaggagaatggcgtgaacccgggaagcagaggttgcagtgagccgagatcgcaccactgcactccagcctgggcaatagagtgagactccatctcaaaaaaaaaaaaaaaagaaaaagaaaaagaaaaagtgatctcttatgatgttcatgctttagcattcacacacattcacacttgcccaattttaaggaaggctttagagccagtaagtgtttagtccaatctcctccctaattccagggtagttcagtgatttttaatgtttgtaatgaccctaagtcacctcaggatctttggtgatcaaataaggattaaaaagtttaacccactgggtatggtggctcacacctgtaatcctagcactttgggaggccaaggcaggtggatggcttgagcccaggatttcgagaccagcctggggaacatggggaaattctgaatctataaaaaatataaaaattagctgggtgcagtggtgcatgtctgtcatcccagctacttgggaagctgagatgggaagatcatctgagcccagggaggttgaggctgcagtgagttgtgagagtaccactgcactccagccagggtgacagattaagaccctctctcagggaaaaaaaaattcatccgcactcattagcaggaaagtgagagaatttacttgggagtgattttgataataagggttgcatagtttttggttaatcttctatcaaataatgtcataaggaaatatattttggtaagtgcagtagtagtagtaatagtagtaattattacagcaataataaccatggaaaccacaagtcatattgtgtccattatttaccatgtaccagttactgttcttagcacttatatcagctcatataatgctcctacccctgtgagacaggcaccgttagcctcagttcatagtacagaaacctcaggtacagagatatagcggaattcaatgtttccaagctggtaaggggctgagctcgggttcagactccagccttctggcttcaaagcctctgctcttcctaattaagtgataattatggatgtggaatattttatatgagtgtaagtacagtattttatatggagaccagaatatatacttttaaaaatgaattaaatactttaaaaaaagaatttgaatgtgtattggtttttcatatatgtttggtatttaaatgactgtggttataaataaaattgtatgtgagacacttttaaaacctttaccatgttttagcagatttctttctttcttttttttaaatggagtctcactctgttgcccaagttggtgtgcagtggcatgatcttggctcactgcaacctccccctcccgggttcaagcgattctcctgcctcagcctcccaagtagctgggattacaggtgcgggccaccgtgaccagctaatttttgtatttttagtagagacgtggtttcgccatgttgatcaggctggtctcaaactcctgacctcaggtgatccgtctaccttggcctcccaaagtgctgggattacaggcatgaaccactgcgcctggccaatattttagcagattttgacaagtatataaactgtggtttcaccaacatgacatttgcacagttaaataaaagtttgagtggtatgagatttaaatacataagcttccgtaagcagtaaaagtaagagccacttgcttgtgtggcatataaatagtggttagaggcagacagccattgtggttaaaccttgccaaatgtgaaatgatgctacatttcatttatcccatggtaaaaaaaagaatcatctttgtaaaataagccataggtaaataatgtctaatcatgtttaaaggatctgtaaaggaacatgatacccagaatgtaaatttgcacatagaagtcagcaagagtgtaaaagaagaatctgatattttttaaaaagtacataacttgacattggtctaaccatttaatgcaacacaatgaatctctttgtgggtttcttctatgtaatctatcagattaaaattctttgcccagagaatgggagaaaaagtatgacagttaaatatttgttggactttagcctctggaaatctgatcagaaaaaaaatacatagttaaatgtgctacttattataagggcaggtaataaaaggatttgttagaattcacatttattacagatactaactttaaggattagatatttggtatcatgtttagtctttccgctgtgcttgatgacctaatccctaaaaaagactttttaaaaatgttcgaggtcaggagtttgagaccagcctgacaacatggtgaaaccctgtctctactaaaaatacaaaaaaattagccgggagtagtggtggatgcctgtaatcccagctactcaggaggctgaggcaggagaattgcttgaacccgggaggcggaggttgcagtgagccgagatcgcgccactacactccagcctgggcaacagagcgagactccgtctcaaaaaaaaaaaaagttataaaaatgtgtaataacgacaggaaaagaagtattcatcattcagctgctcttatatgggagtacataacgtaatacctgtaagtgttcttacgggaagcagtaattgccaataaaaggctgcttcttactatgttgaggaatctgggagaacaagagtggcacacttcaggtattgcctgccactgtattattggctgctatgaaaaggaaaaagagattacatattttatctttgatctttgctgcagttttatttattgcagatattcatttttagattgaaaactatgttttattgtaattagtagatatttcagtgcttgcagagtgacagactgaatgataatttgtgttatagaagacatgttttgtattggtgttaattgttccagttgtagttggcaagggtgtgttttggttgatttggacagttatatttgtcttttgaccaaagacataaaataatgtctgaaacactaaatatcttataataaaacaatttaaatttgttttggggatacataataaacatttggtactttgtaacttttaacatctgcttttaatagaatacattcctattgcaagccttaaaaatgtatttacatagaaaaccacatcaaaattcaaaactataattagacaagcataggttttgtggaatctggatttgtttaagatgttgaaagatttattttttttttgaagatgctattcctataactatttgtagagcatacccaatcaattcaaggaatgcaataatattaacctctgcttttaaattttcttttagccagtaagattgtttttatacttctaagtaaatggctaaaaataaaaaaaaaaacacgaatacaccagcataatataaaggaaatgtaatgaagctaattatccttcaccttgctagattatatattagggaaattatatttaggtaatcgtgctttggaattgcatacaatttaatcatagtgtagatagttaattcttttggattttatatttatataccacggtattaagattctgggctgggcgcagtggctcacgcctgtaatcccagcactttgggaggcctaggtgggcggatcacaaggtcaagagatcgagaccatcctggccaacatggtgaaaccccatctctactaaaaatacaaaaattagctgggcgtgatggcatgcgcctgtagtcccagatactcaggaggctgatgcaggaggattgcttgaacccaggaggtggatgttgcagtgagtcaagattgcaccattgcactccagcctggcgacagagcgagactctgtctcaaaaaaaaaaaaaaaaaaaaaaaaaagattctgttggactaaatgtacaagaaaggggtattaatttttaatggctagaatgttctgtgtataattcataggaattgaagaaagattatagaatagagtataagtgctctttggaatgccagacgcagtggcatgtacctgtagacccacctacaaggtgggctgttgtgggctgtagtgtgctgtgattttgcctgtgatacccactgccctccagcctaggcaacatagtgagaccccatctcatctctaaaaaaaaaaaaattttatttctatctggagcagatgatgggagagtgttttctcagcacagccaatttagagtggagccactattgcggagagccctctttagtttcactggaaaaactaaacagtgaacactttcactgttgcccccttttttgatccgatgacagcacagttgatccatttcagcagggactgcagcagaggaaatgagctaaaataccagaaagggcacagaggttctctggagggctaatttattgtggaacaacccaagagagacagttttgagtaattcaagtgactatacttgaattatccttcaggttccatgctatatactaaagatagtgcaaactgtgggtggtcagaagtagaacagagtatataggctggacttgggataaaggctgtgtggaggagatatgatttgaaatgggccttgaagaatttatttggtttaaatatgtagagaggattaagggatgatttttgagaatagcaccacaagcaaaggtttccgtgcagctcatttagcagacctggcttgcgtgcttctgtctgggagttttaggaatgtgaatgtagatcatttatattcatttctcttagctgaatgtgtttccttctcatccttctacccagcctcgggtttgtcatactagaaataagtgtgaggactgaatttagattaattggacctgaagcttattttggtgtcacggtatgaaacagcaggatgtatccttctttaccatggacagcaacaggatttgggatgatctcagggcaaaggaggattttattcgtcatttgacctacatagtcacaattatgataggtcctaccttttgtctaccagaagggatgctggtgatgacactagtcagattattcacaaccaaacttcgtgtgacctaaaccgaaaaagagttcctgttatttgagggcataagtttaagatttagaaaaaaaataataaagttcttatttgtgtctttagtttctttaatttaaaactttttataaatggaaaataaactgtttcttttttaaagccataaccatttgcaaaatggaggttttaaaattttttgtatttatttttttttgagacggggtctcactctgtctcccaggctggagtactgtggtatgatcatggctcactgcagcctcgacttccctggctcgagcaatcctctcacctcagcctcccacgtagctgggactctaggtgtgggccaccgagcctggctaactttttaatttttattttgtagggacggggagtcgccatgttgcccatgctggtcttgtactcctgggctcaggcaatcttcctgcctccgcttcccaaagtgctgggattagaagcgtgagccaccatgcccagacaacgaaatggaagatgtttagtatttcacctttagtttttgttaatttatgaatctttaaaattactttgggacctgaaactgtctgaagtattactttagcaagctgtctggaggagagtcttctcgagatagtgaggaacttggtgaatcctctccccagtaaaacaacaacttaactggtgagaattataacaaaaaattgtgtaaaatctctgaaaattgtcctaagggcacacaggaaacggagaaacagtcattcaagaaaatctcctaaaactcataacagcaagagtctctgacagttgagccacaacccactctgttaccagccacccccagctctgctctactctagacatgtgtggccaagaagaccatagttctctgtctttctctacaactatgtctatggctatgattttggtctgggagaggcaggatgctggcatttctaatttcttcagtctcctgttagagaagctttataacaggcaagcatggagaaccacgggagacctttgagaagggccctttaaggatcaccatcatcgatggaagtagggagggtgtgaatacacacctgccaggctgcagccatccaagcaagagcaatcagagcaagatgtggtgtccccaggaaagcattcgctaacctcatacagacccaccaaaaccaagcggaagcttcactggcatgagtctgtgtttgtgtgtgtgtgtgtgtgtgtgtgtgtgttattaatcccattttatttatttattttcttttattatactttaagttctgggatacatgtgcagaacatgcaggtttgttacataggtatacacgtgccatggtggtttgctgcacccatcaacccgtcatctacatgaggtatttctcctaatgctatccctcctccagcccccccaccccacgacaggccccggtgtgtgatgttctgctccatgtgtccatgtgttctcattgttcaactctcacttatgagtgagaacatgcagtatttggttttctgtttgtgtgttagtttgctgagaatgatggtttccagcttcatccatgtctctgcaaaggacacgaactcatccttttttatggctgcattgtattccatggtgtatatgtgccacattttctttatccagcctatcattgatgggcattttgggtggttccaagtctttgctattgtgaatagtgctgcaataaacatatgtgtgcatgcgtctttatagtagaatgatttataatcctttgagtatatacccagtaatgggattgctgggtcaaatggtatttctggttctagatccttgaggaatcaccacactgtcttccacaatggttgaactaatttacactcccaccaacagtgtaaaagtgttcctatttctccacatcctctccagcatctgttatttcccaactttttaatgatcgccattctgactggcatgagatggtatctcattgtgtttttgatttgcatttctctaatgaccagtgatgatgagctttttttcatatgtttattggccacataaatgtcttcttttgagaagtgtctgttcatatcctttgcccactttttgatgggattgtttgtttgttttttttcttgtaaatttgtttaagttctttgtagattctggtagattctggatattagcccttttgtcagatggatagattgcaaaaattttctcccattctgtcggttgcctgttcactctgatgatagtttgttttgctgtgcagatgctctttaattagatcccgtttgtcaattttggcttttgttgccattgcttttggtgttttaatcatgaagactttgcccatgcctatgtcctgaatggtattgcctaggttttcttctagggacttttttttttttttttttaatgaagtcttgctctgtcacccaggttggagtgcagtggcgcaatctcagctcactacaagctctgcctcctgggttcaagcaattctcctgcctcaacttcccaagtagctgggattataggtgcccaccaacacacccagctaattttttttttttttttgtatttttagtagagatggggtttcactatgatggccaggctggtctcgaactcctggcctcaagtcacccacctgcctcggcaggttttaggtcttgtgtttaagtctttaatccatcttgagttaattttcatataggatgtaaggaaaggggttcagtttcagttttctgcatatggctgccagttttcccaacaccatttattaaatagggactcctttccccattgcttgtttttgtcaggtttgtcaaaggtcagatggttgtagatgtgtaacattatttctgaggcctctgctctgttccattggtctatatatctgttttggtaccagtaccatgctgttttggttactgtagccttgtagtagagtttgaagtcaggtggtgtgatgcttccagctttgttctttttgcttaggatgacttggctatatgggctcttttatggttctatatgaaatttaaagtagttttttttttaaattctgtgaaggaagtcaatggtagcttgatgggggtagcattgaacctataaattactttgtgcactatggccattttcacaatattgattcttcctatccatgagcatggaatgtttttccatttgtttgtgacctctcttgtttccttgagcagtggtttgcagttctccttgaagaggttcttcacatcccttgtaagttttattcctaggtattttattctctttgtagcaattgtgaatgggagttcactcatgatttggctctctgtttgtctattattggtgtataggaatgtttgtgatttttgcacattgattttgtatcctgagactttgctgaagttgcttatcagcttaaggagatttggggctgagacgatgggattttctaaatatacaatcatgtcatctgcaaacggagacaatttgacttcctatttgaataccctttatttctttcttttgcctgattgccctggccagaacttttaatactgtgttgaataggagtggtgagagagggcatccttgtcttgtgccagttttcaaaaggaatgcttccatcttctgcccattcagtatgatattggctgtgggtttgtcataaatagcttttattattttgagatacattccatcaatacctagtttattgagagcttttagcataaagcggtgctgaattttattgaaggccttttctgcatctgttgagataatcatctggttttttgcactggttctgtttatgtgatgggttacgtttttgatttatgtatgttgaaccagccttgcatcccagggattaagcaaatttgatcatggtggataagctttttgatttgctgctggattcggtttgccattattttattgaggattttcgcatcgatgttcattagggatattggcctgaaatttttttgttttgttttgtctctgccaggttttggtatcaggatgatgctggcctcacaaaatgagttagggcagagtccctctttttctactgtttggaaccgtttcggaaggaatggtaccagctggtctttgtacctctggtaaaattcggctgtgaatctgtctagtcctgggctttttttggttggtaggctagcaattactgcctcgttttcagaacttgttattggtttattcagggatatgacttcttccttgtttggacttgagagggtgtatgtgtccaagaatttatccatttcttctagattttctagtttatttgggtagaggtgtttatagtattctctgatggtagtttgtatttctgtgggatcagtggtgatatcccctttatcattttttattgtgtctatttgtttcttatctcttttcttctttattagtctggctagtggtctattttgttaatcttttaaaaaacaccagctcctggattcgttgatttttttgaagggctttccatgtctctatctccttcagttctgctctgatcttagttatttcttatcttctgctagcttttgggtttgttggctcttgcttctctagttcttttaattttgatgttagagtgttgattttagatctttcctgctttctcctgtagacatttagtgctataaatttccctcttaattactgctttagctgtgtcccagagattctggtacgttgtatctttgttctcattggtttcaaagaacttatttatttctggcttgatttcgttatttacccagtagtcgttcaggagcaggttgttcagtttctatgtagttatgtggctttgactgagattcttaatcctgagttgtaatttgattgtactgtggtctgagagactgtttgttatgatttccattcttttgcatttgctgaggagtgttttacttccagttatgtgttcaattttagaataagtgcgatgtggtgctgagaagaatgtatattctgttgatttggggtggagagttctgtagatgtctattaggtccacttggtcctaataggaccaaagatttcaagttctgaatatccttgttaattttctgtctcgttgatctgtcaaatgttgacagtggggtgttaaaatctcccactattattgtgtgggagtctaagtcttggcatgagtcttaaacatactcttactgaaacaccaggggttcagtctagttcgtgctgctcgccgcacagaaagccaatcactgagatgacaagtattgccaaggaagaaggctttaatcatttgctgcagccaaggagatgggagctcagtctcaaatccatctccctggctgactaaaattagaggtctatatagtgggggagaaatgtagcaatgtgtaagaaaacaagaactagcatgcagcaaggagtcaatcatggtgaatgaggggtctggtgtggtgagctggtgagttttagttctttgatacttatttagaggcctgaaggtgctttttggaggaaggaactcagataaaacaaatataagtttcaagcattaagaccaaatgatcaatttctatgttcatcaaaaagatctgtctatgggactattgggtcagtttcaatacctctgttaaaacactgagcaaacaataagctattctgacacaggggcaattcctaagaaacgaggcttaaaaataatattgcagtcatctctggcagtctgaaagctgtgtacatacccaaggctgtaccctcacaggagcaactggagagggaaaagcccagtggctagtttccagatgaacatggtagaaaaaattggtaaattccctgaatgtgatagcagactccaaggcacccctcagccccagtggttaagggtaaaaccctaagggcccaggggccttaagaataatctttcactgataaatggctcatgcccattcaggggtgacccataggtagccaggctgaaagattaaaaacgtgaaggaaaaatgtgtgcaggaatgtcaggctgctcactgagccagaaacagatttcactgaatgagcctagtgaagtaaccaagtaaataaataggcaaaccagaaacacaagaagctctggggcagggaagggaaaaatcaatatctggaattgataaaatataatgcgtgaaatgtctagttttcaacaacaaattcaagtcatgtaaagaacaggaaagagtggcctatacacaggaaaacaaacaggcaacagaaacattattcaaaaggacccagatgttagacttaacaaagaactcaacgcacccattaaaaatatcttcaaagaactccaggcaactatttgtaagaaatcaaagaaggtatggggacactgtcaagtagggaatatcaataaatagattgacattataaaataattctagagttaaaagtacaataaccaaaatgggaaaaaattactagatgatttaacgatcgattagtggtgacagaagaaaataatcagcagacttgaacatagatcaatagagatggcacaatctgaagaacatacacagaaaagaatgaaaaaaactgacagcctcagaaaaatgggggtacaccactaagggaccagtgtatgtgaactatatccaaaggagaggagagagaaaaggggcagaaaaataattgaatgtatgtggctgaaaacttctcaactttatgaaaaacattaatacacacatccaagaagttcaatgaattcctcatagataaacataaagagatccacaccccctatatcatagtcaaattgttgaaagctaacaattaaaaagtatgaatgcagtgaaagaaaaacaacacatctcatacaagggaaccccaataatactaacagcagacttatcagaattaatgaagaccagaaggcagtaggatgacattcaaagtactgaaagcgaaatgttcaaccagtcatcttacatccagtgagagtttttctaaaatggagacaaaagacagacatttccagataaacaaaaactgagagaatttgttgctaaaagacctggctttcaagaaacagtaaagaaagttcaagttgaacgaaaatgatatggtaatttgagatcacatatacaaaaacaaggagcactggtaaacattttttatctgcacaaaacatagtataattacatagttctcttaagtgatagtttgtggctgcagtgagctatgatcgtgccactgtactcctgcctgggtggtagaatgagaccttgtctctaaaaaagaaaaaagacaaaagtccgtgaacatctcaatagctgtagaatccgcagttaccaaatcgtatacactttagtgacacacacacacacacacacacacatacacacacacacacaaatgggactagaagggaacttcctcagcctgatagcatctgtgaaaaacccagggctcacattgaagactggatgtttttcaggaaaaagacaaggatgttcattcttgttacttctgtttagcaatgtgctagaagttctagtcaaggcaattaggcaagggaaagaaataaatggtctcctgattggaatggaagcagcaaaacattttgcagatgacatgatcttgtatgtaagaagtcctaaggaattcattagaagaaactattagacgtaacaaggaatctaattgtatttctagacattagcaattatcattgtgaaaatgtaattaggaaaacaactccctttgcagtattattaaaaagaataagatactgaagtatggattttaaaaaagaattttacactgaatctagaaagcattgttgaaagaagttaaggaggatctaaataaagggaacatgccatggttatggatgggaagacttgatattgttaagatgatgatacttgccaagttgtcctacagattcaacacagtgtctagcaacatcccaaccatttctccaaactcatttttttttagcaaaatagacaagctaatttaaaaattcacgtgaaaaatgaaggatctcagaatagccaaaacaatctagcaaaagaacaaagttggaagcctcctgatttcaaaagttattacaaaactatagtaattaagacaatatagtactggcatactaatacacatattggtcaatggaatatatttgagagtccagaaatcagttcttacatttatggtctgttgatttttgacaatggtactaagacatttcaagggtgaaagaatggtcttttcaacaaatggtgttgggacaactgtatatccacatgcaaaagaatgagattaggcaatggtttcttagatctatgactctaaaagcacatatgacaaaagaaaaaatagattattctacatcaaagttaacaattttgaatctacaaacaataccatcaaaaaacttaaaaagacaaccaacccacaaaatgggaggaaatgtttgcaagtcacaaatctgataagtggttaacatcctgaatatctaaataactcctacaactcaataacaacaataattttaaaaaaatctaatttcaaaatgggcaaggccgagcgcagtgactcacacctgtaatcccagcactttgggaggccgaggcgggtggatcacctgaggtcgggagtttgagaccagcctgaccaacatggagaaaccccatctctactaaaaatacaaaattagctaggtgtggtggcacatgcctataatcccagctactcgggagtctgaagcaggagaatcgcttgaacccaggaggcagaggttgtggtgagccgagactgtgccattgcactccagcctgggcaacaagagtgaaactctgtctcaaaaaaaaaaaaaaaaaaaaaaaaaaaaagaaaaagaaaaagaaaaagaaagaaaaaaaatgggcaaaaggtttcagtagggatttctccagaaaagtataccactctcaaataagcacataaaaggatactattcaacactattagcattagggaaatgaaaatcaaaaccacaatgcaacaccacctcacatgtgcaaggatggctataatcaaagagaaaggccatagctagcatgataaggatgcggagaaactggaaccctcatacaccgctggtggaaatgaaaaaaggtgcagccatttgaatttcaataagaatttcaagtcttagcctatttatgcaagtatttgctagtaagtattttttatgagaaggtaaataattttgctggtagcacttgttacccatagaatgatcatgatatcagactataattttctggataaataatatatttttcaacctcaaaaaaccttaagataaacttttttttccctaaaaataaatggtcaaaagtttaagctgtttttaacttaaagcataatatagttttataggcaagagttcattaatctcagaaggagaaatttataacttttttctttgcttttgatgaagagactaaagatatatggactgtgatttttctcttgaggagtctgggctctgggaatataattaaaacccctttggaaaatcctttctggccttctgggggattctggtgactttcggacacagtcaccagaatcccccagagacagatttgctgtgtttatgaagattacctccactgttgttttaatatttgacagtaaactggttttattgcctattttcataaaagttttgaagactctttcttccatcaagtcttcatggaggaaggaggattgaaagcaaaatctaaagacttctgtgtttttaacttacacgttgaacagacctatgtggaaatagagatttgcattattgaacctaaatttgaatgcacaaattaaaattagcccataccccaccattcttccccctcttcctcaccttatccatctccctccctctctctttctttcacgtgctgtgatgtttgatcttctcttggtaatcaacataccttaccctttatgctcatatacagagtgaagatcaaaaagtattgatttattggtgacagttaatgatgcctccctagaagagtcaggacttaatatgctgctatgatagtaccaatgtactgtttataaaaaatgactatgtttggtggttctgtggaattgtttcatgtgatgatgcgccaggtttaaaagtgaatgaaatgtctgtgctatccttccatagctgactttttttttatttttatttttttaagagacagagtctcagactggagtgccagtggcatgatctcagctcactgcagcctctgcctccccggttccagcgattctcctgcctcagcctcctgggtagctgggattacaggcatgcaccaccatgcccagctaatttttgtattttagtagagacagggtttcaccatgttggtcaggctggtctcgaactgctgacctcaggtaatccactcacctcagcctcccaaagtgctaggattacaggtatgagccaccgtgcccagcagaaaagtatctttgaaatatcaagttttagtaaacacattttaagaaactgtagtataaaccttgctaaccaaaaatttatagaagagaggccggcgcagtggttcatgcctataatcccagccttttgggaggctgaggtggcaggatcacttgaacccagaagtttgagaccagcctgggaaacacaatgagaccacgtctctacaaaaaaatacaaaaattagttgggcatggtggcatgtgcctgtagccccacctactcccagctgcttgagaggctgaggcaggaggatcgcttaagcccaggaggtcaaggctgcagtgagccgagatcaagccactgcactccagcctgggcaagagagtcagaccctgtctgaaaaacaacaacaacaacaaaaaaactaacccaatagcttatagaaaagaaagagaatagtgtaaatgaagttaaaatgagagcaggaagagctgacgtcccctaaagctttgatgccacctaaagtatttctgttttttcctattttttctcagagagccataaaaaaattttgttttgaggtgtgtattagtaggaatgtaggcaaggcttttctttaattgatccatgtgttaatctttatgtatagttctgtgtatttttctatatggattgtaatgttgccattaaaactttttacaaaacatgtataggtcactctttaaatttccttagctgtaaatatagtacagaatgactccttttctcttttaatactctcctgtataatgttgttggtgtttttacttgcagctccttttactaacattttgtgtacttaattacccctgtaagtaaagcttttcataattaggatggaattttgcctgcttttttctagtgccaacaaaagaaactagcatgttcttcatgctagaagctagaatctgagttgaaatccacttgcagctgagtgctttttaaatgatcagcttttcttcaatggcctagatcggcacaaggctccatagaaattggctttgagttggtctccatcctttgaactggcaaggaaagacacagtaacttgttttgttttgaaagctagattgcagtattcccccagtgatgccagactgacttggctgttgtgttgtaagtaaaaactttcctattccagtaatgccagccttcttctcaatactgccacacacgaagcaggtagacacacagctattccaaaaacaagaaaacaaaacaaaaaactctctaatttgaccatctctttgcgttccacattaagccttccaaaaaataaaacaatacaaacttgccaaatataagaccaaaacaaagctttttctttttaaaatgattgaaaatgtatttcgctatgtttctaccaatgtgaacaaagcttgactgtattaaaaaatctgatcattataaaatgcagatgaagaagatcaaatggcaaggtggtttcagtttattctgaatattttagtgacagaaagttgaacaggaaggaaacaggtgttagtgtaaaatacacagtttaaaagcaaattataccatcggctaaattagaatcatttatttaactaggaggaaaagcacagcttctgaatagtgatttgaaggcatagaaatttgagggcctgaggtgtttaatctggcatgatttgtgaggggcttgtagtaggtacagtggtgacttgaaataataattaggtttgaactgattcagtagttttgcattttcaaacttggatttagtttgcgagattttttctacccaaacagcataaagagcttatgtaaggcaagcttctttgggtttatgttatttaataaatgtcttcaagcactagaaatagtggttttgaagaagtcctcttgtcacatctatccggtcttatcatcctctgagtttatcccttttaaaaatccctctgttctccaaagcgtttgtaggcacttcttgaattcattgatcctcattgcttggtttccttcctggtaacatcttccatatgttttcttcactttttcagataagagtattacttatattctctaccatgagcatcttaacatttatgttgttgaatctcttccatttgctcattctttttctttttcttttttaattttttttgagatggagtcttgctctgtcaccaggctggagtgcaatgatgcgatctcagctcactgcaacctccgcctcctgggttcaagggattctcctgcctcagcctcccaagtagctggaactacaggcaccaggcacacaccaaccaccaggcccagctaatctttttttttttttttttttttaagtagagacagggtttcacaatgttggccaggatggtctcgatctcctgacctcgtgatccacccacattggcctcccaaagtgctggcattacaggcgtgagccactgcactcagcctctttttcttaatttgaaattatgcaacactatggagttgaaaacctacttaaaaatatctttttcatacacgtatactttaacaaatccagaccatgtcagcttctgatgtttctaacaggaaagaatacatccctcttaactacacttaacattttagattgttcaagaatctctactcttttctgtattcatgttgagatacaattagcatctcatgtatggcaaccaggattgcatgcaaaattctagaaagaatctataacatatgactcataccaaacagtaatttgtttgttttcagtttgccctctttttttcttaatccaacttaataagtcatgtttgccattcttgaggttactaatatggtttcacagatttcagtaccctgttttaataaccacggcattccttccttataatagtctactatacattttttttccccgctaggccacccaggactttgttgaatctgtcacatccttactgtttttcttactcatcttactgtggccttgctgttttgctcagatatttattttatcttttctgtgtgtttactcacatcaacatcgtagttttaaaatgtaagctgttgtaaatttctagtggtttattgttgcccacgcttttaaaaaattcattcattcactgtaacagccacttaataaattcagattattagaaaactactgtgtatgatggccgggcttggtggctcactcctgtaatcccagcactttgggaggccaaggcaggtggatcacctgagctcaggagttcaataccagcctgaccaacatggtgaaaccccgtctttactaaaaagacaaaaattatccgggcttggtggcgggcacctgtaatcccagctactcaggaggctgaggcaggagaatcgctcaaaccctggaggtgaacagaagttgcagtgagccgagatcgcaccactgcactccagcctgggtgacagagcgagacttcatctcaaaaaagaaaaaaaaaaaaaaagactgtgtatgggtctatcttccttttaaatttctttctcaaagcatgtaaaaccatctctcttgctaagactattctactgagttttaaatttaattccacagaagtcatctagaggaagtgacatactattgttctgaagactcatgctgagtttaagagaaaaattcacatttgaaagatgttgcttattctgaaaaactcaatatataaatcttacaaagaataggaccacctcattaattaattagtaggaccttacaaagaataggaccacttcattaattaattagtaggaccttacaaagaataggaccacctcattaattcattagggataaaaccagcctatgatattcctcctctttctgtatgcgcataaaaagaactagaagcaagaggcaggcggactcacacattgcacattggccccctccctccttaacaagcaaaatagcccattttagtgatccagaaaccctggaaatggattctttacaactattgacgatacccactggcaatgatggtctatatttcatagttactttaaagtcccaggcagatgtgattcagcctttcagatggatgaaagggatgttggaaggatagaatttttgcagggcatgaattcattatttcttggatctttttaactgataaggtattttaaactcatagacagccgtgagtttaaattcattcctttccatctattccagtcagacttcccttgagctcatagtgccagctggtttttctagggggacaaagcggaaaagaaaaagaggcagaaaaaattcgaagaaattattgaatttttttgcattaacaacctcctcaggtgacactcatcccccctaccctcgccatgattcttaccttcttcccgatgacccctgaaaagaggagaaaaaggtgagaagggccaaagaaattttacacaatgggcagaacttctgtcggagaagatatcaagggtgtagagatcttccagaaaagggaaaacccattgtagaagaaagggaaacaggccttggaagggtgagtgcacctgagcattgtatgtgaagatgctgatttgtctctttagcccaaatccagtctgagtttgcatgtctgtatcttttccaccacaaagagacatatatcttgcttgccataattgtgatgttggacaataaccacatgatttctgctttaggagatgtgtaaaaaactttctgtcatcaccaccaacccccccactacaaatgtgtgtatcagcctccccacagattagctataattagaaaaccatgttgaatcacgttgagtcagatgaggataacttcctgtattccctgtatccctgaggaaactaaggtttattctcttcatgacaagctagtttccttactttatttctccagttatgttttagcaaagcaattatataaaaatatttttttcatatacttataaacttttaaaaatcctggccatgtcagcttctaatgtttgtaagaggaatgagtacatccctcttaactacacttacaatttcagattgttcaaggatctgtattcttttctgtattccatgttgagctacaattagcatcctgtgtatggcaaccagtattgcatgcaaaattcttcaaagaatctataacacatgactcatactaaagagtaatttggtatttatacaaactaaaattattctctttcctgcctctactttagttttttggcttctaattcaaaaatgagaaagggggaaaagatgaagtctaagatattgcgataaatcaagagtgacttctttctgtccagggtatcctcatatacaagttgagaaagagtgcatggacgtcatctttgcacgattaaatagaaagacttctaagccaagatatcagtctatggtgaagttaatattgctatgatattcatttgcttttcattttaaacgctccttttatttggatcagattttgatttttaaataatttaattaattttttgttttttttttcagagatgagggtctctctctgttttccaggctggagtgcagtggtgtgatcatcgctcacgacagcttcaaactcctgggcttaggtgattcttctgcctcagcctcccaagtatctgggattataggtgcatgacaccatgcctggctaattaaaaattttttattattttttttagaaatgggttctcactatgttgcccaggctggtttcaaaatcctgggctcaagtgatccacccacctcggcctcccaagttgctggcattacaggcatgagccactgtgtccagaccccagattagttagttgtgtaatcttgcatcagtgaagggcataaacctcaagcttttcctgtcttctggtgaagtcaaccagtacctttgagaataaggagccatctcccctcttcttcctctgccccatatcaaagttggcctggcagaaaaaaatcccacccagaatgtctggtaatgtattcattagtcactcctgatcattcagatgtttcttttttaagtttctagttttttaatatcttaggttattcatgtctattgtatcatgtgtgagggtttcttcttccccaggagagtgtttttggtgtggaattaccttgtacccgtttggagatagacacaaaggaggtgggtgtgtgattcatgcttgagcaaatttactccatgcatgatctgcggtgaaagttgaagcctaggattctgctgatcattatggcgttttttgcatgacttcagctctttgcactcattcagttctattggtagaaaggtgatttcctttcaggtgtgacctgaaaatggaattttttctcatctccctagcaccatccatactgttcagaatggaagcttttagctttagtgactctcactctcgccatgcctttaactacatacttcaggcccctaatacagtgggacaccccatggtatttcctcgtcgccagcattaaagattatgtgttccagaatcattagactttttgaaaagacccctgtgttagttttgcactgttataaagaaatacctgggactgggtattttacaaagaaaagaggtttatttggctcatggttctgtagaccacacaagcaaggcacccacatctgctcagcttctgaggaggcctcatcaccttctgccatgaaggttttactcacggcagaaggtgaagaggggagcagggatgtcacatggtgagagaggaagcaagagaaagaggaggaagtgccagcctctttttaacaatcacatctcgtgggaactaatagagtgataactcactcattcccatgaggagggcacaaagccattcatgagcgatcctctcccatgacccagtcacctctcgctaggactcacctttaacagtggagaatcacatttcagtgtgagatttggaggggacaaacatccaaactatatcagccatataaaaattaaactcttccagggatttctttcagggattttgttttcctttttgctactttgggtttaactttttatggaagtgcctttacaaagttaagtgacttattctttatgtcttcagcaaagtcaatattgcttccactaatggtagctaaggacaggaaggatgtgagtttttgttgttgtttttcacatagctgggaatagtcatggagtaggctaggatttggatcttagtttcttaagccacatttctacctcttatctcatgaaacaaaacaatgatttaaagactgggctaacagttctgtctttctaagagtttgtttgattgctgactgtccctgttgatggttcttgtgcggataattaacaggtatagtcggataagttgccaccaacttagaaaacagtcagggatctttttttaagagctgcttacagttgttcaagtcagccttgactcagctctgcataccagctgctggtgaccccagcttgcccctttgcacagaccatgtgattttaagtgtcaaggtcttgtccgttatcagtttcctaccctgtagaactgctgttatgcattttgtttactgatatgcattttcagtatctttcccttctctggatttttcgaaatagactaattaaataccgcagctggtctttttatcttgggatggaatcacttacagaatgggacacgtcttcctctcagattgagtcatggtgtggtgacagaagggaatttcattggagcattaagataatcagagactccatgtggcattaattcactccattactgtttattgaagaataactgtgtgccaagcactgggcttagtactttatcttgggaggggtgggcagggtagggggcaaattgcagaataagactgggctttgagagagattggagttgagttatacatgcagaattctagaggatacttgagtttctttgcctacttgctgccttaaatttaagagaattacactaggcttgggaaaacaaactttcataatcccaaatagcatctgattctaaaattgcttttatttgacttctcaatgagtcttttaaaagatgatttccttcctcagggttttgatctggctgtgtttgtttctatgaacacattgtctacagattctaggcattaagcagaatgaactagctggaaaaatccaacccagaaataaacattcacctgtagtcatttccagcaaatgcttgtatacttatcgaaaattcaaatttacttttaactaaatacctttatgcagctgactgtagtgctttggggaagataatggtgttaaaataaggtaatgatgattgagaagaaaggactgattcgaggaacatttaggagttagaatgacatcatttagctatctattagatattcaatagagatatttatgaaaacttgaaatatgtttaacattgtgtatccttataaccactgcttctgaatgttcagccagtgatcttgggtaaagacattaaaacttatttggtgaatacctaacagtgtatctcttcatcatgtgtatgtatctgtagatgtggtattagaaaccactgacacatataatgacttttcaagatatttaactagtttataggctcctgcgtgacttatttaatcttgtgattttgttctgaggtagctaataattttatcataacaagataaatttttaagaaaattattggaaagtatgaagtttttatttgttcatttcattagttgctctgctagagttacaaacaagtacaattacgttggaaatctacttcatagtaaatactcaggttcaaatacatttaccctaggacccagtagtcataggagtagcattacttgaaaaaccctaaactgcaaaccttctaaatatctatcaatattagatacacggtggaatagtaacaatgaaaaatagcaatctgttatactcaacaacaatatggattttacaggcaaaagccattataaacaaagtgtttccatttatgatgctcaagaacaggcagaagttatctgtgacgatagaagttagaaggagacttttgtgtgggggagtattgaaggaggtataaatggagccttcaggagtgctgataatgtcctatacaatgatctgagtgatagttacaatgatgcatttgtaagcaataattaaatgaactctatacttgagtttcgttcactttactatagaataacaatattttaaaaactaaaatttcttaatagtggccactttagaaaaactttttattgaacagcaaaacgctaatttgagactctgggacaatagagttgaagatgtcttcagggataggaataatgaatgatttggctattgttggacgaggatgtgatagaattgtttgacacaatatgataaatttcttcaaatggatttgttaaagaaaggaaaaatgctaaatatatgatctctgaaaatgatgccatcagaaagaagactatttggtctgtaaaggcttaaaatcacatgttgaaatttttattctctgaaaatgagcatcataaattaactcactgacatgccactgtttatctctctttaacttccaaactctaggaggtctttgaagaatcagccacttgcttattcagtatgtcatttctaggaataaagattgtagactttcaaggaagctggacatgtcttcctccataggatagggtcaaatccagttttcatctttgtgtcttcacagtgctaaaagcaccagcatactctatggatggagcaagaaatcaaatcttgtccctataaaagggccagaaagaaacatcatgccattggccaaagagcaggaagtgaagcaaaacgcctgaataccgaatgaccatttactaaatcattaaaagtttattatgtgattctagtcaataaacatatgctcagtgattcatttgttttctgaatatttaacattttctctatcaaacttttcatctaaatttctcataggcattttgttgttgttataactacaaaggaagggaactattttggttgttatttgtttttcataatttccctgaaattgagcaatacataagacagaatattcagatggaccttaccgtctaaggtttgctttctagttaacaatttgaaaactaatttattctctttatgttccgtctgcccatattaattatatttgataacacagggcgttaaggaaatagtggggaaaatgaggcatcgtgtgtctcattccttggtaggagtgtgctctccatatggctgaggggtagtgtggaatagtggtcaagggggtagagcctggaaccagactgcctggctcatttcctagctctgccactttatggatatgtgaccttgaacagccacttctgctgtaaaatgtggaccgtagtggtacctgtttcactggattttggcagtgattacaaggaagaataaactaaagccctttattatgcaccaaataatgttctctgaatacatacttgctacaacataataataaatatgcacatggtctcaataagagtcttttattcctttgtggttgtcattaaccttattatctgcatcacgtcttttatttgtgatgattaatatctctcattgaggtaacgaagtacaaagtgagatgctgatgcctgtattttgtagacacatacttgatatccaaatatttttggcaatatcatgaaacatttagatatggtactcacaatgtattggttttcttatattttaatttttattgtaaactttgatgcttctaactgaattctaagtgctgaaaacataatatgaaaattatagataggatacatatctaaaaccagatttttagagggaattctgaagggaaaaatatagctcagcagacttgtatgcaaccagataggtgaaacattgttttctcctttccaagatatttgaaatagcaaaggtccaaattatatcttgcaaatgtttttcatgccaaaattggctagactggcaaaaagatatgttcaaagaataaaagattgtaatgttattttaatttcaaggagtttaaacatctgtgcatattttctttttgctttaaagagtggagacttaggatagttggtttaaattagaaaggcattttgttttaagagcctgctgatactgcagcattatagtgcatgttactgtgatatttttaaacaaactgtgaaatttagaaatgcaacctgctagaataaaaactttaataaaatatatacctaatgccattttgtttcttcatcggtttgtttggaatcactttggtgtattttcaactctggattttttttttaattgtattttttttttttttgtcaaggtcatcctaaatgtttcagctttttctaagaaaggaaaagttaatataaataagaaattgagtttctaattcttttaaacttatccctttaaagaaaaatatcaaaaagcctaagaagttcccttggttttttgttagcaaattcctgtgctgtatttagtgttgtgttatggcagaggtgtgtgtgcacatggctctcagggactgcctacagcagaggacaagtgaactttggagtcggacttagctgacaggaaatcccagcctgcctctctggctttggtctttcagccatttttcatactgaacatcattcatttctgtgactcaatacataatagttattatttttacagatgtgatttatgcgtgtcacgctgctgggacatttaattactctattcaacttgactgtatttagaaaaggctatggcgctactcctcttgtttaacagcttctattctaagagaagaatctaaccattgattgggttggatcataagtgtggctaatcttgtaggctaggtaggtatcattttctttattttagtgtgccttgctttttttttttttttttttttttttttttgagacggagtctcgctctgtcgcccaggctggatctcgcctcactgcaagctccgatctcggctcactgcaagctccgcctcccgggttcacgccattctcctgcctcagcctcccgagtaactgggactacaggtgcccgccaccacgcccggctaattttttgtatttttagtagagacggggtttcaccgtgttagccaggatggtctcgatctcctgacctcgtgatccgcctgcctcggcctcccaaagtgctgggatgacaggcgtgagccaccgcgcccggctagtgtgcctttcttaaaatcaactggaacacgtatgtcttagagtttaccaaatcgcttttatataacatgcatttgcttctttttaaaatgacacatctttcatgtctgacttgatttctggtttaacagtgatttataatggtatattgaatggcaaaagatagtcgagggagatattgttatcaagaaacaatggagaagtcagatggacactagtttttacttggtgggaagatgtcctgcagacttacttgcacatatttgaaattctcgcttctagtttgttagaacaacccgagggatgggaccaggagaccggtatcaggatcatagactaaataagaatgaaagcaggaaccaagaagatggtgtcaggagagattgaaacaacctactcagttgaggaacaacatccagatgatgttacaaccaggagacacagctctccaaactgaagtctaaaatatacatcaagacaaccaaatgagagagacaggctaggagagcacaagaggctcttcttggtaaccttaccaaattccacagctgtcagtctccttctgaggctgactcagacccaaaggcaggacaaacaaagcaagacgctttcacccacactatagcttgatcctctgccaagaggcacatctgggaccaagttcagaagcaggcttctagattcttaatcagtgagaggtgtcaaatgtcacctcaccaattagcaaactgtaattctgctttgcttctgagattgaatctaggctgcccgagtaaagaggattgtctggtgccaaccagatagtctggagataccacttgtgggcatggtcagtgtcagtgccttctgtggtctgcagtgccttggaatgctgttggatgcctgtgagatcagccaccctcccctgaggcttaccattaatctgagtaggagaatacggtagtgtaagtaagactgcagtcttccttggttgcgggagtagaccgaaaaaaaaaaccaaaaaacaaaaaaccctgataacctcttgctctgcaaaatctcatgcaagcattcttcacttttgagtgtagactagttaagatttaaaatgactgctgttttcatgaaatagtatcagacagttcagaaaaggctcatggttcctgattctcattgggtcaaaaatctagagatgaatttatctttccaaagtaagaaaactgaatccaaatcaaggttatgagatagccaacaacagtatgtctaaagagttcttggagaaatcacactttgtaaattcccaaggggcaggagttggccaatgtatgggttgttctccttcttaattttagatgtttatttcttatcgccttctattgtctctgctgttcctcttgttggaataaactcaagtgattttacaacatcataaatataactgccggttattggattacaaaataaaacactagcacctggcatttgcaagacattttatgctttgaaaatattttatactttaccgaatttgtttatctcaagttatgggaatattgcatatggattattaactgtattctacaggtaggaaaatttagatcttgaggccaaggagcttgtccaaagttacatggatgctaatttaggcaaagacatgtcctgaaatatggatctcctactctgatacagatcaaatcattggaaatcttgagtttgggaattgttctctttgcctttccttctattcttacatctcttgttcactttggatttactatttcatatttacttatattctcctggtcattagggtattcttgggtgcatttgatagctcttattccttgaatacattgcatacctctggatataccaccttgtgctctaatgtcgtttgagaaacaacagttttcacattctgaggttctgctttgaaatttaccttaattcatctctatcgttgagtaatcttatctttttctcttcagagaaagatttgccttattggatctggccatttatcccttatttaatgtccacttttcagcaaggtcatgacatgccatttcagaagaaagcaatatgctcttttaactaggaatcaggaaactaaaacttttgttgtggctctacatttagactgtgtgcaaattatttactagcttgtaaaaaattgtgagattttactagcttataagaaattgtaagattttactagcttgtaagaaattgcaagaaacttcaagttatctctattggatatttaatgtggagctctttgatgtcatcttaattagctaatattccatgtgacacatataaaatgcatactatgtttaaacttccgaattagcaataaacaccatgttgactgatcaaataattatttaaatgtggttttggctacttgtgtaataaatatagttcacataaactttctactatgtcttgatatgattctaagttacagaagatattatcttgcagttcttgaatttaatagtagaatcacagttcaaccattattcaaatacttccttttcaaaagaagtattcagtggttcccaaatctgcaccagcatcagctgtggtatttttttaaaacatacatattccagggccctactctagagaaaattgacttttcagaaggttgagcaggatcctttatttaagaaggtacctaagtaattctgatgtctagccaaggttggttgtctaaccatttttccaagtttattgtgggacatctaagctgggcatagcagtttaaacaaggtttacttattcagcggacatttttggatgcttacaatatatcaatcattgtgctgagtactacagtaagcaatatgacacagagtttgtctagaggtaattatactttagtgaaaattgcccccaaatcactttatcatgtatatgttgcagtaggagagtatatagtctcaaaagagtaaagaagtggctcctaagtcagctcctgtaagagttctgtgggaagtacagggatgttcaggagaagcatcacagtggaatgagacttgaacattcctgtccactgaatagtcagagtttgtcattttgaaaatagaaaatagaagagaaatacattatcaggggccactaaatatctgttaaaaggggactgacaggatgaaggcagtacagaatgctgggctgagagcaggactgagatcctagaggcagaatcccagtctacccgtactctctgggaggaagtgatgagaacttgcagcagggtggtggtagtgaaagagaagaatgaaagacaaggaagcatcagtggaacttgatgtgtggctggataccagaaatgcagaggaagttagtcaaaggttcccgtcctgatgactggagatcatggtatcactgactgagctctaggggttgtgaaatagagctcattaggcagaggatggtaagtgtctggtttttttatggttttccgtgcatttaccctactgcctagcacaatgcctgatgtgtagtaggggtattagttaaaatactggtttggtggtctctgttgtgacttgtaaaagatgaaaagttaattttatctttctcatggagaaatctaggcaggtaagtgcccagggaggtgcagtgcctgtgttccatcaggttgtccagagattcattccccaggccttctgttgcttcaccctcagggcatagtataactgatgatggctcacttccataattctgcctcagcctgagaggaaaaggatagagaaagtagagggccagccaggcacagtggcttacgcctgtaatccaggcacttggggaggccgtggcgggcggatcacgaggtcaggggatcgagaccatcctggctaacatggtgaaaccctgtctctactaaaaatacaaaaaattagccgggcatggtggcggatgcctgtagtcccagctactcgggagactgaggcaggagaatcacgtgaacccaggaggcggaggttgcagtgagctgagatcgcaccactgcactccagcctgggcgacagagcgagactccctctcaaaaaataaaaataaaaataaataaaaaaagtagagggccagccagccttttgaaggctgcgcttttatcgctctccgcattctgttgtccgtaacttagtcatatggctatccctggataaaagtaggatgtaggctggcgctgtggaacatggctgtaatcccagccacttaggaggctgaggtgggagggatcacttgagcctgggagttagaggctacaatcagctataaccatgccactaagagtacctcactgaatatccactgcagtctttggaatttgatactgttttaatcatttttctaggggaggtaactgaggctttaggatgttggggtagcttttctccaacacattagaaagcaagtaggagaacctcacaatctgtgcaccagaagaactggcatcacccgaaagctcgttagaaacaaagaacctcagtcccacccagatttagggatcagaatctgcattttaaaggatcccagatgattcaagtacacatgaagtttgagaaatactgctttattttacagagaccgtgttcataatctctacacagtcctgccttctagggaagcctgagatgataactttattaagagaattattaagagacgtgacattaaagcagattcaagataattcttttttctgattataagttctaattttatagatttcaaatgtgttaattctgcattttctgcgttttgcctcagttctgagatcatcttagaagagtgtactctcctcttcattgtattgtggtcactgaattctaagaatgttctaactttaggttcttcttctccaaggtgttggaaaaaaaggtcagatcatagcagtggttcgtaatgcaaagtttgggttacttaaggacactgtggaatccatccttttagacatctgtcctcttctgaatgtctgccttctgaaaggtggtagatgattattgttcctatgtaaaatcttaggcatttaaatgtaaaatccagtttgtgatcaagtgtgtttgaattataatagaaaaagcaggctgggagtggtggctcaagcttgtaatctcatcactgtgggaggcccaggcaggcagatcacctgaggttgggagtttgagaccagcctgaccaacatggagaaaccccatctctgctgtaaatacaaaattggctgggcatggtcccgcatgcctgtaacctcagctcctcaggaggctgaggcaggagaatcgcttgaacctgggaggcggagattgcagtgagctgagatcgtgccattgcactccagcctgggcaacaagagcaaaactccatttcaaaaaaaaaaaaaaagcaaattccatatatgaaatgtgaaagattctataagactttttaaaggactaacccttaaacatgagccaattgggtttaaaacctatgattaaaaagcaacatgcagatatcagcatttttagagagggtacttgggtatcagtttggagaatggacaggaagggatgagatgaaacgggtggctttggaattacttggaaggctttcaaaattcagagtgatggttcctactctcatgttctgattagtaggtttgtgatgaggcctgagaacttgcatgttcaatgtttattattgatacataatatttatacatatttatgatacatcatatttatacatatttatgatgttacatgcatagaatgcgtggtgatgaagtctggatatttagtatccatcattttgagcatatatcatttctgtgagttaggaacatttcaagtcctttcttctagctatgttgtaatatataatacattgttgttaactatgctcaccctcctctatcattagaacgtatttcttctatctaatgcttgtacccattaatcaatctctcctcatcacctccccctccaccacccaccctacgcagcctctgatatcttttgttctactttctacctccatgagattaacatttttcactcccacatatgagtgagagtgtacaatacttgtctttctttacctggcttatctcacttaaggcttttctcactttctttacctggcttatctcacttagaacctcctgttctatccgtgttgctgcaaatgacatgattttattctttttttatgcctggataatattctgttgtgtatgtatgtatatgttttatggattatatatatatatataacatacatgttattggatacattatagtacatacatgtgattggatatatatatatatatatatatatataacatacatgttatatatatttaaaaatattttttctttatttgtccattgatggacacaggttgatttcatatctttgctattgtgaacagtactgcagtaaacgtagggtgaagatatccttttaatatttattttccctttgggtacatacccaggagtgggattgctggatcacatggtagttctatttttagttttttgaaatatttccatattgttttccatagtgactgtactaatttaaatccccttttattcacatccttgccagaatctatttttttaaataatagtcattttaactgggtaagataatatctcattgtgtttgatttgcattttcctgatggttagtgatgttgagcagtttttttcatatacctgttggccattcgtatgttgtcttttgagaaatgtctactcatatcctccttaaaaagtgggcaaaggagatgaattatttatttatttatttacttacttattcatttttttatgtactgttgagttgtttgagttcctcatatatggatattagtcccatgttgaatgaatagtttacaaatattttctcccattaaacaggcaatgtctttactctgttgattgtttttttgctgtccagaagctttttagctcaaaatagtcccatttgtctatttttgttttagttgtctgtgcttttgaggtcttagccataaaatctttgcctagaccaatttcctgaagtattttccctctgtttacttctagtagatttatagtttcgagtcttgcctttaagttgttaatccgtcttgcactgattttgtatatggtgagagataagggtcaagtttcattgttctgcatatagatatccaatttttccagcacaatttattgaagagggtgtcttttccctcatgtatgttcttggtgtctttgttgaaaatcagttgcctgtaaatatgtggatttatatctgggttctctattcttttccattggtctatgtgtttgtttttatatcaataccatacagttttgattactataaccttgtaatatattttgaggtcaggcagtgtgatacctccagctttgtttgtttattcgttttgctccggattgctttgtctattcaggtttgtttttggctccataagaattttacggttgcttttgtatttctgtgaaaaatgtcattgttttgataaggattgcactggatctggagattgttttggggagtagggtcacttcaacaatatttattcttcctgtccatgagcatggaatgtctattcgtttctgtcctcttcaatttctttcatcaatgtgttgtagtttttcttacagaggtcttctgtcttcttggttaaatttattcctaagttatttattttttgtagctatttgagattggattgccttcatttctttctcagctagttcattattgttctgtaggaactagtgatttttgtatgttgattttgtatactgcaactttactgagttcatcagaactaatggttttttggtggcatcttatattttctagataaaagcttatgtcatttgtaaagagaaacagtttgacttcctgtctttcagtttggaatccttttatttctttctcttgcctgatttctctggctaggaattctagcactatgttatgttaagtaggagtggtgaaagtgagcatccttgtcttgttccaattattagaggaaaggctttcatcttttccccattcagtatgatgttagctgtgggtttgccatatatgcctttattaagttgaggtatgttcctactatacctagattattgagaatttttatcgtgaagggatgttgaattttatcaaatgctttttctgtgtccattgagatgatcatatggcttttgtttttcactcttgatttgatatatcacatttattgatttgcatatgtacaaccatttttgcatccctgggataaatcccacttgattatggtattttctttagatgtgctgttgaacttaacttgttagtgttttgttaaggatttttgcatctctgttcatcaggatattggcctgtagttttcttttttgttgtattcttgtctggttttggtatcagggtaatgctgacctggtggaataagttagggagcattcccttctcttctattttttttggggggtgggaagagtttgaggaaaattagtgttctttgtacgttttgtagaatttggcagtgacaccatctggtcctggacttttctttgttgggagactttttattactgattcaatctcacaactcattgttagtctgttcaggtttgctatttcttcctgattcaatcttggtagattgtatgtgtccaggaatttattcatttcctctagattttccagtatattattgtatagttgttcataatagtctctgatgatcttttatatttctgtggtatcagttgtaatgtctcatttttaatttctgattttgttcatttgggtcttctctcattttcttggttagtctagctagcagtttatcaattttgtttattttttcataaaactaactttattttgttgattctttgtgggtttttttagtctttattttgtttagttctgttctaatcttcattacttatttcttcctactgattttgttcttgcttttctggttccttgatatacactgttagattgtttatttgagatctttctacttttttgatgtaggcgtttattattttaagctttccttttagtactagttttgttgtatctcataggttttggtgttttgtgtttccaatttcatttgcttctaggattttttttatttcttccttaatttcttcctggtctcagtagtcattgaggagcaggttgtttaatttccatgtatttgtgcagtttctaaagttcctcttgttgctgatttctacttttatttcattgagatctgagaagatacttgatatgatttcgatatttaaaatgtgttgatatttttgtgtcctaacacattatctactctgaagaatgttccatgtgatgatgagaagaatgtgtgttctctagctgttgaatgcaatgttctgtaaatgtctgttaggtccatttggtctaaagttcagtttaaatcctagatttctttgttaattttctgtctagatgatcctactgttgctgagagtgtgatgttgatgtctcctactattattgtatttgagtctgtctctccctttagatctaataatatgttttatatatctgtgtgctccgttgttgggtacaatcatcctcttgctgaattgaaacttttatcatgttatcatcttctttataagcggaaagtttaatctgtttacattcaaggttattattgatatgtaagggcaaattcaagtcatttccttaattgatttctgtattttattttgttttatttatttatttttgagacgaagtctcactctgttgcctaggctggagggcagtgacgctatctcggctcagtgcaacctccgcctcccgggttaaagcagttctcctgcctcagccttccaagtagctgggattacagacgcccgccatctcacctggctgatttttgtatttttagtagagacgagatttcaccatttcggccaggttggtctcaaactcctgacctcaggtgatccacctgcctcaccctcccaaagtgctaggattacaggtgtgagccactatttccggcctccttaactgatttctgattgctttgtatatcctttcttcctttctttttctcttattgttcatcattgtggttttgtagttttctatagtggcaacatttggatccttcctcttccttatttgtgcatttgctctaccagtaggttttatacttttgcatgctttcatgatggtggatatcattcttttgcttgcaggtgtaggactaccataagcttttattgtaggcccagtcttttggtgattagtaccttcaacttttgcttgtctaggaaagactgtatttctccatcatttatggagggtaactttgctgggaagagtatcttgggctggcagttttttttttttcagctctttgaatatatcattcagttctctcctggccagtaaggtttttgctgagaaatcagctgttattctgacggggggggtggttctcttataagtgactagatgcttatctcttgctgtttttagaatttgttctttgcctctcacttttgacagtttgactctaatgtgccgcagagaaaacctttttgaattgtatctatttggggatttctgaccttcctgtatctgtatgtctaaatctcttactagacttgggaattttttttagctattgttccactaagtaggtttttgatccctttcatttattcttcatcttctgggacactgaaaattcaaatatttgtttgctttatggtgtcccatgtgtgatgtagtcttgttcactttttttttttttttttggagacagagtctcactctgtcaccaggctggagtgcagtggtgcaatcttggctcattgcaacctctgactccctggttcaagcgattctcctgcgtcagcctcctgagtagctgggattacaggcatgcaccaccacacccagctaatttttgtattttattttattttacttttttaagtagagatggggttttaccatgttggccaggatgatctcaatctcctgacctcattatctgcctgcctcagcctcccaaagtgctaggattacagacgtgagacactacgcctggcctgttcattcatttttattctttattctttatttttatctgactaggttatttcaaaagacctgtcttcaagttctaaaattctttcttctgcttaatctagtttattgctgaagctttcaaatgtattttgtattttattcaatgaagtcttccatcccagaatttctgtttggttcttttttacgatatctatctttttgataaatttctcattcatatcctaaattgtttttctaatctctttgtattgtttatatgaattttcttgtatatcactgagattctttaatatcattatcttgaattctttttctggaacttcatgaatgtctttttcattggaatttgttgctggagaattattatgttcatttggaggtgtaatatctctttgttttatgtttattgtttatttacattgatatttgtgcatctggtataacagtcacttattccaacttttttgaatttgcttttataggggaggactttttcctgaagatgtatctgtggtgttggtttgatgtagcattttgcctttgattctggatgaatacagcagtgtagtctctgtatgatttttttcatctgtaagtgtcagtagtgcttgtaatttcctcagtggcttagggtgtggttgttagtggaggtcatggtaaagttttgctggtgatgaggatgctaggtgggccagtcctcaatcactggcaggtgcttgaggtggcagtggcaggctgagcatgcctgtcctttggtcttagggtggtgtatgctggccctgatattagcaggttcagtcaggccagttggacctccaggtggcttgcttgggtgccagcagtggaagaagtgggctgggtggctgggagggtccttaggctcctaggcagtgggcatcgtgctgagggacgcagtagtagtggtgagacaagccttaggctcccaagtggtttgcgctggtgttgcagtggctatgacaggccacgcggggcagtctcaaggcttgcaggtggcatgggtgagtggatggtgtgggtgggtgggtgctagctgtggtgttagcagtaggttgggtgggtttgtcctcaggccctcagaaggagtgctcaggtgtcaatggtggtgaatggggcagggccattcccaagcctctgggtggtggtcttgggctctgggggagtgggatgggttttaacatggttaaatggtcctgttctctggcccctaggtggtacgtgtgggtgctggctgtggtaagtaggataggggtggaccccaggtcccccctacccctggcagaatagctggatgggggtggcagcgactgtgtggtggccctgaggccctgctgctggggagggtggagttaccatggcagcagttgtaaacaggtgactgggggagcttgtgctgtggctccatatggcggctgcaagaggggtgccccatcctcagggtgctcttaaatgcacagaggccttgttgctaggggcagcagggtcgttggcaaaggcttgtgctttggccctggctgcggttggaggatatcaggggagccccggggatgtggagatgcaggggctattgggccccaggccaggatgcagtctggtgggggctgacatttcaaaacagtgccctcctgtaactgcttgtgacacagcaggtgagtggaactcagtgcgcgctccctctggaggggtgccgctgcctgatctccgggtggctcccaatgttagcctcagggcctgtgcaggccgcggggttctcccatggctacgattgcaggagtctgtggtggaaatgtgggctgctggggtcgctcacttaactttaccacatgagggagcctggagaaccttaatcacattagagaacctctctagctcccagccgatcctggctgagcagactgccccacttccctcttcttctttgcctcccatgttacctgtcacttatttcttgaattccaatgttctctcttatgtgatctgtttgacctgtgatatctactcactatttcagttcttgtttgtggaggaggcgagtaccaggtgcctctagtcagccatcttgaaactcccctctaacttttccttggatttttgataacttcccaggtgatgatggtgcccatttgtccaaggaacacactttgagaaccactggactagagtttgggagatcaatcagaaatcttttgcatttatctatgtaagataaagtatagaactaaatgctgaaaatagagttaaggaggaggggtggtttccgcaaatacagagcagctgtaattggcaggacttgataccagaccagagtatgcaggtgaaggggaggtaggagtcttgactggtttctagattcctaacattggtaggtggatgaagaatagtggtacctttatctcaatatatagcataaaggagaagaagctggctggtggtgttggggtggaactgatatgtgtgtcattttagacatgtcaaatggagattatggggacaatttaaatagagatgtcttttcacgaagtaggagactgccaagttgaagatgcagacatgtatgtctctacaggagaaattataggttataatgtgatgagaataggttataatgcgacgaaaataagatatagagaacagaactctaggatacgcaaatatttaaggtgaaatcagaataattcatcttcaaaagaactgagaagaaatgttaggagccctggaagagaagttactacaagggtgtgatcaacatgtcaatactatagggaggtcgaatgatagatggattgaaacatgcctattgcattgagaaaccagaagatgatagaaaaccttgataaaagcattttcatcaagcagcatgattcagcccggattgcactgacttgtggttacaaactggttttcaggacagagtatacaccttctgcttctctgatattaaattcctactttttaagctcttaagaggacaatgctatggatagaaatactttgctgtactaataggcccatattctagttttaacctcatctttctaggtggaatttagaaaaatgtttagttaacatttagaatcaaaatgtatatgttgctttttcttttgcaaaagcagcgccttttgggagatatcgtgccttaccaagaggctttcagaaatgatcagggcagggccaggcagcagtggtttatgcctgttatttcaacactttgggaggccgaggtgggtggatcacctgaggtcaggagttcgagaccttcctggccaacatggtgaaactcggtctccactaaaaatacaaaaaaaaaaaaaaaaaatagctgggcatggtggcatgcacctgtaatcccagctactcaggaggctgagtcacgagactcacttgaactcaggaggcggaggctgcagtgagccgagatcgtgccactgcactccttcctgggtgacagagtgagactccatctcaaaacaaacaaacaaacaacgacaacaaaaaagatcagagtggttttcgtggttggtccttctgaaagtgttatgttttattcctcacccccatccgtgctggggcacccagagtgctattattgctattaagaatattgttttactctgtgactttgtgtaacagttgggtatgattattttattactatcctgattgacccaacttaaaccataagggaagacagggtacaaagatgcaatagctgttagagcagctgtcacttctggtaatttgactataaccactttctttccttttcctccagtgtttttctaagcagatttaaaacaaaacactgggagtaaatagaaaatgctgcccctcacacgatcaggcctgggataagtttcataagcagaatttcctggtgatgctgttgtctggaaaacatggtcaaaaaatatctatctgttctgtaacagccttcccacctctgttttaggaacccttcgcatgggatcgtgtgccctgattctttaagacttgctggaaatccagacttgagattgtgctgatgcagcccttttaatttgatgcttgtatccctctgttaattagtaggaaagttctccccaaaatgtgggtcaaatgcagaatgagaggaacttccagtaaaatagtgagctttctatgtgacccaagtgaaagcacttttttaaaaaaatttttcatgacacaaccaaactaatctagcagattctctatgtgtgtacttttattttgcgcttcacttgctgacgtgtttgaagtttcagtgtgtcaaggctccacattgaaagaaaaaagaacacttcaaatctcaggctgcaaatgatcatatgtgtaattgtgattttacagagaccagactaatttcctagaccattagaaattttacttgttgacagatcaggctctcaaaagactggttaaaaaacatgtctttgaggctgatggtgaataatgggggaaaatggtggattttgaagatttatgatataaaacccaaaagctctcttcaaacattaaaaaaaacactgttttgaatactttaggtaatgacgtgagatcttttctctgaatttgttcttcatttaggattttttaaaatgctagtaagcatattggagttcaaattaacattttccccttttactttctttctcgagcaggttgtcaagttattaagcaacaaaagatcacaagcagttggaatactaatgtctagccttcatttagatatgaaagacatacaacatggtaagtgtcaaaatgaaaatttagcttctgaatattaaaatttgggctgagggatatgatgtttgttggtaatgttatttcaaacttagagtttctgtgtaaaccgaggttagtatatatcccgtaagtgtgatcaagctatctcccatgattgtttctggaaggattactattaatttgcctgtggtgttatttatataccttactaacagtctaattatcatgtgacattattatcttagttcaggctactataaccaagtaccccagactggtgggtgataaataagagaaatttatttctcacagttctaggaggctgaaagttcgagatcagggtgccagcatattcggttctggtgagggccgtctttcaggttgcagactgccatcttctccatgtatcctcaattggcagaaagaaggaaagagagctctcttgtgtctgttttataaggggactgatcccacgcacgagaattctacccttgtgacctaatgaccacgcgacctagtgaccaccacctaggatcctgtctccttgtaccttcacatgggagtgaggtttgcaacatatgaacagaaatattttctgtttggaattagagtggttcttaacattttataaatggctttagtgtcaatattttaatacttggattctactgtacaattgacggccattcttatgccatatcctcctatgatatttatgctgagagatactgcccaaaggtgaatagagtaatgaagtgtaaattcagagtgtcccttaagctgactagaacctaagaatagatttaaagcagattgaattatccaatggaatgccagtttacctattaaagaaatatggtttcaagaataacacagaccttataatcacaaaagcatttaactggctttctagcttacccctttatgaatgtggattctatttgttgggcttaaaatcttgtgtgggataattcataaatagcacaagcttggtatgccctgtcaattgatgagtaactcttaatcacaatttaagtttttattaaattgttttgatggggaggagacttcctcaagctgaaacatttggggtaatagtcatagaagagaaagccaaggctggcgccaggcagtacttggtgtttctaaagctggcagatgtagcccagttaagtcataggatgaaatctgaaaataatgatatggttctttccttcagtcaaatattcaactcgggttgagttgataatgagaaccttatgaacaagagtccgcctgacatctgtgtctgtggtaaagccagtgagagttcattgaaaatttgcttgctttaacatgcaacgctagcaataacatggcatgaaaggcagtagttgaagggtcatacagaatcatgcagaaactttatcccattaggatgtgaagtgattgctttagtccctttgaaaccctgtacacttttttttttttttttttaatatggtggccttccaagtctaaagcagcaagaggttgtgccctcctgcaggtaaagtcctattctgccttggtgtattgtctgcaaacaggatttacatgtgtgaatcgcttgtgtcctctagagcaaacttgacttctctcaggatatgcctccactgagaagtccacagaagcataaacatcattgattttggatatagaagtggccacagaatttatctagacctccagcgtcatttttaaaaaatactttttatttccataggtttttggggaacaggtggtatttggttacatgagtaagttctttagtggtgatctgagattttggtgcacacatcacccaagcagtatacactgaacccaatttgtagtcttttattcctcaccccctcccacccttccaccaagtccccaaagtccattgtatcactttttatgcctttgcatcctcatagcttagctctcacttatgaatgtgagaacatacaatgtttggttttccattcctgagttacttcacttagaataatagtccccagttccatctaggttgctgtgaatgccattaattcgttcctttttatagctgagtattatttcatcatatggaatatgccacaattctttatctactcgttgattgatgggcatttaggctggttccatatttttgcaattgtgaattgtgctgctataaacatgcacgtacaagtatctttttcgtacaatggcttcttttcctctgggtagatatccagtagtgggattgctggatccaatggcagttctacttttagttatttaaggaatctccacactgttttccatagtggttgtactggtttacattcccaccagcagtgtagaaatgttcccgtttcactgcatccatgccaacatctattatttttttatttttttttaatgtggccattcttgcaggagtaaggtggtatcacattgtggttttgatttgcatttccctgatcattagtgatgctgagcattttttcatgtttgttggccatttgtatatcttcttttgagaattgtctatttatatccttagcccactttttgatggaattgtttgttttcttcttgctaatttgtttgtgttccttgtagattctggatattggtcctctgtcagatgtatagattgtgaagactttctcccactctgtgggttgtctgtttactctgctgactattccttttgacacgcggaagctctttagtttaattaagtcccagctatttatctttgttttcgtagcatttgctttgggttcttggtcatgaagtctttgcttaagccaatgtctagaagggttttcccaaagttatcttctagaatttttatagtttcaggtcttaggtttaagtccttgacccatcttgaattgatttttgtataatgtgagagatgaggatccagtttcattctcctacagtgtcttgccaattatcccagcagcatttgttgaataaagtgtcccttcctcactttatgtttttgtttgctttgtcaaagatcagttggctgtaagtatttcactttatttctgggttgtctgttctgtttcattgttctgtgtgtctatttttataccagtaccatgctgttttggtgactatggccttatagtatagtttgaagtcagataatgtgatgcttccagatctgttctttttgcttagtctttctttggctatgtggcatttttatcgataggcaaaataagacctgtgagtggtccagttaccctctcagtatcacgcagctcattaatgaaatggattgaacttgcactcaggccccttcattaaccagtacttttttttttttcattcagacatgctgcttctccaagattgtgctttttttttttaccaccagcattggtttatctaaaacaaagtatatgtaatattgtaataaacagcaagaatcattttctctccttctttgctgtcagtactctaggttttcatttactttgtaatgtttatatttcaaagtgctccattagagtaattagtgtgtaaggtttggattctaggtatcaaagttctaaccctggtcctgctgagcaccacttgctcagtctgttatttgaatacaggttatttcccacaataatagatgtggagcattctcagcaacacatacattcaaaaggcagagaggagagaagaggtcaggttcctaagtttattaatgcggcaaatataagggggcatccccaaataattacctgtgtgtgtgttagtatataaaagttataatgaaggcctgagctgctggctatttggtaatgttcaaactggcctacagttataatacctctgaaaaaatctcaccctgtggtttatagtaatttgaagtctgagatgaaagtgccttccagagaagatttaccctttttgtgtgtgtgctagggtctgggggccctgtggatttaggaacaccttgaatcacactctgggggctgtaggagggtcccttcagccagtgctgtttgtccactgaatgggttggttcccctgccagtatagcccttttttttaattattattatactttaagttctagggtacatgtgcacaaccagtatagtcctttgagtcccatttcattgtggggtatgtctaggatctctatgatgagtgggttctgggctttgatatttggcccctcccaccgtgaaactgtcaagagaaagttgacatttgttaggataggcaaatacactcagggcaaaagcagtttgtgagctggatcacttctctgagttcgctcttcattttgtttagcatggtaattatatcttgtcagctctttgacgtccttatgatattttacaaacatgttttactcagcatttttagttgttgttagtggggggattgatttcaaataattttggcctgttattcccataaattgatattataagagtatcctacagcttcatagtggtagttcacttctgtgaaaattgattaaatattttatacaatgtttggtctgtatttcaggggtcagtgtgctcttcacagatcttaggtccattttcatagataacagtagctgcaaaagaatttgcaattccataagcttcagctttatcccccaacaatgtcacggttagatagaaatactaactgggatgctttaagagtagaaggggatgtcattgataatattgcctggataacaaatgtaaagtgaaaacttttacttttttttttttttttttttgagacagagtctcactctgtcatccaggcatagttcagtggcgcaatctcagctcactacaatctccgcctcccaggttcaagcaattcttatccctcagccccccgagtagctgggattacagccacctgccaccacgcccagctaatttgtgtttttagtagagacagggtttcaccatgttggccaggctagtctcaaactcctgacctcaagtgatccacccgcctcagcctcccaaagtgctgggattacaggcgtgagccacctcacccatccccaagaacttttcagataagctagtagtattgtcaccctactaccagatcgaactgaagcaagtttcagactgaaccctcccccacacacagatatatattacactggtatttcctggccatctcaagcaaaatagtttgaaaaccctgcttcataaacttgaggttgtttacctctctgtctttataggggctctcactgtgatctatctgaaaggtttgcttcagacagatataagcttggcacagatgtaggaatctgctaccctcatagtctgcacgagacatctagaaagtcaactcagccagtggctgcacccagtactgtttaggtcctaggcctcaggcagcctccttaaagaacaaagctattagcccccagtagactcttattctagctatggaagaggtaggagtggagcatctctaagagattgcaactaatccacacatccagaatgactttaatttcaccattgaaagcccatttcagacattagtatgcgtattaaagcctcggttgttgatttagatagagatagctgagcagcttgcgttaactgcctctggagaatggcctttcttgcgtagtgctggtcagccatccctgaggtgtggtctcttagacactccctctgcaaaaatatttgaaaatagattacagatctcatcacaaggaatacctaatatctatttagtagtctgacacgttaaacttacggaaacacgtttcaatatactgcagggatacccagcccagggtatgaatggctctgattccttcctgtcttttatatatgtcctgtctaaagctaactggaattatgggcccttggcagtaaatgctatgttacctccttgctgaaatttctatcctgtttaaacatgatttatgaaaatcatatatcttaaaatttaatgagataataatgtaaactacctagcattccatcagaagtacagttgatacagtcaataaaattgtagttatttttatgttttaatttctgagcctaatgattgctttcccaaacagtttatttaaattatatagttaagggtaccttacaaggacaatgcacaggctcttagatttcaattagaaatgccagtgagatctcagtgttaattatgacttctcattggaatcatgtcatgttgctgctgttttggtctgccattgtcctccctcaaaagggtccaaagctgagaagccttattctgataattgtttgggaagaaattgtcctaatgtagcaggtaccaaaaagagaaccggtattggcatacaggatacatattcttttttaaatttgtttatttatttttatttttttattatactttaagttctagggtacatgtgcagaatgtgcagatttgctacataggtatatacatgccatggtggtttgttgcacccatcaatctgtcatctacattagctgtttctcctaatactatccctccctttgccccctaccccctgacaggtcttggtgtgtgatgttcccctccttgtatccatatgttctcattgttcaactcccacttatgagtgagaacatgtggtgttcagttgtctgttcctgtgttagtttgctgagaatgatggtttccagtttcacctatatccctgcaaatgacatgaacttattcttttttatggctgcatagtattccatggtgtatatgtgccacgttttctttaacaggttacctgttctaagatcttttataatcatatctttttattagtatttgaagagatggaattagctattggtttgaactttgcttcttccgcctccttccctctgatattattggtgatagttgtgtaaaattgtccagaagaggggagttaattcccactttatagtagggggaattcaggtttatagatggagtctgcctagttctttatctccatagggccagaatgggcatccaatttttttgagtcctagctcagggctctctgctctgggcagtgtgttagcttgttactgaatgaagcatgtgttacctaataaaatcagaatgcgcaacatatgcaaaaataaaactggcaaacaggcatactacttttggctaccagttgtttcatttttacagttgaaaataaatttatcagacttcatttattatgtgtcatataatacaaattttgcagtttgcatattgactatgaaattttttcacatctgtgaattaaatgaggataaaattcttttaacaaaattattaacagagttccttgctcttgattgaaccaagcaaagaatgaaatacacttatatgccacataacaacattttggtcaacaacagaccatgtatgtgatggtggtcccataacattataatggggttgaaaaattgctatcaccaagctagtttgtagtgtatcacattactttttctaggtttagatatgtttcaatacacaaatgcttattattgtaagagagttctcaccagtgactgagtcagctggcaccttgatcttagacttcccagctttcagaattatgagaaaatatatttctgtttaagcaccccagtttgtcatattttgctatggcagcccaagctgtccaagacagatttgaatctcagctctgccactggctggctgaataaacctgggcaaattactttatatctctagtcctcagttttctcattagttcaaaaggctattgagttctgattgtacacacacctgcacccatattaagcacttaatcaatgttagtttccttcgtgtgtttcttaggaaatgacctatgtctgtaggctttggaggtgtttgaaacttagggcaaccagtaagagagataacttaaaggggtttgtttttttttttttttccttttttcattgccctgaacagactctgtgataagtctttgtccatgggacaaaaggagggtgtagaatccagaatctgttacttccttttttttttttttaataaatcaactattatttttgattcaggggtacatgtgtaggtttgttatctgggtatattgcatgatgctaaggttttgggtttgattgatcctctcacccaggtactaagaagagtactcaatagttagtttttcaatctttgtccctttctcccccatctaggagtccccagtgtctattgttgccatctttatgtccatgtgtacccaatgtttagctcccagttataagttagagctagtggtgaaggtttttgggggggtccagtttcattcttctacaaatgggtagccacctagcaccatttattaaatagggagtcctttccccattgcttatttttattgaagattggatgacggtagatgtgtggctttatttttatttttggattctctattcttttccataggtcttttccatgtggtgtttgcttttctgttcctgccttaattcacttacatagcctccagctgcatccatgttactgcaaaggacatgattttgtttgttttttggctgtgtaatgttccgtggtatatatgtaccatgttttccttatccaggccaccattgatgcacacctaggttgattctaaatctttgctattgtgtatagtgctgtgatgaacatatgagtgcatgtgtctttttggtagaacaatttattattacagagaccaaaacagcatggtactggtacaaaaagacacatagacctatggagaagaatagagaatccaaaaataaagccacacatctacagtcatccaatcttcaataaaatcaataaaaataagcaatggggaaaggactccctatttaataaatggtgctagatggccaaccatttgtagaagaatgaaactggacccccaaaaaaccttcatcacatataaaaattaactcaagatggattaaagagttaaatgtaagacctcaaactgtaagagtcgtacaagaaaacctaggaaataccattcgggatattggctttggcaaataatttatgactaagtcctcaaaagtaattgcagcaggaacaaaaattgacaagtggaacctaattaaactaaagagcttctgcacagcacgagaaactctccacagagtaaacggacaacctacaggatgggagaaaatatttgcaaactatacattccacaaaggtcttttatccagcacctactaatacaagaaacttaaacaattcaacaagcaaaaaataaatagcctcatgaaaaaaatggtcaaaagatgaagccataaaaaaaaatgagatcatgtcctttgcagggacatgaatggagctggaggccattatccttagcaaactaacacaggaaaagaaaaccaaataccgcatgttctcacttaaaagtgggagcttaatgacgagaacacgtggacacatagaggagaacaaaacacactggggtctttcagagagtggagggtgagaggagggagaggatcgggaaaaataactaatgggtactaggcttaatacctgggtgatgaaataatctgcacaacaaaccctcatgacacaagtttacctatgtagcaaacctgcacttgtacccctgaacttaaaaaaaaaaaaaaaagagacctgcaactttaattaaaacaacatataacaaaatgaattttgctataggctaattgatataaacaagagttaagttcatatggcatatttctggtcacttttaaataaagaccccaaacacttataatattaaacactgaagtaaatgtgagctatacatacatttaataaagactaatttttaaagatgggtaaaaggtgtgaacacacacttctcaaaagaagacatacaagtggccaacaaacatacgaaaaaatgttctacaccactaatcatcagagaaatgcaaatccaaatcattatgagataccattttacaccagtcagagcaacagatactagcgaggctgtgagaagagggaacacttatatactgttggcaggggtataaattagttcagccactgtggagaacagtgtggggatttctgaaaaaaacgtaaaacacaactctcattagacccagtgatctcattactgggtatatatctaaaaggaactgttacttctgattgagttgggagtgagataagagggaagaaatgggagttaagttcaaggggaacatgtctgaggcagatttgattgttttgtagtttggcttttatttttccgtcagttttcagtaaactagctgaaatgctttttaatactgggctgtacccatttctgatttttgagtacagataagtatgagaattatctaacagctcttagaagttgagcatgactacatgtttggactgttttatctgcaaggaggacaacttgttttggaaacttgaaaggctaaaatctcccctaactgtgtggcttcttaaacattgtctctgtgctgtgagagtcagccatattctatattaattactgttggctctgtaaagcatgtgaaggtagtgggggaagaagtttagctttgttggggaaatgaatattggtgtgggccatgagtagaatctaagtagagacatagacagatgcttttatttcttgctttgacattttatttttcctgatagttaaactagtttctagctatgaatataaagtataagaacactttcatctttttttgctgatggccattctaacaggtgtgagatagtatctcattttggttttaatttacatttctctgattagtgatgtagagcattttttcatttatcagttggccatttgtatgtcttcttctgagaaatgtctgttcagatcctttgcccattttcaatagggttatttgcctttctgttattgagtagtttgttatatatttagacatataaatatattagatattagcccctattcagtgcatgatttgcaaatattttctcccaatttgtggttgtctctgcactctattgttttgtttgtgtgcagaagcattttgatttgatgccatcccatttgtctattttctactttcattgcctgtgcttttgggtcatatccgagaaataattgccctgaccaatgtcatggaacctttcctaacccctgtgttttcttcgagtagttttatagttttaagtctttaattccttttgagtttattcttttatgaaggatgaaataaggatctattttcatttttgtgtatatatagatgtacagttttaataacaccttttattaaataggctgtcctttccccattctgtgttcttgacacctttgttgcaaatcaattgactgtagttagctgggtttatttctggacactccattctattccactggacgatgtgtctatttttatgccaccaccatactgttttgattactatagctttgtaatatattttcaaatctggttgtgtgatttctctggttttgtcctttttgatcaagattactttggctatttggttttttttgtggtttcaaataaattttaggattattttttctatttctgtgaagaatgacactggaattttgattgggattacattgaatctgtagattgctttaggtagtatggccattttaacaatattgagtcttccaatccataaacacagcatatctttccatttatttatgtcgtcttcaatttttttcatcaatgttttattgttttcagtgtacagatttttcatttccttggttaaattttctcctaagtattttttgatgctattataaatggaactgttttcttttttctttttcagactgttgttagtgtatagaaatgcttctgatttttataggtcgacttttgtatcctgcaacttaattgaatttatcagttctaacagttttttgatagagtctgtaggattttctatatacaagattatgtcatcagcaagcagaggcaatttcatttcatccttttctatctgaatgccttttatttatttttcttgcctaattgctctggctaggatgtccagtactatgttgaacagatgtggtgagagtaggcgtccttgtcttgtttctgatcttagaagaaaagctttcaacttttcaccattgagtatcctgttagctcttggcttatcatatatggcctttatcatattaagaaacattctgtctatacccaatttgttgggagtttttatcatgaaacgagtttgccaaggatgtggggaaaagagaactcttccatactgttggtggaatgtaagttaatatagccattgtggaaaacagtgtgaagatttctcaaaaaataacaatagaatttccacatcatccagcaatttcactactgggtatatacccaaagggaatgacttcagtatgtctaagagatgtctatacttctatgttcattgcagcattattaccaataatcacacctcggataaacctcattggcttcagtagtactgcaacagcacctcattggctttgataactgccacagcacaaagctaattgtattattattcacaagagccatgaaatggaaacaacctaagtgtccatcaacagatgattgcattaaaatatataatatatatatacacaatgaaatacaattaaaaaactaggtaattctgtcatttgtaacaacatggacaaacctagaagacattatgttaagtgaaataagccagggacagagagacaaaatctctacgatcacatttatatgtggaatctaaaaaagtcaaagtaatagaggtagaaagtagagtggtggttactagaggctgaggggacaggatggatggggaaaggggagacttggtcagtgggtacaaagtctcatttagataggaggaataagtcctgctggtctattgcacagcatggtgactatggttaataataatgtattgtatatttcaaaatagctaaacaagagggtttaaaatatttgagatgatggatatgttaaataaataattaaagcacaagaacacttctttaaaaatctgcaaataaccctttgacccccctaggaactttccacgatggtttttttttttttttttttgtgactctgtttgcatgtatttggatagcctacacatttgcacttcttttatcctgttggggttgccactgaatcatggttttcttatgaaatttcctatggaacaagttgtacattacaaactccaggtccttttcatagagtctggcttcattcttggagacacaggctttttcgcttccctattaattaccataagaaagttcattcatcatcatttgtttatttttgtaatagtctcaaaaattaggctcagtgtgagcaatgttgtttttccccactaggcttttcagtgtctgatttttttttttttttaatgaaactcaagcttataaggcttgcttagaaattgcttcatgcccccatttttttaaacctttttttttaaagtgttttcctcacatgggatatagaattttaagacctgtttattatatttattgagacattaaaaatgtactaaatgctgttgggaggtttagtgaatggttttcattgaaatgtaaagtcattgagaattagaaatttgagaagaaagtaggctccagtgagcctgtgtaaccttttcatcaattgtagccttgtagtggagaaaagtacatgtgagatactaggctttcataaaaacctactctcagaaatttaatatgagaatttgttttaatttaaaatataagttcattacctagagctttttataaaaagaaatacctcatatgtcttttgaaatcacacataaattattagatcaaggtcaaatgaattataatgtcttttactacaagttcagcaaaaaacttgggttgagcttagattatatttttaatgacattgttccatagttggactttttgattatacttctatgggaagaaagaatgcaatacttggggttgtaccaaagccatgagctttgcatatggttattcttttccctcattgtacttactgtctgaattgagaatcatgtatttgtttatttgtttgtttgttttggccaacctcttgaccctcactaggagggtgactctgtgagcctgaagacagcccactgcagctcaaggccttcctccccataatgttgcatctgttctttaagatcagtgggtgactgcgaatggaattgtccaggaccacatggagcatgcatggaggtagagcccaagtttgaccacagagcacttagtgtgagcccataattaatcacatcaactttgacccttgaactactttgtgtaaaaggtgtggtttttgcaaaaagattcctttggcataatccttgagaggggtcggattggcactgttattttggggcaaggggaagcccctttcataagtagagttatgtttgtatttcaaaattggctgattgaaagttctttgtgttttgacaagcacttctccagcatccctaagtggatactctcaggatgctccctggccacctttatccagttggatgaagtgaggattctgagagttctggagaagatgcaataattgacacttttcacctttcccttatggagccgcatgtgtcctattcttgtgaggtatattctacaaatataatcatagtccttcctctcagctcagtgtgccgagacatcagctaaaacatcaaagtcatgtgatgacatgttatcttttggcatggctgaagcaatgacatttcgtgctgttgactatcttgcatcttctttcacggtcaaacatgaatacagcgagatctttattttctcagccaaatacctctgactacatttttacattaaacaatttaaatcagataattatatgcacgtgattaagaaaataagttgtatagaaaggcctataatggaaaaagcacagtttccaaatctccgtaagaactttgtcacttctccgatagattataaaggaaagaattgttcccttgctttagccactagagcataatagcaggctcatttgaggaaatggtggaacttaagaggagggttctctatcattgtcaaaaacagcatgaaattcttatgaattaagttgtaaagagaatttctgaattgaggaagacattgaaatagattgtctgcaagattccgattaatgctatttttatggttccaaatttaagatagacaatagctgatcataatagggaacacttacagacattactatgcaaagacttgcaacaactgtatgaggcaggtgtttttatctccatcttcaggatgaaagaactgaggcatagagtagtaaaagaaacttaattagcaggtggtggggctatgatctaaacacaggcattctgggtccaggtccatgctctgaacctctgctgtacttgctgagaactctcaatgttacttattctatcagtggcttaagctggaaaaacagtgcatgatttgtttttttcctgtgtggttcttagctatagagctagtctactggttagaggctatggttgctgtgtgcagtgctttagtgttgtactgtctcgctagagtacacattcatgttctgtgtatgggagtggcatgaggggaaaggcagagggggcagagacacacacacagggaggaaaaagatgtgatggataacttgagaatttgctttattccttctattattaccacttgctgtatcttctctctgtgattcaggtgactctgaatcaggtgagttctgtgattcaggtgactctcaggtgttgggggatctctctatgccaacttctgtgccaagtagagagataaagagaatgcatggaaagactatgattgccttagtgaagtactttcatatgaatgttagggtgtatgagagtgactgattttattgttgtacttactagtccctgttgtttccacaaagaaagatgccagcattgacattaacatcagggaggccataattcgttcactcctactgctttctttccttccttgatttcttccaatgcttcagcattcactcaacattaactgtttgcctactctctgccaagctccactcctggcagtgggatacagaaataaagacagagagacaaaaatccatgtctgtgttcccatagaagaaaaacaattttaatatgtaccatgggggaaacgaaaaaaaaaaaaaaagagagagtggaaataaggagcacatcatgagaggagagggaggagtcagggaaagcccaattggaaggtgatagctgaaggccatgacagaaggaaccttgtaaatatctgaggaaagagcatgtgagggaaaacaaccaggcaactgcaaggatcctggggtgactgaaggatcagcacgatgtgagagtgcctggagagagcactcagcggggagagaattggagacgtgatttggataaacaatggggtctgcgggggagggagatcatgtagggctttgctgactttttaagaagtttggcttttactctaagaaagaggaaatactaacagagggtttaggtagaggaacgattggtctgatttgtcttccaagggatgctctgctgagtgcagaatatcaagaagaagggaggtaggcaagaagagcagtgaggagactatcacagcaacagatgtgagatgctggcggccaggaccagagtgggagcagtggagacgtgtgagatatcagattcctaatatgtttcgagggaggaggcaacaggttttggtgatgtagactgtgagaaaaagataggactctaggattattggcctaagttaatgaaaggttgtcattgcatttactgagatagggaaaactgcagaaagagcaggtttgggagcggaagatcagcaattccaggtcagactttgtttgcttgagagagaatggaaagacagtgatttggagactacaggtgtagactttttgctgagacaaagtgcatgaacctggtggtatacctatagctggtaggggaaattggggtcaagaaagggtgttcttttttttaagtttttttttttttttgtcttttattatactttaagttctgggatacatgtgcagaacgtgcaggtttgttacataggtatacacgtgccatggtgttttgctgcatgcatcaacccgtcacctacattaggtatttctcctaatgctatccctcccctagccccccaaccccaaacaggccccagtgtgtgatgttcccctctctgtgtccatgtgttctcattgttcagctcccacttataagtgagaacatgtggtgcttggttttctgttcctgtggtagtttgctgagaatgatggtttccagcttcatccatgtccctgcaaaggacatgaactcatccttttttatggctgcatagtattccatggtgtatatgtgccacattttttttttatctagtctatcattgatgggcatttgggttggttccaagtctttgctattgtgaacagtgctgcaataaacatacctgtgcatgtgtgtttatagtagaatgatttataatcttttgggtatatacccagtaatgggattgctgggtcaaatggtatttctggttctgggtccttgagaaattgccacactgtcctccacaatggttgaactaatttacactctcaccaacagtgtaaaagcattccttttctccacatcctctccagcatctgttgtttcctgactttttaatgctcgccattctaactggtgtgagatagtgtctcactgtggttttgatttgcatttctccaatgaccagtaatgatgagcttttttccctatgtctgttggctgcatacatgtcttcttttgagaagtgtctgttcatatcctttgcccactttttgatgggaaagggtattcttaagtagaaagtatagcctgtttgttatccatgcaaatgacctctaaggaatggaagaatccagcgtataagagggatcaaaccaaatatggtggctcacacctataatctcagcacttagggaggctaaggccaaaggattgcttgagaagtttgagactagcctgggcaatccctatcatttctgcaagggaagtatagtatgaatgctgggcagcagtgaagggcccacctgaggttagtggccatgattttaagggtggtttgcatttctctctgcaatgttcagctgttcaggacacaggcattagaataggtgaagaggtggttttaacaagggttgaggtcttgtcatttgcatatgatattttattatagaggaattaaagggtgtatatgaccctggaaggcatgaataatggtgcgtggttaagaatgtgtgttaggatgtaagggaagagtgtgagggacaatataatttgaggagaagcttcatgtgtcctggtgaaactgatgagaacactttgaccctaccttgggggttaagtagaggataacaatgcacttgagatgagtcaatcatctgaaataatcatgtgaacacttagttgcaccaaagcaaaaggaaaatgcacaattcatattgttagtggaagatgcagttatctattggggtgtgtgtcagtgttttccatccttttccaaatgacaccccatttgccaccatgaccctcatggtgcagactacacaggctgctcaattttccacaatcatgtaagtttgtaaaatatcctcaagattatatactgcttgaatctactatgttgcatgtagagtatttctagatgggtaagaatcagatcaagtggcaaggacgaagagagatgtattctatattgagcatattttctatttttcgaggctctgcctggaaaggggacagaatgctcagtgttgcctcattttctcatcaaacttgacactagttcactggggaaattgcatttccaagttgttttaaatcaggaagttgttttaaaatcaggctgtgtgtttgtgtttgcactgttgccacttaatccttgatcctgttaaatgtttcttccatacagaggaacataaacaatagcggctttcttgatttcctaacattcatgtaaagataagttggaaatattatatttaataaacgtaaaatactgtaattaaatgtaaacagaaaattcaattaccattttggtggattgttggataataacattgaatatttgtcacagtagccatttggaagagaatacagattgagttattgatgggatccaagttgacattaattatttcattagaaaaatatatttcttctaattcttagaattttttattttaaaatctggtatgatcaatccgtttaagaccagcaggtctaaactctcccggactctaggactgccatgtttgaatacagttatattgaacctttctgccttttctttttttttttttcaaataaatggagggagaaggatgtgttttatgaagattatgccttacccaactttaagtacctgcatcttcttctttttttttttttttttttttttttgagacagagttgcactctgtcgcccaggctggagtgcagtggcacaatcttggcttgctgcaacctctgcctcccaggttcaagtgattctcttgcctcagcctcccaagtaactgggattacaggcacctgccaccatgcccggctaatttttttgtatttttagtagagacgaggtttcaccatgttggccagcctggttttgaactcccgacctcaagtgatccgcccgtcttggcctcccaaagtgctaggattacaggtgtgagccacagcgcctggcccgtacctacatcttctaacattgccttatttaccagagtgaaggcttttgaaatatttagatgtctggtaaacaataaacttaaaaatattgagttcgttaaaaatggaactcaaatgtttatttaaattctaagaggctttactgttttttgaaatatttgaaatgtttagaatagttaccaacatgcatactttacacttttgagatgaattatttctaattcaaatgtacttatcagtggtccaatgaaccccgattcctattacactgtgcatatattaatgcttcttgctaagtgcccacttttaaaagtttatttcataactatataaacaggcatttggggctcctggcctcactgctgcagagtgtctggaatgagcatttgtagggtcagttgtcattatcttggtcacgatctttggagtgctgtattcccatcacctgctgcacatagcacaaggtctgggtgtcacaaagacatgacgtgactcttctagcatctgtgatactcttgagtagtaatttcagaatacttagtgaaaggctcgaagtgttgaaatacgatgaagtctggggagttaacttttagcctcgactttaactcatttattctgtgccaaagaggaatttgggggagaggttgagttttcctttgtggtagcctggcaggtgaggacaaatccacttactctcctctttcctcagctagaagagacgaggaatggaaggagatttgatattccttaggaattttattaataggaaattgcttcttctttaacaatgaggatcataacttcagctgagattaacttttaagggctttattaaactgttttagccactagcaacgatttcccttacacagatacatttagattgactttgcacatcttgaaaataagaaacaaatgaaaataccagagtatctttatatgtataagttgtgaaatttgaagtctgcattacttcttattggttcagttttcatgggattatttatgtataggagcagccaaggaaaagaccatagcagatttttgtaatgatggaatgagattcctggcctgtcaagccagtaggtgtgggactatggagaaagttcctaaattttagtccagttatttgaatggaatcttgaagagacatttactattcatagagcaacctgagctcgaactgtaattttgttctagttgggcagtgggggaagagaagagacttgaaactagtgttatatgatggacacgtcagtgctgaaaattcacggtgcctgaggtaggttaaaccttcctccaaccaatggtttccatgcaagctttttaacacagtgatgcctatcctatatttttactatttgcacatattacgagcgattgaaggatgttaggaagctctgacaataaaaatggttttctttaatgaaaaaaaaattctgataccgtgagaagaggacagatacatcttgctcaattaaatcaaaatgtgtgggacacctcatttctgcagttgcagaaatgctgaaagtcactggatacttaaagcaatgaaggaggaagaggttggggttgggaaaagcaaaactgataatctcctttgtgaagacatcactgtaagaagcaggtggtacttactgaactctggagagaatggaaagtgtgaggacagcacagtaaatagaaggaaaattcccttagcagtccactttccaggcaccagtcacctctggaactttaattagaactcaaaaatgtgagtggaggaattagaacagaggcctttctatcttatatttgaaaagtatttattttacttagaagcaactttttattaattaaaagcacatcagataaatcctaatatttgaaacacctccccatatttaactaattcctcattcttctagacaaggaaacattaaagtaatttttacacatcaacatatacttcagaagagaaaaaagaaaccttcattaactgaacaaataacaaaatatgactcaacatacacaaaaaccagtgtatcatatttttgcatatattaactacatgttgatgtaaataggaacaaaattattccaaagggagggtgataaatatgtgggttttagatttttcatgtttttaaacatattggaaatgtaatgaaatacaagttgattaaggtgatctctgtagtacagtggaaggtattaccctaacatgtctaattttggtatgtgagctctgatcttctcagtcatatgttacaaattcacaactgagttttcttttttttatgaatttttaatttttagtgaccaaacttcttagttcttccccctacctcagcatgtctgccaatatataaatgtttacatatactaaagaagttgaatatttaaatgaagttttaggtgaactattttaaaaaggaaaattttttcccttaaaattgtgattataatcattgtgtttataattcaagcttttctgttttaggtttctttcagtgagacatgtttgtgtagcactacactgaaaaaagatgattcttattggtatgaaagttattttggcataagacattttagatttctgatagattctggacttatggagcaatatatatgcttacattcaaaataaagtttatcactgtgccccttttagagcatgtgttagaaaacagtggcaaaatgtgatcccagagttagggttctatttccaggggaactcactaagccctcttttacaagagcataaatgtttacctaagcaagaaggtgaaatctgttatgcccaataaaggacattttgcagtgctggtttacggaaaacattcaacagacagtggatgttttacataaagtacagtgcgttgtttgaaactctttgctcatctatacactatgcttaaaataaacactatctgggaatatacccgtcttttttctacctcccttattccacaccctagattttgtcacctgccaaagtcaaataaatcttatctaaacagttgagataagcgccgagtcgtacccagtgtggtcaaatcaacaaacctctccaaaaacagaaatgaaatacaatatcgctagattaaacagtctacaatggtaatcatgtttgcatttaaagattttattccaaaaggatcacagtcttggtatccatttttttccctcctgcctagacaagacggcgacatactgactcaaacaaaatgcatttgttctctaacaatttaacttgtacagctcttataaacaaggcccataggtgtatgaagcctaccgacttaatcagtaacttatgtcgttaaccttgtataagcaagtatgcttgagatgtaccagtgttggattgtgtatgggatttagttttttcttgcaggaaagcctttctttatgtagcctgagtgcaaagtctatggcattctgggattttattgtctgtatcttacagtaaagctccatcatgctaaactgttcaaaaagagaagatagtacaaattaaagtgatttctaaattataggatattataaaaaatgcagttttcttccttcctaggacatatggtattttaactgtttgataacaaggtgtaaactctactagggcaggaaccgtgtctgtctggtttatgctgtatcctcagggcggacaagagtacctagctcagaattagaattctgaatatttgttcaatgaatcaatgatgttttccagaagatattctgtcttctctgtggatgaataaaaatattttgtaattattacattaatttctgatatttaaaagcatgtctctcgagagtacatttttgtcttacagtttttaataaatggtctcctttcaatgtcgtaccatttaattagcaaaatttaaaatacgcaataaaggaaggacaaatgacacaatatcactcattttttggtaatatctctaaggtactgtatttgtgcatttcttactgtagagcaatttatacactgactgctggtttgaaaataacccatttttccattattctttaagcagatcttcatttactttggttcatgaaattgggaattagcccagttgtatatagatgcgtgatttgaatatactgtccttttatttttaaggtccaaacaataatacgaaacttatagtcttattttctaatttatattttgctttatgagagcaaatatatctacaaaggtatatgtgctatttagacattgaccgaaaactgaagaacctttcattttagagtgcctgctataacaaggactgttttccacacaatagaggagttacctctaatctttataatatccatttaaggggataataacattaccactgatatgtctatttcccatgtgaataaaccaaagctcatagagcttaccaagtctctccaagagatgcacagctggttagtcacagagccctgtttttagttcaggtctatctaaatccaaaacacaaggtctaagtctcatgtaattctggagaaaaccacaacttttgagttattatattggtgagttaagacttctcagtaaacatgttactgtttaaactagagcttttaatcagaagagagtaataaaatttagaagtcttacaaatacaaggaatagaacgccactatttaaatttgggatcaaaagaagaatgctgttggtatatgtgccatttaactggcctttatcatggtctttagataatccagaattacttgaaatattactcacgagcgtgtgtgcagggtttcaggtgtatgttaagaatgcctggcagcacgtcttctggcaagatgcccacgtttgtgtgcatactcaaaggccccaggtttccaggtgcccaagcatcttagtggtgagatgcagaaagaatgcaagtagtatttcctttcatcttatcatcgagtgtaaaatgttccgatgaatatggtagcaagtgtcttccttcctttgaaatatgagttttcatcagctgttggatatgctcacgtaactaagccaagcaaaatccaacacaaatttaaaagttgcttggctacctctttagaaaatttttgttatgtaatatacattttggaagtttttaatgtaactgcccaggtgtgcagattttcagctggagattgatgcatcagcattctattccttagaaaacaatgctgggtgtgactcttgactcctttcacatccagttgcacagtgacatgcacctcccgaaggtttctatgctttattgagtttcaaataaagattgagggatgatagttctaggcatttctgccaagctgtgtttttcttttttttcttcttccttcttacatcttctcagcagattaattagaacagtaattgaaataaataaaaattaaggcagccctgaaaataaaaatgagccttttgtatccaccacagattatagatgcagaggaggaaaaggaggcttcttcccctagtaatgtctgtctgttgctcttttctttgcagttcctctcctcattactatttagaggctcatgcttgtattaccatttgcagcagggatttttgcctatgccagtatttatttggctttcactttctcaggcatttcggcctttgtgcatttctggagccaataaggcaaatgtgtgagtggtggcatcctttcttaaggttacctattatgacttttccctggaggttcagcaatgacttttgtttttcacattacacacttcttcagttgtctgctatatgcaggacactctggcatgatacaataatgtctaagacaagatccctgctattaggctcttaaaaatcttcttggagcgaccaaccacatacttttatacaatagagggagtagctggagtgtatcagatggcttttattaatgttaaagggtggaatccaaaggtagggaaagtcatgagccttggtatttatggagtgttttggagattacttagactggagcttgaaattgctattttgttagaaacagcagttcgtccacatttagagccatactttccagtttccctttccttccaggtgaccataggaaactgatccggtcagtgagatgtaagtagaagtctcctaaaaatttatgatccatcggcattgtgcatttcttcttgttgctttcctctttcctccttcgtctggcctggaatgtgaaagtgatggctggtacagtagcagcaattgttccaagtgaggaaaaggaaaaggcatgtgaagaccacttaaaaattttgggccctaacatattttatcccctgaatcaatggcaacctaccttagctttgttcaagtctctatctactcagatattcttttacttactgctgaaaacaattttttaactgattcaaatgtatttagcactttggccatattgtcatgtgggtaattgtcaggatttcattcatatttcaaataatcttcatcactatattctaactagatgcccatatcactccctaatatgagccaatcttttaagctgggggggaggattgagttagaaacaaacagtcaggaatgactgacattttccccctcatctagaccctgtgttttcattttacttcctaataaactcaaagatattggaattcagtttttatttctctttaattccactagaatacagatgatagcttctataaaagcactttcccttccccagctgtccactcttggaattctttgtccatctacacaacttttcctcaactttatattgttttgtcttttaacacctaaagacaaacacaaacttagctaggtaagaagagggaaatatttctactattagatgaaggattataaaagaaaggcagagaaactttctaagttgtaatctgtcttctagcttcagagtccctcaaatttttaaggaccttttctgggtccttaaaaacgtaaaaactaataggcaatgtagtgagtaagttctgtgaacagaaggatcaccagggacacagcttctggctgggctagagtgtgaaccaagtgctttatatctggcaggcatatggtcagagggagtacgtgattctatggtttttgttaatcttaactcgctgggatctactctcaggaactggtcaaccttttctttcctgttatttggatgttggccttcctaaatttgtctaaatttcttggctttttcctcttcgtttcctttttgatctacttttgggaaattctcacatgtatttcccaaatcttctattgggtttttctgttaccctgttttttgtttgaagaaacattttgttcaattaggagggtgttgcaagaattgcaggcaataatcgggaatgtctgagaatggggtggtaggggtgggtgtggtgaggtgaagtcatattctggatgtgtttggaatgtgaagccaacacgattcatgatgtgttggatgtggaaggtgaggggaagggaggaattaaggacagttcctctgaacaccaagcagatggaggctccgtcatgtaagacagaagaacatgtatagagtgtgctgtctgttagacacccaagtggtgatgctgagaaggctgttggttctataagtgaggagttcaggaaggaggtcggaagctggagatgaaagtgctggagtatttcaagcccaccgtgagactgggcgagaccaccaaggcggtgagtgtagatagaggtaagaaagggtggcagtagtgagccctaggacattccaaaaatgagaggttagggagagaaagagccagcaggggagactgaggaatggggaacattagaagtaggaggaagaggaagagagagtggtatcctggaagctaggataaatgtttagcacgtgtatcggaaggaatttataactgtgtcacatgctgccaagggttgagaaatgtgcatttggatttcacaagatctaaaacactggtgactcagtaatcagagcaaagacttgatgagtgggtttaggaagtgatgggcagagaagaaggtggggacaacaagtattgacgacactttgtaggagttggaagagttttactgctttatttttttttcctttttttcccccgctctggtttctaacatcccttgtagaggcttcccatagatgatttgatccttggctgtctgttcttgcttaagtctaaaaggtgatgagaagccctgagtcttcatgttgggctcttggactttgagttcagtgtagcattttcggtgtgggttttttgtcgggtattcacccatgtctttatcttttggtcttttttcctgggatggagagatttcctggagacttcccatttctggcttggggtgtaaaggcctgtctggcagtgttctggaccctaaattgggggaggagggctgaatggaggtatggaggcttttgtattcaacatgcagtactccacatggtccctgtgtattcagcatagcaacctatcctacaattgtgattgctgtgtctttgtccagagacttagatttaatttctcaagaaaatcaacctgatgaagttgggaaggactttttcagaatgagcatgtaactgactgactggcagcattcatccagtgctccttgtttctgatattccttgctttaccctcagttggacaagtgcctgttgccagttccttggccttcagggttggtgctcagttttctcagtgaaagttatggttttatcattttaaggtctacgaaactgagtagagctggcttccacattttgttgctgtcatctcatcttctttcttccagtccttatgggtttacttttttaaatatgtttttactatagctttagtgaaacttcaggagagaacaaaatcaaatgtgtgtacttcctgtgccatcttaatcagagatgcttcccagcagtacgtattaatacatatcacagtgcaaatggaatgaagcaatctgaatgttaggtgatgctattaagatttagaccatctatttagtagtcgttcactttcaaactctgtcactttgaggatcttttacacctgacaacgcagttctttctgctgtttgcacaagctctaccttgtgcttttattgtggtgtaattgttgtgtagttatttgtcgatgtgtctttctacttcactatactgtcagctcttctagatgggggagtgtgtataactccagattcccaaaatgttttgtaggacatttacaaaagagataacaaatactgtcagatacatttcaattacgcatccccaaaatgtaaaagtttctatttcactgaaatatacagtgaaacaaaaattaactgcttacatgtcctcgtcgtcctgattttaaagtcgaaatgacatgctccctgcagttcctcagagagatctcttacaaaatgtagtttcctggtagctagagtaagatgacaaacctgactcttaaatgagaggatgcttctgatctctgctacataagatgagtgtctgctcaaacaaaggtctttgcttctcagcagcttgcaaagctaacttcatcaaagcttttcctgtggcttctgtattttaaatggggtaaagatgctttcttcaagcccttatactctgccagtgaaaagagggcatgaaccgtaaatatgggctgatttgtactcattttgtgtttaagcttctgctgactctacttctctttccatgtactttaacccaaattagtgttaatggcttccctctggttacttgtttagtcttctatgttactatcagtacaactgaaactgtcatttttctttttgctgagaatgttttcaacctggttcatctgaaacctctcaatctaagatactgatttggagagagattaaaaaaaacattttccattataggaatgtgaaatgggccgtaataataatcacaacaaccaacattttctgagtgtttgctttgtgcgtggcactgcatttgacttttattatttaatctcctgcaagaactctgtagggcaggtcctcttcttattaggtccattctgcagatgaggaacttgagactctctgggttatgcagataataagttgtgtggtcactgtgccccactgccttccagtgccatcaggtggcaatgtgacatgacatattatctttgtgttctgtatttttgagctatgatgtcagctagagtgaagttagttatttatgaaaggacaatcagagtgatctcaaagaaaggtcagtttatccagtaaaattaaaggcagagttgattttcaggaattgctaacctcagcctgttttagcctttcagcattcgagaaagatgtttttccaagtcttttgtgtactgggttcttctagatagagaaaggatacaacagtgaatgaagcatgaccatgtaattatggagggaagggtctgtccatattgtctcacacgtctctgtatatctacagaacgtatctcatatgatctctatttatagaaatgatgaggtttagctgatttgataggttatgcctaaaccagaagccagccttcctgactagtgcactttttctttccactgaatcatgatgcttctccatgtcttttgtcaacctagagcctaataggagaataaaaacattcgaattaatgaaattaacacaaggtagagacccatagagcaacacaagttggaagctgaagtccaaggaacagagagccatgggttagcaatgtgttgtgatgggcagcccctcagatggtccctggagatccccaccttctgagactcacggccctgtgatattccctagcccttatatgtgggctacactcacgactcacactgaatagaatagaacagaacaggggtgatgggatgtcacttccaaaataaggttacaaagagaaggaggccctgtctcgtatgccctttctgtctcactctaagggaagccaactaccttgagagttgtctatgaagaagcccatctggcaagaaactgagtcagacttccagccaaccagtagtgagatgctgaggccctcagcctgaggaactgaatcctgccaacagcctgtgagtaaggctggaaacagatcttcctgcagagccttcagatgagaccgtagcccccgccaacactgtgattgcagtcttatgggagaccttgaggcaaaggcccctagctgagctgcacctggatttgtgacccacagaacgtgtgagataatccatgtgtgctctgtaagcccctaagctttggtgtaacttgccctgcagaaatgaataacacacttggtaataaacactgtgagattttctagtttggggcatctttaccaccagtttagcaggtcacacaggaaagattaaagtaggtgactgcagtggctgggataagtgttcatggcttatgaaaggaaggggccatcaagcacagccctgagagactgctccagtcctgtctcatccaacagatccctgattttaaaaaatatcaatgtaaggcatgtactaacactgttccatagcttaaaatgttgcattcaacaagagtaatcctatcatattgaattatacaaataggttgggcaccgtggctcatgcctgcaatctcagcactttggaagcctgaggtgggaggatcacttgaggccaggagttcaagaccggcctgggcaacatagcaagacctttttctctacaaaaaaattaaaaaaatagaaatattatctgggcatggtggcatgtacctgttgtccccgccacatggagaggctgagatgagaagattgcttgaacccaggagtctgaggctgcagtgagctatgatcataccactgcaccctagcatgggtgacagagtgagaccctgtcactctgtctctctctaaaaaaaagggattacacaaataaagtgaactacttaatctggctattcaaaatatgtgaaagatcaacaaatttgtctaataatgttttgttgaagtgctttgttttaaatgagttccttttaaggcacatttaaaataagtcctttcccttctgtgcagttctttgaaagtatagagacaggattcattttatcatgtaaacattcatacagatagattactttgctctctagcctgtgggtaattcaacatttgtagtaagttagaataagaagcatgtaccacatttctggtgctgacaaaggcagccacggaggagaacacgttaatagcaaagaccaagtgtccaaggatagacacctgcctgcgcacagtcaagagtgggactgtttcttatgttgagtctataatgcttggttgttttgaattgctttattcttttatttttttaatgtaatgcagtcatcgatcaaaatcttaaaatcaaaagaaaacagatttctttttctgtttggacattttgagacattttaaatatcttaggttaaattgacgattggacttccaaaacaggccatttcatttttcattttttaacagcatgctttaacaacaatgacattggatcttagcgagctcataccggtggagcaagttcgtaccggaggagttcatgatgagaatagctattgtgaaattaacttttaactattgaacgcaaatgtttagtcctgaacctagttttaatttagcacctagttttaatctaatttctgaaccaatgtgtttacaggtaacatacaccttaaaattaatcacacccattattccaagcctttctgaattatttttctactatataattacttattttccccacatgataagcatatgctataaacgaaagttatcccacttgataaagtctcagagaagtttagtgtcttgatcaaagacacacagccatttggtatgaaagcctgaaagattactatgttctactctctatctagacattggcatttgataaaatcgtagacaagaattgttgtctattttggtctggagtgatgtctgtttgtttggttttttttttttgtttttttttttttttgagacagagtctggctctgtcacccaggctggagtacagaggcatgatcttggctcacgtagatcttggcctaggtagatctaggccctctacctcccgggttcaagtgattatcctgccttagcctcccgagtagctgggattacaggcatgcaccaccacacctggctaatttttgtatttttagtagagacaggatttcaccatgttgtccaggctggtctcgaattctgggcctcaggtgatccgcctgccttggcctcccagagtgctggaattacaggcgtgagccaccacatccagctggagtgattagtaacacgtggtcatttgtaggttgtttaaaggaagtggtaaatatctccgttgttttaatcctggaaatgtagcatatttgacaaataagtgaataatcttttaatgtgcaaaaaaggtctatagttcctctcaacacctttctccttgaacccactcacataaaaacagaacagatgcttcctggttaaattgatttatatatatttttgagaaagtgattaaaactgcattgtagacctgcagggggtgggtgggggtgggaattgtaaagagtcgcagacaaggatgggtgttactcagcatcttaaagcagcaaggaggaaatgagtgtgagatatctgacctccaatctgaaatgtaatcacattaacaccttgctgaatattagagaataaagtaatctgaactaaacatttatcactgaatattcttttaaattttggatttatctgaaatctagtcttctgcttaatcatttaaatgctaataaacaagacagagtataatgaagaagcccaggtagttctgtaccaggctctcttgtttcactctaatggtttatcattcaggtaaaggttccatccctcagtagatgcagttggaatggattttttgtttttcttttttttggatacacggggaagctaaaacacaaattgaaaaaaagtcaactcgtttaaccttgggcttcatagcaaggctcacttgagcaggaaggatgttctaatagttgaatttatgtgaaaagttggcatggggaggtaacattaaccaactacatgtcagacccttttacttgttattgcctctaagccccacaaaaaccccaaaccaaaacttggctaatattttccattatttccttgcccctgccccataaaggaactgaaacttataaaaagtaacttacttgaagtaatgcagcagcaaataaaaatttaaatttaaacttagtttagttcgattccatgttctatgtttgttccacatcaggaaacagcatcttgtaaaaataatattccctttggaggaactgtcaccttgatataatttcaatactcaggttctttcctccgaaacaaggctgaaattttggacttggaaccaagaaatttctgaggagttttttctttgaatctttttgccaccgaaataaataaatacataaataagtaagtaggtaagtacataagtaaataagtaaaaaataaaaaatgcattcagtcattcttagcatgatctagaactctgatcatggtattctcttctctgtgcattaccagttgtctgcagactttcaaggctgggctattcagcatattcccacccaaatagctccaacttcaaatcattattactcaagtaactgttaacacttctagtatactagtgtaatccctgatgtataggaaacacctcacatttgttgaatacatttgggaatgcttatttccttgattttagaattccatccattgaaaatgtaccattgaccaaatcacagattttaaggaagggagaaatggaagatgctactaaacgtctagtaacatagacattttgatctaagtcctgatttctgaaatgttagcatatgctttttaaactggggaggaagtatggcacttcgataattgtaatctttcccaaattgcttcttttacctttatttcctgtctagaatttctatcactgcatccattcatctgtcagtatttaatctttctttctttttggctacaaaagcatgattagattttgccctgaaaactgctcgttcccatttgaattgtgttaatttctctcaggtcaactagggggaagttatatggagaaacagtaacagtgctgctttccagtgagattttctgtggatgagtaaaaaatgagatttcatgggttaggaccctttgagaacttgtttaggagcacataacatgtattaagatattcattattaagaatattctttcgatctcatgtatatgacattgcatgagatagaaagatgagaaacctcaggatattcacaagttttatgtggggaaaacttgtgggtataatagtatggtttaaaatgatggataaagtcaaaggacaactgtgtactttatgagctttgaattgatcatgaatgattttattgtgtttctttgccttgttctggggatgaaatctgacaccaagttgaccccttgcatttcctttatagttttcttatcatgtagagaattactggattattagctagctgatgaattccaaaatcagaaacctttggattcactgtaagatattcttgaagagctagactctgcacaaattgaaagaagataattccatacataaatttactgtttttacttgggttttgtgccttttcttacatattatcacagcaaaattattagctaatcctttttaattaatttttgaaatatagtcaaaggtatttggactgtgcctttactactttgaaacattaaagttcacgatatttttgccttatatggtctaatgaataagatttgtctgagactcttactcttagatatgtatttcacacctaatttttttggaaattgagatagtggattattattagggtggaagtatcatattctacttggtacaatattttttggtgaatctgggctcccttcccagctccaaatacaaatgctaaattaccttgtttagatttcttatccatcctgtgcttcgatttcccacttgtctttttaaattctttcttgggattttgccagagtcaactagaaaatgtctcatgtgaaactttgagagaagagacattgtaaaatgcctcttatcaaaataaatatatccagtttgtgattattcacttggtgatttttgtcccggaaatttttaactccccaagagcttcactggctacttggcacaaattctatcaaggcaaattcaccttgtttctaccaaatatccatgtagaaaacacagaatgatttgtattaacctatgcctaaagcaagtaataaagcacacctactccaaaatacaatacaaatttccccaggcaacaaatgcgtaaagaaaatattgctgatttttctattatctatcctgcttcttccttgtataaccatgggtagtatatatttgaaggatggatttttaaggtaggatctgtgctaataccactaccaatataaaagattcatcctttgattataatattttgaggaattataataggaaatgcccccatcatttttatactaagtccatctgtttaatgattaaatttcacctttgtcaaaggtcctagatatactggtgaatttaagcatttattgatataaaactgggatgtagcattcactggagtgatttgcttattttgctggtatgaagcagatttttcaaattcattcagttcggctgtgaaaaacagacctcacagtttctctctgacctttgcctgggccattttcatgggatttagtatttgcggagcaagtgaaagctttaacacttgacacctggcccagcgaaattcctggtgcaggctttgcagtgggggcaaggggaaacattgaagttaaagcccctgctccctctggctgctgagccgtgagcctgctgcctgagatggtcaaacatcttttcacaggtggcttatggcaatttatattcttcttttttttccacagctgttgtgaacttggataattctgtggttgacctggagacccttcaagctctctatgagaatgtgagtaatagaaggaattttatgtgtgagtatataatatgtacacagtacatgtctatgtgcacatataggctctttgttttaaggtcctctaaagaaatttgatccgagtgtagtgaatttgcctaagtaggtgtttgttacaatactttctaggaacatatcaaacaaatgtgtggtctcatggtttgaaaaattgtgaatcaaatcatattgcatatgaggtcattcattatttttttaaatttaaataatagtactgatgtgggggctaacttgagccaagcattgttctgtgcacttcatacacacacacacacacacacacacacacacacacactcacacacacttaaaattttaaaatatgtaactgaaaaagattgaatacattcattccaggtgtatgtattgaacatattcatgctgagttgatatacacattgattaccacaatcagattaacacatccatcaccacccacacttatatataagatctctagaagttattcatcttataactgaaagtttgtaccttttgaccaatatctccctattttcctacctcccacccctgggcaaccaccgttatgctttctgtttctatgagttcaagttttttagattccttatttgtctttctgtgtctagcttatttcacttagcattatgccctccaggttcatccatgatgttgcaaatggcaggattgctttcttttttatgggtgaataatattccatggtgtatatgtaccacattttctttatccattcatctgttgatggacactggttggttttatatcttgtctcttatgagtagtgctgcagtgaacatgaaagtacagatatctcttcaacatacttttcatttcctttggatgtattcccagaagtagaattgctggatcatatggtagttctgtctttaatattttgagcaacacctacactgctttctattatggctgtaccaatttacattcccatcgacagtgtgccagggttcccttttcttcgcatcttcaccaacacctgttatctctctcctaatagccttgccaacagatgtgaagtcatagctcactgtggttttgatttgcatttctctgatgaactgtgatcaaatgctattattatcacccctgttttacatgaggaaagttagagaggttagatgacttactcagggtcacatagctagtgttgtgatatagctggggtttagttcattctgcctgtttctctatactgctacagtttatttcactaggtggcaggacatttagcttttgttatgtagtactttttttttttttttttttaacaaaggtggtagagaaagggagtaaggtattgaaggagaataaccatagcacgatatagtcagtgctattgggaagtgtgatatgagagatgtctttagctagaatgtgacattaaataatattgattcaagtagtaataaagcaggttgttttcagtgcttttgattatatttaaggtaaagtctcagtgtggtcctattttgggtctaatatctttgagtgcttttttttttttttttttttttttactttatttctgttcttgcctttgatctgcctggtatttaagcctctgctctttggggcatggccttagttggtccttaacttttctgtctcaagtcaaataattcttggctctggggagacccatgtggtgggcaggatgcagactctgttccttgatcactcccttgaggactgtgtattcaacctgctcatccactcttgagtttggttttttttttttaacatatgttatatggtggtctcatctgtgagattgagaccgatgtaagacaaaatatgtctcatggtgcattgtacagaatctgtgggccaagtgtagaattggtacccattaagcatggtgagcataagcattcagtgaaactgagtcagaaacaaagattgagagggaagctttcagtgatttattatacagttgtcactatgcaaagggaaaactggaaaaagtaaatcgtgtgtttagtatattcacattccaatgaaattggtatttaaaatataaccattgggaggtacagagagttttcatttctcttgagtctttcatactaaccctcttccaaccaggagggccatatggaagaaaggaggaaatactagaggaaagtaatttcttcagcaggtcataatgatttaagatgttggtgtgtgtgtatctatctatcttgcacatatatattacatatatacatttggtgtatacatggtgtgtgtgtgtatctatatgtgtgtatgtgtatctaggaatgaatgtcttatttacacttgatgtatttatgtgtagaaatatacccagaaaatacagaacattgaatgtttattttatgatggtttagaatattttatttgggctgggtgtggtggctcatgcctgtaatcctagcactttgggaggccaaggcgggaggatcacgaggtcgggagttcgagaacagcctggccaacatggtgaaaccccgtctctactaaaaatacaaacataagccaggcatggtggcccgggcacgtgtaatcccagctactcgggaggctaaggcaggagaattacttgaatctgggaggcggaggttgctgtgagccgagattgcatcactgcactccagcctggtgacagagtgagactccatctcaaaaaaaaaaaaaaaaaaaaaagaatattttatttgggagtgtttagcctttcaaagtaaagtaatttcacaaaatataaatttatgactcaggacaaactggatagctacccagaatcttatcttacttcatgaaagtagaaaaagtactgtgtcttagtctgtttgggctgctataatagaataccatagcctaaatggcttatgaagtgttatttctcccagttttggagactgagatttccaagatgaaggcactggcagatttgggatctggtgagggccctcttccaggttcacagactgcggtgttcttgctgtaacctcacatggtagaagggacaagggagctgcttggggtctcttctacaagggcactgatctcattcaagagggctctgctctcatggcctaattgcttccaaaaggccctaccttgataccatcatcctggggataaggtttcaacctatggaactgagggtggggcgtaaacattcagcgtatagtatactagctggcactggttaaacttaattacaatttttattgctgctgttctcaaactttaaggttcagactttcattgtttcaggaaaacaattattttgtgagagggtgattcacaattattagtttaggtagtaccaggttagccctctgcagtacaggaacttgaaggatccgttatgaacaataacaggtcattgtgcgtattttatatgccaataatacatatatgcaaattcctgattaatatctattaaaaaataagtcttgggaaggcaaaaatagttgttttatccacagcaatagctccagaacctagagttaagtagtatttggaacagttcttccctaaacgtcctgtatatcaggggtcctcaaccctcaggccaaggaccagtaccattctgtggcctgttaggaactgggccacacagcagaaggtgagccactggtgagcaagcattactgcctgagctccacttcctgttggatctgtggtggcattagcttatcataggagctaggagtacaaacccttttgtgaactgcgtatgcacgggatctaggttgcctgctctttatgagaacctaatgcctgatgatctgaggtagaacaatttcatcaccaaaccatccccataatgccaggtctgtggaagaattgtcttccacaaaactggtccctggtgccaaaaaggttggggaccgctgctgtctatgtaagacattgttgaaatcttatagtactcctttcttcctttcctgggaattttccactttttgctttatgttatctttatgtatgcatatgtcttatcttctcacttaactacaaattccttattagttgaattttttttttttgaggtggagtctcactctgtcacccaagctggagtgcagtggcgcagtcttggcccactgcaacctctgcctcccaggttcaagttctcctaccccagcttccagggtagctgggattacaggcacccaccgccacaccgggctaatttttgtatttttaggagagactgggttttgccatgttggctaggctggtctcgaactcctgacctcaggtgatccacccgcctcgaccttacaaagtgctgggattacaggcgtgagccaccacacatggcctgagtttttatattccatattgaacaatatggtttgtataaaatattcataataattactacttaaacaatgacctgagaatagtaatgttttccttttggtattattttataattgacagaaatgaaaatggttaatgtcattatttacatttcaaatgctctgctttttttaaacatcagtataaaaggaaatctggctttcttaaaaataaggtaatttcagaaatatttctgcagagactcagaagtgatacctttaccatggataaagctaaccattgctatcccagcaataatctgatcccgttatgtgtaatttttcaaacaatggtttaaattcaaacggtgacattctattttagggcaaactgagtagatttgcttccttcttgttgatgtaatttcagacgtgattgcctcaggagcccctggaattgctaaggaagctctttccatttcccatgttaccttagatcttttgagtgtccgctggactgaaaagaagcttgagcttccttttctcagtttatactagataatgcatactgcgatgaacccaagatggacctaagattacagaactagtagtagtttattttttggtgcacaaagcggaacaagtttttccatgttttcagttgctaatagactgcatttttacgcaagactagtaggaataaggtggcgcgctgtatgaaggcacatttgtggtgtaccttggctggaggccttcctacttcctgcagactctccccaaactttacagctatgtaatagctagattaaaataggccactatttcatctccatgtgacatgaatatgtgcttacatgttccatccctcctctatcaccccaaatcacacaagggtataccagaagttgtagttccaactgcatgaaaccaatatggttgctattactaaggggactgggattctaactacctcttttcattcatgctgtatcaggtaagggaaggctaggaacccagtgtaactataatagaagtttcatatgatctctatgctatttaatcccattaaatgactgttgaatgaatgaaccctttgaaacgggagctcagcatggtagaacgtttaggcaacatgtgatgccagcttcttttccatgcattttcctagattcccaacttacaaatataggaacattaagccatctgatttgtatttaccattgtttcctcatttgtcactactgttttctctttgtctaaaaaattctatgacaatctttgtacccccctctgatgttccaatcaaagagctcttctcactttgtactagtttctttctcctatctctcctttgttatagcatgctcagatgcccatcaaaccgaaatgaaaacaaaataaagagacatatataacttaccttcttttactcattgtttctttcattgaaaactatttctagaaagctaactaactgtcatgcagtttgctaagatcagtgctaggtagtatattaggcacatgcatatttggaatcgttttttctcttggatgttgctttttatcagtatgaaatattcttcttcagtttagtaatactctttgtcttgacgtttttttaaactgatatttaaatagctattctattcttttgatacttactgtgtgcatgttttttttttttccaactccatctgtgtactttcaacttccctgtgtctctgtgtttgaattgcatctctcatagacagcatgcatttgggtctgtgttttttattcattgtgataatctttactttcttggagcatttagattgtcaacatttattgtaattgttgttatagttggatttaggtctgtcattttttgtccctctaattcttctttcctaccttattatttacatggtattttttgctgttttgttttaacttttatttctattttttttttttagcttcacctctttgtgtcacatatttttcagttatgctaggaatcacaatgtatattcctaaccttttatactctacttagatagaattttcatataaaatatagaaaccttgactccatatagggctttttgctgcctctcctgctccatttaacttattttgttgtgacgtgagtagcatctgtatgtgattgtatttttaaataattaaacatatttaaatatagtttttttatatttagctacatttcccccatttctgaagctcttcctttgttaagaccaagtttccctccagtatcattttatatcgtttttctttagcctaaggaagtatctgtagtgtattttgaaaacacatcttttcagtgatgaattttcttaattttctttcatcttagaattttttttatctcaccttccttttttttgaaggacattttaaaattggatatagaagtctgggttgacagtttttttctttcagcataataaagatatcccaattacctccgatctaccttgtctctgatgataagtctgccatcattgttactttgtattaatacataaattgtcatttttttccccttctactgcctttaggtttttctttttattgggttttaatcagttttattgtaatataagtaggcatggttttcttgtattctgattgagtttgatggacttcctgattataattgtgatttttcaccacatttgacagtttccatctctcgtccttcaacctgaaactattcttttgtactctgttctcccagtttctctcctctctggcttactaatgacatacatgttacatcttgagtactttttcacaagtccctgagattctgttcattagattttccatcatttttttctttctgttcatcatattgtgtactttcactgattctttcttttgctgtctttattcttttattcaacctctcaaatgaaaacattttatttctaatgctataattttcctagaattttcattaatagttctttttttgagactccttatctttgttaacattgataatttttgttacaaattgaatagttatgttcagttttttaaaaggcacctacacacatttaaaagataaaccagaagctagaaaaagaaatttgcaatacctgggccctcagaaaatcgggacccagaatattgaaaaattcttacacttatcaagggacaagtccaaagaaaaatgaataaaagagataacaaggcaactcaaaaaaagtaaactggtatgtccaataaatacaagaaaaagtgtgtattctcaatagaaagcaagaaaatggaaataagacatcagtaagatacttcttcatctccagtgaaaaagtttgacagtatcaaatgttgaagagcatttgaaaaattagtaactattatatactatattaatataatttggtataatctcaatgggaagcaatttgcaatatctaatataattagtccagtaattacacccttagtcatacattctagagaaactctttcaaaaccagttttccaaccatcagacacattaatgggtccaacacttgggtctagtcagatttgcctgatatctaagtataactatcagacaaatcaacctaggccaaaagattatgaaaattaataattagagtttcaagctactaaagtttaatttctttcacataaaaatgttagctgacacttttcccatacatttttatgccctatatggatataaatatagtgaaaataaaaatagggttatattaccattatacaataatatagaaagataatttctatgtagagcaagatatttgtttttgttattgtctctatgactaaaaaaaaaaaatcagaaaattaagtaaaaagaagtatatttcccttcttattccaggaaagtaactgagccttttgtaccctgaggctgcgctctcctgcctcagatgatctttggggaccttggtttttcttgatcacaaagagaatttgctttgtcttcgtcaagtgagagagactgattataatagttaaagtagctgacgtgctcacatctgtatttcttcatacagctttgagttatggtctagtgtcctgtcatttcatcctgcaggactcccttgagcatttcttgtggtacagatcgagtgataataaacttttccagctttagtatatctggaatgtcataatttttccctcatagtcaaaggatagttttactggatatagaattattggttgaaactttattttgtttcagtactttgaatatatcagaccactgccttctggtctcccaaatttgtgacaagaaatctgcagagattcttattgagcatttcttgtgtgtgaccagttacttctttcttgctagtgttaatattctctctttgactttgtctttcaaaagtttgtttataatgtatctcgatgtagggctctttggattaacatcattttgagttcattaagcttcttggatgtttatgttcacatctttcatcaaattggacaagttttcagccattattttttaaaaatatcctctctgttcctttctctctttttcttctaggacttccataatgcatatttggtctgcttggtggtgtttcacggcttcctgaggctgtcttcacttttcttccatttttctttttctgttctttagagttgatactttctgatccatcttcaagttcatggattcattcttttgcttcctcaaatccgtctttaaattctctttgtgcattattttatgttagttattgtatttttcagttcttttcagttattgtatttttcaccttctttttgatttattttcaggttttctatctctttattaatattgccattttgtctgtacattgttttcttggcttgctttctttagttctttgagcatatttaaaacaaaatttaaaaagcctttgtctttactctgccatcaggtctttttcagggataatttgtattgatttatctttatcctttgaatggtgcatacttttgtttctttgtatgtcttgtgattttctttcttttttattttgaaaagtggacatttgaatttaacaatgtaattctggaaatcacattctccctcttcccaagggtttgctgggtttttattaattgtttttatttgttgttttttgatttttgtagtttatctttgtgccaaggataagcctgaagtgtaaacttaaggtcttctcagggcatttttcagcctgcacctttccctgggcacaagtggtcactttctaattttcccgatatatatacagttgcttttaaatgtcctaatctttaatgtctggctcccaaaaggtgggaaagattaaaaggaatcatggaaaaaagagggctctggccgtttaatcccccagctgtcacttcaaccagataaggaggggcaactacagtggggggacagaggctcaacaatggcctcctgcttctttgtttgcacctgagtgatcagaagcagtaatcagggatcagagcacagatcctttatatttggaaggtgaggacattgggaggttggctcactttggctcctgcaggctgtgtgcaggttgctccagaagcgcgtgcacagctgcctgccacagggccgggagtgggggataggtagctgctgatctgctaagagctgacattgactaaaattaactgtaatttaagctccaagcctttctttggaagttgtaagaccaacagtagaccccaaagtttccaacagattctgctagtacaattgtctagatggggaaatagatccctggcactttctactctgctatcttcccagaatcctttctggggtttctaattttttcattcattcttaatatatttttgttcatatcatggagcatagttataatagctgcttttctaaagacgttgtctgataatatgaacatctgggtcatcttgaggttggcatctgttgattgtattttcctttgagatttagtcagattttcctctattttggcacattggataattttgtatcttggacaacatagtctgtgtaactgtatttaatcatttcttttcatttaacatttaaatgagcttattactctctgtaatacaagatatattcaatctaggttttgctgagaaagaaactcattcatttttgaaagcatgcgtttcccagtattgtgtttttcaaactgggttcagtgaaacactattgttttgtagtctatagtaaaaaacatgttgcataatcaaacaggttaaaaataagttaatcaaataagttaaagttaaaaataaaactgtgcagagccataatgtatgcctaataaagtggtagtttccaagtggaggacattttaaactatattcttccttcaattaaattattaatctagtgaaaacaatagtattacgtggtttggaaaatgctactatagtgcagtctaaataaatccagacttgcagaaacgtagctattgtataatgccaaggaatgtgtctattgtgtatttttaatttaacatagttactattttacttattaccaaataattacatgtatatcccttttatgtatctcttccacttatacttcttgtcataagaattattacatgaaaaggtcatcttagtagtgtagcatcattattgtaataggatataaaccattataaggtcagcataattgttttaaagtcattagtcatacagttttctagactagatatgcttgtaagttttttttttttttttgaggtgaaatcttgctctgtcacccaggctggagtgcggtgacgtgatctcggctcactgcaacctccacctcctgggttcaagtgattctcctgcctcaacctcctgagtagctgggattacaggcatgtaccaccatgcccagctaatttttgtatttttagtagagatggtgtttcactatgttggccaggctggtctcggactcctgacctcatggtccacccacctcggcttcccaaagtgctgggattacaggcgtgagccaccgcacccggctgcttatagtttttattttctttttttaaaatccattttaattttagattcaagggatacatgtgcaggtttgttacaagggcatattgagtggggctgaggtttgggcttccgttaatcccataacccagaagctgaacatagtatccaacaggacatgtttcagcccttgttcctctccctccctccttttggagtccccagtttctagtgttcccatctttatgtgaacccaaaatttaactcctacttgtaagtgagaacatgtgatatgtttctgcatatggaataacagtctctagctgcatccatgtttctgcaaagaacatgacttcattcttttcatggtgttgtagcattccgtggggtatatgtaccacattttctttatccagtccactgttgatggacatctaggtttattccacgtctttgctattgcaaatagtgctgtgatgaacatacgagtgcctgtgtctttttggtagaatgatttattttcctttgaatatatacccactaatgggattgctggattgaatggtatttctatttttagttcattgggaaatctccaaactgctgtccacagtggctggactagtttgcattcccaccaacagtgtataagcatttccttgtcttcacaacctctgtaacacctgttattttttgacattttagtaatagccattctcactggtgtgagatggcatctcattgtggttttgatttgtatctctctggtgtttagtcatgctgagtactttttcttaagtttagctgcttgttatcatcttttgagaaatgtcttttattgtcctttgccactttttaatgaggttgtttccttttttcttgttgattcatttaaatcccttatagattctggatattagtcctttgtcagatgcatagtttgcaaatattttctcccattctgttggttatctgtttattcttgtcaagagtttcttctgttgtgcagaagctctctttggtttaattgtgccatttctctatttttggttttgttgcatttgtttttagggtttcatcataaatgtttgcctagaccaatgtctaaaagagtatttcctagcttttctcccagagtttttatagtttgaggtcttacttttaagtttttaatgcatcttgagttaatttttatgtgtggtaagaggtagtggtccggtttcattcttctgcatatggttagccagttttcacaacaccattgattgaacagggtgtcctttctccattgtttatttctgctaactttgtcaaagatgagttggttgtaggtatgcaactttatttcaaggatctctgttctgatccattgatctgtatgtctatttttgtaccatgctgttttggtaactgtagccttgaagtatagttagaagcccagtaatatgatgcctctggctttgttctttttacttaggattgccttggctattggggctcttttttgtttcatttgaattttagaatagtttttcctaattctgtgaaaaatgatgtttgtaatttgataggaatagcattgaatcagtagattgcttcaggcagtatggatattttaatgatattcttccaacccatgagcatggaatgcttttccatttgtttgtgtcgtctatgatttctttcagcagtgttttgtagttctccttatagagatcattcaccttcttggtattcctaggtatttaattaattaattaattattgtggctattaggtacattatagtttttaaaatattctgtgttaaagagaaaaaaagtcaatgtgagggaaaggatgttgcccaggatggtgggtacaattttaaatatggttgttatttgaaagatgacatttgaactaggaattgcgggagatgaggaagagaagccatgtgtaaatctaagagaccatatcatgcctgaagtgtgagcaagtctgatatattcagggaacagctggaagcccacacagctgaaatggcacaagggaggggaacattgtagaagttacttagagataaattggtggggactagcccctctagggacttgtagaactttgtaagacttgaactttttctctgagtaaaatgggaagttaacacacagttttggctagaggattcatgtttcaaagcttgtccaactcgctttattttgttgttgtcattctgttttgttttgtttcaggcttttagcagcctgaagccatggtgtttagtttcgtgtctagtgataagcagaaaagagggacgaggacggggctttactggcccaaccagaaacagaaactaagaacccacgactgtattctgtcccttggacacccctgtaagaagttctgacaactaggaatagactgtgagaagcaaggtggagtgtcagagacctttcagagttaagagatgatagtggcttggacctcagttaagagatgatagtggcttggacctcagtgtacacagtggagctgctgagaagtggtcagattctggaactattttgaagaatatgccagtagaatttgccagcgggctgggtatggactgtgagagaaaacaagaaattgagagtgatcccacaatttttggcctgggcaataggaagggattgccattagctgataagtggaagcagcttggtagaaaatggggcaatgagaattctgtggttatgttaggtttgagtggtctgttccttcataattgatatgcagacacaggggtctagtagtctcaaggcagaaggtggagagtgagggtatgagtgttagaaagtctaacagtatgggttcaattgggacataaaccacagactaatataagcagaagagtttattataatgaatgattaacctatgatggaagagtacaagaatatagtgataactttaacagcaccctagggatgagtaagcatacccaagttcggataagcttggaagggggtcccctctctaagactggggtgcagatttcattggagaaggtgtgtttgcagcccactggtttgcctgggccatagctggtcacgtctctgggcaagcaagaaaacacacttctgggggcaggtgaactctagctagtgggcaggcatgcaggagttaggatgctacagtgaacgtgaagcccagagtgtacagtatctatgtagggagggcccaggaaacaaacctcagggcacaggcaagccttggctggtgcaggtgcacagtgcgtggtgtctgcattggaggcaaactggtcactgagtctaggtcaggactgcaaggttgccaaagggctctgcactccgggtatgctgctggggtgtggcagagcacccccagatgtcattatacacccacaccgctgaccaattgtgctgcagaaaaggcaaactgcataccagagtcaggaagaggacccccttcctctagcagtgcccctccatcacctcctactggcaaagcataacctcatattcactgtaaagggggaccgggagctgctgagtccagtccgttatctcggattcagttctagaaggcaaactgagggatgagaggcagtaactggcacagatggtagggagggttgaggttttaggaggtatggtctcatctggcatgacagtcacgtgtgtttgtgacttaatatggtaggtgtcatgctcatatgaaagtgtctctagaaacaaaaagtgacatgcacgggcttagacttggcttgagtcctctttggaaatctttccaactttatcatgttggtgtaatggtaattattaacttcaggtctgacacagtgtttgaaagatagctgaatagtcttaattttgccttaatagtttaataataacatttgagggtacatgtgaattttatctagaaaaaataaacatatttaaactcaatttttaaattaaatatatgggtaataatcttatttggcattccacttcttatccttgaagaaaaaaatatcgctaacctaaatcctttcccataaatacaacacactttctttttgccagatgcttaaatgtcattggtctgttttaaagtaattctatttgatctctgtgaaacagatggaagtatttgttatacaaaccttatttagaatgtaatctttttttctctcctgattgcatatgtttggcagtgagctttctcttctagatgtgaatgaatcttggttagcctccaaatctaaacacaccctaatttcaaaaaccacaatcctgaggactcaattcctgtttactgaggaattaaaacctagagaaaccacatagttactaaatgcagtacaacctagtgagtttttaaaaacaaaaatcattacagtttatttagggttattgactgtcattaagttcagagagtaagatcttttcctaagcagtatataatatttacagttggttaactatatctattgcttctgaatcttgaaatatactccttatatggcaaagtgagcttgtgaggtggataggaagcagtagactgtggtgtggggaatgagggagcagatgaggaaaattactcatttttttaagtgtgttgaatgactaacttcaattcaaaaatgtgtctgttaaaatattcatgtataactatcagttgcattgtgtttttctgaaaatcatttttttctttctttcatatttaagaaacaaataaacaaaaaatcttaagtattcaaccagaccaaaacctggacatgaatactattagcagttcaactgaagaaaaatacatgaaaaaagataggaagggaaaaaattcaacaccccctttgtcattaaacagttctaatccaattagaaggaagaaaaaaaagcaggtaaagtagaaagaattagagatctaaatttacacttctcaggattggatttcacaggcatactttatagttttagcaatctttgcttaaagattactagggtagtagttgacataccataaacttgaatctggaagaagggtatcatgcatgccacatgatacagcatcctcaaaagtgtataccatattacattagtgaaaatgaattggattaactgttctgtgttcccataacttcctagaggaatttaattgattcatgttttaagcaacatttaatcatcagtttcttcaaacaaaaatgagaggagtattgactttccccacatagctgttttaaaaccatactctcaaatttcattgttttattgagttggttcatggaatccctgcaagtatgctcattttcaaccataaacgtgcttaaggtgaatttcagaattaaaaaaaaagaaaagctttggatcttgaatcacttacagattgactctataaacttaataaaaaatcagaaattatatttctttcttgttaatctaaggtgtgacactgcctgtcacatcataaaattattgactgattttttgatagttatgcttcttttggataaaccaactatattgcataaattcctggaaaatgaaaattaaaagattaacacagctgcattggaaatatgtggaaataaatgatccgggattgttcttatatgtcgttcctgttattttactttattttattaagagacaaggtctcgctctcttggccaggctggagtgcagtggtgtgatcatagctcactacagccttgaactgctgaactcaagtgatcctcttgcctcaccctctcaaatagctggaactacaggcatgcatcaccatgctggctttctcttattttaatatgatatttttcttttattagttgacatccaaaaggctgacattgtagagcagagagcagtttcatgttcacattgtggaatttatggccatttactttttgtaggcgggtaggttctctgagcacttctccttcacatttgtttttagttttgcatggtccgtccactttaccatcttgtagccctctgctctccagccacccacccccttttagtttctcaaaaccatgcagatcctaccactagaacagcactgacaaaaggtgttccttcaggcaggagatttccacttaccatctccttctagtaaaagtctcctgaatcttcagttgtcattcttttcttccttaggaattctttgtatcaaatccttccatttcaggctcatacagcaacatgcaccttgtctttagaatgcttgtaaacctagacattgtacgcatattcacttttctttactcccattctctctgatctgatgaaagttctgttgtttttccttagtattgtatctccttggcacatagtaagcactacaaaaaacatttaccagatgaatgcaaataattgtttatggcagttagaacgctacccttgacaagttctcttaaatagaatttcttttaaaataccagggctttgatcatgattttaatgatggcattgtttcttggaagaaagagtaattctgtgatcagatgttccacaaagtacatttgattatcagtgtttacttttacatttgaaataaagactattgctttcttggtcattgtaacagaaagcagagtaacaatgtattatagaatctgttagcccaaggaaaatgcacttctcgaactgatcagatcgctgccctacacactttacctccacacttatcaatttgcacatcaagattagtgttttccttatatgtcaatgcaaaagacttaagagattatttttagaactccccagcacttcttcctgttcctgaccttttccttctccttacccacccatgcatcttgttctgaagtacaaggctcaatacagaaattaatcccttggaatttgctatgtcacttcctattgcaacatttgctttttagatgaccagttaccacttaccctttcttttgggaggtctttactaagtgagctgtctacaaaacgatgagtcgtcctggatgggtgttgttagagcaggccattagttctccattctacccatccgatgcttcctttttctcccatccaagtgggaaccactgatgcttcctttttctaacaaatatgcataacgcccttttcactattctgaaaagaaatgtatggataataaatctatatacataacttaagtcacctaatgtctgacacttaatataaagtagtgcagtaatgtataatattatatgatgtatttaagtatgtgaatgcttatgtgtgattgaaccagaagatataaggaagtacatatttgttaaggtatttataatcaccttgaatacaatatctaacaatggttttatcaccattaatgagattttccaaaatagtcaacagtaaatttgaagtagagtttttcttagatactgcagcatggttttattcctggacagctctgtgtaccttaaaatatgatataagatatttaattaatattaaaataatgtatataaaatagtgtatactgcccgggcacggtggctcatacctgtaatcccagcactttgggaggctgaggcaggtggatcacttgaggtcaggagttcgaaaccagcctggccaacctggtgaaaccccgtctctactagaaatacaaatacaaaaattagctgggcgtggcgatgtgtgcctgtagtcccagctactcaggagactgaggcaggagaattgcttgaacccaagaggtggaggttgcagtgagccaagattgagccactgcacacttcagcctgggcaacagagcaagactctgtctcagaaaaaaaatagtgtatgttaacatcctgaaaaatatttaacgtgtacattttttttcaaattatgcttttgtacataaaaagctactaaggaagatgctggtatctattactgtcctctgcaaggaaaaagtaattttgttggggagctacaatatgcatacaattttaattatcatataagaattccactgctagcattctatgaatagtagtttaacagaaaacacatcataaggcactttaagtaccaaccttaaaaaagggggagtagatcataaagactgtggtgttttgggaggggaaatatggcatccatctgtagcaaggagtgcaaatattgcttgaattgaaaggagagaaagggagaaagggagggttgctgtattacgtctatgccagattcacatttccctcagaaatgctaggttcaactactgacctattttaaatcacaggcctgtcttcaatatgtactgacctgaaatgaaaaaatagtccaaatttctactttttaaaaagagagaggaaagaggagaagcaaaaggatcactgttattgttgtcctcctcaagttctttataaaaatagctggagaataaatccttaataaatgtaaaaattttggaatactttcatgttcgtttcatcctagctttgatccttgccgctatttttcctcatgttttcagttctaaatgtaaacctgtttgataatggaaacccttgtttgcttctccttttattatgactttttttggtttctcaggaggtctttgctcaggagaacatgaattgcacatccttgtgtgtggtgttgaattgtttgtaagttccctgtctgcctctaccagccattgtttttacataaattctgttcttctgtgatctgcctcgtttgtctctttgagaacattaacaagccttttagcttagtggaatacaaaagtgtttcctgcgcattcactctttaataactattcagctcttctgggaggacagtttcttctgacacacatagagtaaacattttccagtaattttccttgatggcaggcaagcattagggaaatggtgcagttggctagcaaccccagtaaattttgccaacctgatgccataaatgttcactaggctgtcttcaaattcctttattctgctgatgttacaggaatggacttaagactaagcatattgtagtttatatataagactttcaggtttggcctgtgtggtcatataaggtagaggtttttgaatggtagcaaacataattgttctcatgcctgctaaaaaccttggttatgactaaagctggatcctaacttaaaattatgcatgaacagtaaaaacatttgatggttttgatgtattatgtttgatagggtcatcaaccttcccttcttacttcccatgattgcaacaactgaaatttaactgggcaataaatttattaaaggaataaatagtcaactctcttaataaggatgtagaactcctatcatgtttttcttcactgaacttatttaggaacttgagtgattccagatggtattacatgagtatttggctctgaatttcttgttttctcacatttgccaacatacaagtgttcaagactttcaggtccctgaggagctgttcagccattggatatacaactttaggttgctatggtatatttgatcattcttttgaaagttctcctcagtccttggcattttaaaatatgaaaattatttaatgtaacccggagaagaaagatctgtggagctgtagtgtgtgagtcagtggaccataaaatgtagatctcttgaaaagctagttttcaagatgagacgagatcaacaagtagtatatagaccacccataaactcttgaatgtggaatgtgtaaaaatgtatttaagtggccctttaataatgcaaaagtattttcccttaaatgtgctgggaagtccccagtccaacacacaaaaggccatttcatgcataacatatatatagggtttttacatactcaaataaaatgagagaaccaaaccacgagatcttttttcccctccaataaatatttagagtgaacctactgtgtgccaggcactgttctaggtgttggtattacaaaaatgaatcttatattcacctctttgaagagctttggatgtaatgtggatgacaaacatgaaaccaaataattaaaacctattgttcttaagtgctagatagagttctttggaaagagtggggcagttgctgaaaaggcaacaaggacttgatcttcggggaggtagaaggatgttcatagagaggcagtatctgggattgttcttaaatgttggtcaataatatgctgcagagaagagataaagacccagcagatggagcagtatgatcaaaggcatggatgtaaaaatctataatgtgttttaggtgaggaattttgtgttgctgacaagtagtgcctagggaaatgggagtcagaggaggggcagggattgagactggcagggatggatgtggacaggttgctgtggggtagcaatgagagtgagagggagaagtctgtttctaagatgtttttcaggggaagactcaacaggaaatgttggtaacaggatgtgggagacaggagaccatacacaggcttctttcttgggtatttggatcaccatagctgggattggatgttcaaaatgatgaacagatttggggacaaaatagaacggatgatcaatggctcattttgttttttttctttcaagtttttattttagactcattatagattcagaggactttgtaaaaatagtacactgtgtcccatatacccagttttccccaatgatagcatcttataaaactatagtataacatcaaaacctggaaaattacattggtatgatccgtggaccttttttagatttcaccaattttgcatgcactcctactgggtgtgggcatcatgtacacacatatgcatgtacagttctatgcactcgtgtcacatgttgattcctataattatcagcacaatcaagatgtaaaacaggacgagtgggtggctcatgcctgtaatcccagtactttgggaggctgaggcgggctgatcacgaggtctatcacaaggtcaagagattgagaccatcctggccaacatggtgaaaccctgtctctactaaaagtaaaaaattagcttggtgtggtggcacgcacctgtagtcctagctgctcaggaggctaaggcaggagaattgcttgaacccaggaggcagaggttgcagtgagccgatatcatgccactgcactccagcctggggagactccatctaaaaagaaaaagaaaagaaagatgtaaaatgattccatcacccaaaaccatgacccaaaagatcccttgtgctacccccttgtaattacaccatctctttctccatccctaacccctggtagttaataatctgtttccatcgctataattttgtcattttgagaatgtgacataaatggaatcatacggtatataaccttttaagattagcttttttccactcagtataatttccatgagatccactcaagtgttgagtgcctcagtagttcatttcattttattgttgagtagtatttcatggtatgaacatactaacatttgtttaatctttcacctactgaaaggcatttggggtgttttgagtttttgggtattacacacaaaactgttatgaacatgtatgtacataattttttgcatgtcgacttaagttttctttttttgtgtgataaatgcccaggactgcaattgttgtgttacaagttgtgtatatttacgttttaagaaactgacaaactgttttccagaatggtagtaccattttccattctcagcagcaatatatgagaggtccaattttgctgcatccctggtatggttactaatttttattctagctgttacaatagatttgtagtgatagtccatcatgattttaatttgcatttccttaatggtcaatgaggctgaacatcatttcatgtgctaacttgtcatccatgtattctctctggcgatatgtctgtttatgtctttttcccgctttctagttagattgagttgctcatttgcgccacctcagatcacctctttcttccttgttgctgctgggtggaagtttggctgcccactgggcccccagataccaggttgatgggaagttggagtaggccttgtattaagtagcactgcctcatacccacttgctccacttcatagcgctggagtgacagttcagctcttcacttaacacctcaatgggacagtttttcatttggtgtttggcctagggcaggtattaagagaaaggttttctgctctggcagaccacttttttcctagtcctttgtctggaggaaggaaactggcttttctttttctttttcttttttttttccatgtatctgctggtggttccaggttctaagcttctttagcacccactctgggataaatgggaagaaaatagaaaactcaggaagttcatcaccatgctgttaatgatactgtgaggtcgttggccagtctgccttctttccacccttcattgcttccctatgtttgtttgtaccattatgtccaggtattattctaaaaataattgttaatcagtaaaaagttttgaataggatatacatgctctgatttgcaccttttaaaaacaatcacattaagtacttcatagaacatgtgttagagagagtcagggatgatttaggggagaccaatcaggatattagaatagttgagttgagagatggcggtttggacaaggatggtggcagtggaggtggatctgagactcagtgattcactggatgtggaagtgaaatatgagtagatgtttaggataacccccagctttctgggtgggtgacgagttttccagtttactggaatgaggatcactgaagatttagaggaagaaaacctgacttgattttgaaatatgtttcatctaagatgcttctgaagtatgcaggtgaaaaagttgagaaagtaatggtctgtctggacgtggaatgaaaatacaggcttagaagggaaaccagagctaaatgtatttattatatagtgtggtgaggtatagtggatgaagacctggcagtggggatggagtgggttcagcagagggagggaagagattcacaagaagaagatgtaatgtaatcaaagggagcaatattaggatgtaaggttgcctagtcaacataaaagtatcaggagtgatggcgtttgtggagagaggcaaagggcttagcatttagctacattatgaaattggagagaaaatgaataaaggaactcgtagaagtttggccagcccaatatttctacattatatcccttagaacactggttccttgggggatatctttctgtctgtctgtcttagacacacacaaatgcacacgttttgtgagaaattaagtataaggaatgctcttaaacaaaactagtatttccaacagcataatttcaaagagtgtttagcatcgtgagtcttcacaacagatgtggtatacaacaattcctaagacatctcagggatttaagttagtgtcctctgggagttagttcttgtagactgaaacgatgtcgtcttggaagggactttcccttatggaagtgaaaaagactgggcgagggaaggtttgttagttgaatgttcagaacctggaaattctttgatgtgattaactaatgtataagtgtggagccactttgttcgtgtatttggccataaggaagaatgagcctatttcagcattcgagaaatagttgcttagcaccattcataaactcagcagaaatgggtatcaattcaatatcatagccgcctgtttcccctcccccgcaaatgaaacatcttcctgcctatagcgttaatgatttttttccccaggagttgaaatagtacaattcggttgcagaaggtatatgagtctagggtggtggaggttgaagtatttggtgaaatctgcgatgacatctaggaatctgaatctgcgctggctggtggtgactggtgaaagcatccaggttagcagcaactggggtgtgtttcatttataggcaaacacagtaaatcttgagaaaggaatattctgctacagatctgcaaatgatcagggtgagattgggaaggggtgaaaggaaggagcaaaaagacagtacttgtagactgaaacgatgtcatcttggaagggactttccctaatggaagtgaaaaagactgggggagagggaaggtttgttagttgaaagtttggaacctggaaattcttttatgtgattaattaatgtgtaagtgtgtagccactttgctcatgtatttggccataaggaagaatgagcctgtttcaacaatggctcgtgtttgttccatgtaaatggcaaagaaccaggtacttagcacagaagacaaatgaggaaaattgtagcttcctcacatatctgaaagagattttgaaatgaccctagagagtggacctgggaccgatagctaaaagtagaggaaatgttttgtttagtataaagaagcccatagttttggtgtttctgaacactgttctttaaagatgtgatgaccaatttaggacgacagtgaattttgtcactcaaagtgcttaagtatgggggtgggtggttgagaatttaatgatcagctagataggaaggttttaccgaacattagttctcagtgtctgctccgtggatgcccagggattcctgccattctttttgaggggatctgcaaggtcaaaactattttcctgataccgctaagatggtatttgcctccttgtgtaaacagctgtgctgattaagcaaaagcagcggtaggtaaaaacgctggtgcctcagcaagaaccaaggcagtgacaccaaactaagttgttgctgtaattcttcaccactatgctctcacagggggaaaaagtcatttcctttgatagagcaataaaaatgatctattctattaaaactcagctatttaatatgtgtctgaatcttctgtgtgatgaggtgggaagtaaacataaagtctactgcatggcaaagtatgtcgttattttgatgaaaaatacttgtgtgattatttaaattgtgaattgaacttgttttttttttttcattgaacaccatttctacctgaaaaccagactgcaaaccgtggttattcataccttgatatttgctagacattttcttgaacaaagtaagccagttacgtcaaggaaaaccactcagagtatttgttaccaaggataaagtctaagctctaaagcaaaaattagaatgttggaagtcttttatccaccagcataagcttgaaagtttcacctatacttaaatacttttttctgataggattacagatggtatttttaaagaattgactttatttttagtaatccaaaatgacatatcccagaatctgggagctctgtgtaaatcagtgaatcaataatttttaaatgaccattctcattgcaagatagaaaataaatttttatgtaacatagtacaaaaagtaaattgatatggttttcactaacttggtgtagtactaaagattatctacacttatctgaaaaagctattaaaatattcctcactttcccaactacctatctgtatgaagctagattcttttcctatacttcatccaaagcagcaaatcacattagattgaatgcaaaagcagatacagattccagctataagccagacaataaacagaacttcaaaaatgttaaacattgcgactcctctaatttaaagaaaaaaatcaaattatttttacattaatggacttttatgataattttgattgaatgaatacatatttgaaacacttcttggtttaatacctaatatggtaaatatcagtagctatacagatactcctcaacttatgatggggttatgtcccagtaaacccattataagttgaaaatatctttaataaacagtgcatttaatacacctagcttatctatcaaatatcacagctttccctagccacccttagcctacagttggacaaaatcatgtcacaaaaagccgattttatataaagctaatataaaaattttgagtcaaaattcaaaatatgatttttactgaaagtctattgcttttcccaccccaacttactatggtttaaaaaaaaatcataaatcaaaccatagtaagttgaggaccctctgtaatcctcaaaaactaaagctccttggcatcttctataatttttaggagagtaaagaatcttcggtctaaaatgcttgagaattgctatagttgatggcctgtgcttctttccatccctgagatttttatgattctatgatattatactaattcagtgcttgctgaaagtgtccacgcaaaggaatttctctcttccttgccaggcgtgccaacactcaggctttgctacgacagagagaggatttagagacgagaaacagacaggtgttgtccctgtcctcacagaacttccagtctctgtgtggaagatataaacccaaaattcacaaaaataaataaaattacagtggcggtatgctagagaggaaaagtagttggaagagggtctttcctcaagaaacagttcccccatgaagtgactgagcatgtatacgtaatgagcctttcagaccgaggaatccacacgtggaagggcactgtgggggatggaaagcactgttgttccgtgtcaccatgagagagggcttgtggctggcacacacgttcctggaaaagagtgaagctgaactgtggtccccttggtgttccatggcaagcatgttgccatttatcctttgcaagatatttaggaggttaatttttttgtctatgtcataacttctctaaacctgttctttatcttcattgttcctcaagttcatttcataataacttgatttcccttcctgatcttccgccatccccaagaacccccctcctctttattttccgtggctggttcatcattgttgaattttagttccttttcttctctccccttgtttgcattcctcacacattgactcttcagacctttttcttttcttttttctttttctttccttccttccttttcctttcctttctctttctctttctctctttctctctcttttcttttctttctttctctctctctctcacactctcactctctctcactctctcacccaggctggagtgcagtggcccaatctcggctcactgcaacctgcacctcccaggtccaagcatttcttgtgcctcagactcccgagtagctgggaatacaggcatctgccaccacgcccggctaattttttgtatttttagtagagacagggtttcgccatgttggccaggctgatatcgaactccagaactcaggcaatctgctcacctcgggctcccaaagtgctgagattacaggcgtgagccatgcccctggcccagacctttgacctttttcactctgtgtcatcctcttcaacctgaccttccttatttatgggcagtaacctcacttccaaatttagtaacaaagttgagatcatccacgtgaaagatctttctaatattcttttctgtatcaaaatcctctgtgtccttgttcttcccttccgttgttgttcccatttgtgaggataaaaatgtctactttcctacattttctgtctctgacctcttctctcacatctctgctggcttctcctcatcctccttcctgttcttcctcctcttgcctgtttcttgataggtgagcctcccccaggatctgtccttggctgacttctgtctttcctctgaagcttcctcctcagggttctcttcatgtctgacttaaggacagctgattcccaatggtatcttttgccctcgcagctctccgaatgttccaagttctctcaagcctcactgtcatgctaccattacttagtaccacaaaaggaacacctgtcacactgtttcatggcagtttattcttttgtctgcctcctgtttgggctgcctgaaggcaagagttgggatttgctagcccttgttttcccccttaccataatagtgagttgtggtccgcgagtgatacttatttgatgaattgaaagcaccaatttcaagcctgctttacattcctaacactttagagatctccccatctggacattccaactgggtaatttttcatttgctattgatttatacactattctggtgaagttaccttttccagagcactgtcggattgaataggagagggcattatttgaaaattggcacttgatgaaaacgatttttaaaaaatacaaactgtgctacaagaaatggtttaaggccaggcgcagaggctcatgcctgtaatcccagcacttcgggagctccaggaaggcggatcacttgaggctatcgagaccagcctggctaacatggcgaagccctgtctctactaaaactacaaaaattacctgggcatgcatggtggctggcacacacctgtaatcccagctacctaagtggctgaggcatgagaattgcttaaacctgggaggcagaggttgtagtgagccgagatcatatcactgcactacagcccgggcaacagagtgacagagtgagaccctgtcgaaagaaggaaagagagagagagagagagggagggagggagggagggaagaaagaaagagaaaaagaaaacaaaaacaggtttagctcttggactagtccacaaatgactattttaaaccttgcatcaaaaaaaaaaattgaaaacaaaactgtagctgtactacgttatagttgtgggggtatttacttaaataatgaatattcactgcatgtctgtaatttgttggggtgtttacaaactatgaggggaattctaagatgcgtcaaaagctttagggattggcttatgtgtttctttaagatgattaatgtttcaaaatgcatggattcaggtgtaccactaccatctttgtgcatgtcaatcatcgctgtggttgtagaatgaaaagggatatgtttttgaagtaatcggttgaagggggaaaatgaaggggattcatactgtatatctaggctgaggcaggcaaacagcttgagcccaggagtttgagaccagcctgggcaacatggcaaaaccccgtctctacaaaaaaaacaaaacttagctggagggtagtcccaacttcttgagaggctgaggtgggaggacctattgagcccaagaggtcaaggctgcagtaagctgagatcgcgccactgcacttcagcctgggtgacacggtgagaccctgtctccaaaaaaaaaaaaaaaaagagaaggataaggaaggcttcatttggccatattcctccaaaagtaacataggttaaaaaaagagtgtatacttattagagtgtatactttctcatataaatgcacatgtgtatatatgcatacaaacacacacatacagatttgatcttcattatttgcagattctatatttgctaacttgcctagtgtcagttaactccaaaactgacacacatggggcttttatagttatttgcagacatgtactgagtggtgaaaaatttgagtctcccaacacacatacatgttcttactgaaatcgaacaaggcaatgttctgcctttttgtttcagctctcgtgcagtaaggcatcccttttgcagtccatttagtaccatgttttttgcactgttgtgcttttgttagtgattttggagtctaagagggccccaagcacagtgttaaagtgctggctagtgtttctgagcacaagacggctgtgatgtacctgatggggaaaaatctgtgtgctggacaagctttgttgaggcgtgagctatggtgctgctggccttgagtattaatgaatcaacagaatatattaaatgtctttaaacatcaaacaatgttacatattggtgagtcaatgaaaatgttgtgaccccagaggctcacaggagccctatattttttctagaagtaatagttcagtatatgctgattcagtgcccagtccataaatagcaagaattgaccgtgtgtgtgtacacatgtatgtatatatttgtgcacatgtgtatatgagagtgagagggccagagattacctgaggtggagttaactaagccccagagagaaaaagagaaactatgtacccatagttgtggataacaagaaaggagtttatggggcatagataaagtgacagttcccttgacttgccaaaaagtttactgtcagcccagggcagctttatttctttctgaagtgagcagaaatggtctaatagagtacaaggtataaaggactgtgcaattagtaattcatatgtgctgaatagtttggggagtgcctctagagtactagtagaaagtcactttgttctgaagacattgatgaatttcatccttctcttgtatctttaattattactctgatttactttagccatctttttgcgcttacagctgccttttgatttgtttttgtgttgtttaagacccagggaaatttactgtgtccatggagtaggattctggtcattcaaccccacgttgagtctattcaacagctagattgagtgtatattaaggtgtctaaacaaaatcaaactaagaaacctaattatgtcaccaaactgtagcaagctggattttttttttttatatgaggttttgggtatagaaaggggttaggctcggagatagttgactaaccaactgctctggtagaaactctttcctttaagacaataaagaggttatagggattggagacctttatgtgttatactttggtggggacttgtgtgtcttaaaacaacccttgccttgtctgtattcttagctttaatgttcttttagaatattacctgagtctctcatttgccagaaagatgggtattgtcatttttaaaagtctgtcttgtaatatggctttacatggtcttatgatattatttatgaggctgactctcataggtaactgacgaatgaagtagtatttgctcaagtagtaaaattcttgagcaaagccacaattaactggagataaaagtaagattactgtgcaattgaaattctagaagaagagttttaattttttgagtagcttgggatatttgcagtgaaatgtacctccgttacttctttgtattcttttgacgcatcacattccaaatgcaaaatttatgaaactgtcagaggatcagcttctctggcagatctctcatcaattcttctctcgttaaaagaaacttcttttgagacacgtctttgttagttaatcctatcaactgaaaacctgcatctcaaaacaatcagtaaatacaaagcagaacctagctttgtttaggtagtatctatcaattctcttgaaatttatcaggctgtagcttctatagcagttctcggctgagctgctcgtctatttaaacaaaaataatattgaaagaatattaacttctgaagacgactcagaaatcataatatagtggtctattcttaatgcatgaagaaaatgtgatattttggctcttttaatacacctttgtgagttgtaaaataataaagacaggactacaaataaaaataatccaaatactctataaaataaagacagatttgtgcttcttgaagtctataaaatctcctaccctatattaatattaaaatgtacaggatcttctctcataaggaaacacatttagaatgacaaatttttagtttgcgattataaagggtaacagaagacacttaagaagaaaataagcatggagtcatttttgtatcaaaaagaaaatccaggccaggcgcagtggctcatgcctgtaatcccagcagtttgggaggccgagatgggtggatcacctgaggtcaggagttcaagattagcctggccaacatggtgaaaccctgtctctactaaaaatacaaaaaatgagccaggcgtggtggcaggtgcctgtaatcccagctacttaggaggctgaggcaggagaatggcttgaacccgggaggcgcaggttgtagtgagcagatgtggcgccattgtactcccacctgggtgacggagcaagaccccatctcaaaaaaaaaaaaaaaaaaaaaaaaagaaaaagaaaatccagcaaaaggatcaaaaccttttatttttgttccatgacttaaatcatttaattatattttcccccaagtacaaaaatcaataaacaatgatttccatagttaaataaatactttttttctttaaaaatgttatgaaacctttagtatcaaattacttccaaattcaacttgacttctgaataagaaatactactttataaaatgaaatgcctgtgttctagaaagtattatagacaggcaaaataacaaaggaaaactattgttttaaagcatgcttgaatgaataaacatttctcagatcactaatggtcaataacattatttggaagatttggggataatctggtttgcattaaacatatttacactttattttatttatttatttatttatttatttatttatttatttatttatttgagacaagagtcttgctctgtcacccaggctggagttcagtggtgcaatctaggctcactgcaacctcctcctcccaggttcaggtgattctcctgcctcagcctctcaagtagctgggattacaggcacctgccaccatgccccgctaatttttgtatttttagtagagatggggtttcaccatgttggccaagccagtcctcaaactcctgacctcaggtgatccgcccgccttggcctcccaaagtgctgggattacaggcatgagccaccacacccggccatatttacactttaaaatgcctcatgaattaagtcaagctttactatatacagatgctaagaaacatgaaaatatatagcgtttcgctgtattcagatcagcaaatttatcaagataattagattattatctaagggattcagttggccagactttgaaaaactatttggtttttgtttttctagagagcacagtcagacgaactcgaaaaaatagaaaagcatggccgatcttccaaagacaaggaaaatgccaagtctctggacaaacctgaacagtaagcatgtcttataaccacgtagagggcgtccaggctatgggtgggcccgttttgtttggaaaatgcaaatgcggtgtcttcagtgcatacttgttgtgaatgagatgaggataaacatctgtttatgtgaattatatttttcttcttaacttggctttatttccttaggttcctttatgaactgtcactaatccccaacttttcagagcgagtcttttgcatcctgttccagtccacattttcagaaagcatttgctcaattcgtcgcaaactggaattactacagaaattgtgtgaggtgagttctggtccaaagagagctgaacttgagtctcatttaattgtgctcagccatgttcttatttcagaaaagcattcttttatttactctaagtactcaccaaatttgaaggatcgcagtcccacagaagggaacattttatgattgaccttcaagatcaaagtaaatgttccggcgggcgcccagggctacaggaccacattgctagaatgtggccaatacatgttggcctccagagatttctctgccctctccttttgccaaaacaaaatcttcagttttcacggtcctctcagacatcagacttccaaaggaatgtaatttgaaggcttttttttttactttctttcgttatctggaaggacctctccacaaactgttaataattattccagccaaataatttaggaacagccatatgactcaacagaagacaaatattcttccgaaaacaaaaaataaatgcttggcagaaacgaccaatgttaacatttaaaacaatttgtcaaatatcagtaataccatttgttctagttgcggtaaatcattttgaaaagtgaaaagatgtttttaaaggctcacattttcagaagaagtgacatgcaaagtcaagttaaacacagtgttttgaaagaaatgagtgtgagctctttgggggtaaacctaaatttagaaattaatctctgaatctgctttttggtttcctctgctgatgccaaacattggtattgttccagacgtaggcaccattaagacaatggcagtgatattagtgatgttattttgtaatagttctcatttggccttatctaatagttatcatatagcctttgttcccatatagccttaatagttctcacacaggcttgttttccttgcagttacatcacagaaatggcctaacatagcatcccccagcttacaaaggcatacctgaatgtttgtgggtggtgcaacttttactaactttcaggatactgctcttaaaatatacctaataattaggaatgataaagttcggttgtgacccaaaactcctaatataatataaatagctggcatcaactcgatgattcaaacaaaacctggtataagataaaagttgttttttgttgttattctgttttacagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgtaagtattttgcatgagtggacgtaagcacattgaggagtcaaggttttgtttagtaatgggtttgaatgtaaagcagttgtaaaaaatatttatgttcctaggtcaaatgcttctttatgttctgagctagaaaaaagtaatgtccatcagatatttgtgattttgtgattaatgtttcctaaagtgaataattttcattcttatgtctaatgtataattacaactttttaatataaaaacaatacaaaataactttttatattgttttaatataaaacaataatttcttttaccatatctttcccatgtctgctaatatttatccttttggaatctgaaggctaattattttctatgaattagacagtatatctttttttctttgtcatgttaagcaatgaaggccaataggtccatattttgaaaataacacaatgatgagtaaaatggcttgtaaacaaaatataaaaggtgattctactctgctgcatatgattttctccttgatactggtgtgtagggggatgtctaagctctcttgcagacctaatcattttttggtactacttctgcagttgtgtttgtttgaaattaatgtctaagcaattgtgagagtgccagtagaaatatgaggttaggaatgatggttagagtcacagactcaagtctgagacggtaaacttaaaaaataaaagagttacatttctctgataaaaaaatcatcacacaaaaaagtaggataaaggaaattctggacatgtttttgaaatattaagtttaataattggcttgtagaaataaaaatatgtaggactgtccttcctagataatgaaataatttccttcatgggggagagagagacttttaaaaatcttttctgccagccaacaatttgtttattgttttatatacagatgcttctcaacataaaatggagttatggcctgataaacccatcctaagttgaaaataccataagtgaaaagtcattcaatacatctaacctagtaaacatcaaagcttagcctagcctgcctcaaacatgctcagaacacttacctcagcctacagttgggcaaatcatctaacacaaagcctattttataataaagtgctgaatatctcatgtaatttattgaatactgtgctgcaagtgaaaaacagaatggttgtatgggtactcgcagtacagtttctactgaatgcgtatcacttttgtaccattgtaaagtcaaaaaattgtaagatgaagcatcgggagtcggagactgtgtctctgtgtacgtgtgtgtgtgttgtcaaattaatacagatattcatgcaatattctttcattgagcatctatggaatgtggacactgctcttccaaaatcgaataattcatagtccttccttggtacaccagcagcatatgatttttttatttttataattgttcaaatgctcatgtgtatgatacacattttcatagaagtatctactatagagagctgataaattacatttgttaaaaaaaaaatgctgaagccgagtgcaatagcatgagcccgtaatcccagctacttgggaggacttttcaaggccaacctgggcaatacagtgagagcccttctcaaaaaaaaaaagaaagaaaagcccttttcttaacctatggtaattcttcaatactcagcaactgcttgttggagtgaaacaacttttgcaaataacattgaaatctatagcatcaatatcatatttaaattatagaaatgaactggaaatagattctagtgatcatatataaataagagattatttgtgggacttttttggtatcagtttatatatcttattcaatcctctgttaggttaaatttcattaatttaaataatcaagaggtaatctaaaataaaaatttaaatatgtaatcaagaaatacgtttttaaaatagtttcacttgtactcagaagagctatacaaagtcttcctgaattggttctttctctgtaaaacaaatgtaactatatttattccttagtactatttatagacctccatggacagagctgttactttgatcacttagaattttctctcagcatgcctagttttgttaattgattcaggtgctgccaaccgtttcattgaattacaagttgggagagagaaaggaagtcaagttgcttaaatcattttacaagcaaatcctgtctaatgagggatatctctaatagctacattactgactcatgtcaaacttgattataaagaggttttgctctttttacaaatatagaaaaaatcgtggttatattaaacattccagagaatgtagtttgtatcatagggtttgtttttaaagtaaaatatatacttgagctctcaaattcagattatctactactactttggaacaatacaaaaaaagagtaaaataaaaattaatgcgcctaaataaaccagaaaggaggtgaaaaggtatttttgaagtgtgttagatatgaaacaattttacctttttttaaatagaaatatccacattgtcttatttataaccacatgagtgttaactcctcaaatctcaattgctgatataacaaattataatattggaattgttaaaagctcccctttacttagtattggaatggttaaaagctccgctttacttaaaatgatacttagcttttttatttccctaatctatatgctaatgagcctcaatcaaacttactgttggagtggtatctgttagtccagctatatatcaatgctaaattatttcttttaatatagtagttttaaaacataaaaaattatcaaacaaaaacaataaaaacacaaaataataaaatatacaagacatgagctaaatttctaattgaggggggtaacagttggaaagtatttacagttcagactttgcccctaaatagctgtgctaagattggaacactggggagaaaaatcttttaagccaccaaactccttagacacaatggccaagacaatccaaaatgtaaaatttcacatttcattccaaatgttctcatgtatatacatgaattcactagaatcttttttggtaacactttatatttaattagttaaaaaatatattgtcactgactttggtctttctgcctaggacaatagcagaagccttttgtcatatattgtttcgtattatctccgaaattttgatgaggtaagacaatttttacatatagtcatattccattattctttattcgttggatgatttggcagtactttttgttgttgtttttgttttggacatacctgctattattcttttttatattgataaccaatttctttaaatatgatggggttttttgttcattaggatgctggaaaagaacagtgcctctttccactgccagaaccccaggacctttttcaggcctcacagatgaagtttgaagattttcaaaaagatctcagaaaactgaagaaagacttgaaaggtaacttaaaatcctgaactcatgttttctgtttatgcttttttaatgagagaaggcagacttttcaatgtttttagagaaaagtaatcttttttatctttatagaactaaatttgtgtgtgtgtggcgaaagaacaattttgcctatattcttattctttggttgtttaaaaagttatgtgtatcaaaaatttggttattaagtaatatcttggttatttcaattaacaatctgtcttgtcaggaataagtttacattttgttttcattttataaccaagaacattttggtattggtcatgtcatggttggatacaaattatgtcattgttgtaatagaagataaatagtccttccccattttcccttggtgtacttgcccaggattttctggcttatgaactttcctgggaacaaaatatcttctacttaaaaaccacatacatgtatattgttttattaccagtcaagctttacataaaattattttgaagaataataggccgaaatttttcaaatttctaaattaaaagtagcatttacaaaaaagcaaatagtttgcagatttttttattttgtaagtaaaattcctgctatccccttttcttgatattcttattgagttgcgaacacctcagctgtctatttcagcttctttcttgctgtattacatacagatgagaagtaaatacatttacccgagcttttgatttgatattgtgttactatatgagaagaaaaggcctggttacccctgtccagaaaccaaaaagatagaactttttaagagactcccaattttgagatgtgtttatccaaagatactgatctgtaatcaaattcatagagttgttatattctagttacaggtgttttaaaatggatttcagtgagcatagggacattatgtagtgtggttatagttcttatgtattcaacaacatttattacggacctggttcatggcagacagttgctaggtgctgtggatccacaaaggttacagtaaccgctgttgaagagggctgaaattctgtcattacatgtaccctgttggagccttacaagttggtgctcattgactgaggccaagaaagactgccttgacttgctctgtttttcatacaataataataaataaaactatgttacatttgtataatattgtggtactgtgtattttaagctaagaatgaattcttaaagcaacaaaaaaacccactcatgctatagtattatacttcaacctgatgacaggcatcttggtttgcttatgaaatttacacacactatgatgtgtaaatgctagaggcatttctaggggatctggaaaatacttcccacttcaatcaatagttcagtcttgtaaagtaggatttcatagtttacaggtgatttgataaaggagcggaatgggtgaccctattatcaggatatcaggatttatgtttgctttctggagttgcatcacttcggaatgtgatcccattttcttatgataaatacacaacttcttactataggcattaaacatacatgtaattatgaaaatggcaagttcttgcaagacttggagctaaaaagaaagacctagctaacaccagatagtgggtttgaaaaggacaagcagccggccaggcatggtggctcacacctgtaatcccagcactttgggaggccgagacaggcagatcacctgaggtcaggagttcgagaccagcctgaccaatatgaagaaaccccatctctactaaaaatacaaaattagccaggcatggtggcacatatctgtaatcccagctacttgggagcctgaggcaggagaatcacttgaacctgggaggcagaggttgcagtgagccaagattgtgctattgcactccagcctgagcaacaagagcgaaactccatctcaaaaataaataaataaataagtaaaaataaagaaagaaaaagacaagcagccagcgcctctgaatactatttccgcatctgcatttgccacctacaagtgctaggtgcctacatttggtagcacagaagattagatattgaaggagcatcttagcaatttttgagtacctcagagtttaaagagaggattttaaccctgaaggtttacactttatgtcagggaaagatgaacttatttttcagatatcatcagacctgtgcccttggccaacaatgatcacatttgtctggcacagtattttccccaatctgaacacagcctgttacaatttgatagaattgttgaaatggggagtttcatgaccaaatgaatgttaagttaaagttaaaaggacttcatggtattctccaaaaaaaaaaaaaaaaaaaaaaaaaaaaaggtggttgcaattgttttcccatttattacagagaacttttttcacagaatctctggtgtgttctgtagtcactgaaacatattttgagaaatgcaaggctggtgtactgtgttagtaacagaagaatggcatttacctttgaggaacttacagggaaggttggagaaatgatgctatagttgatgaaataatgtaattatatattactcttcttaaaaaatggaatcagcttgaagagctatttacaaagctgtcaaactctgaggattaaaaactgacaaatcataatttacctcattttttttttgcttttctcaatttggggttttccatgaaaaacaagatgttttatgacttgaggaaggaaatcttatggactgaaatataaattcagttactgggaaaaaaagatatacccaaatgtagaatttcgtatcaacaacgcatgaaatctgcctcatgtcctttttaggaacgagagggatataaatagatatgtacgtctatctgactaaatgggagtcaaacggaaaattattggattatgttattttaggaacaattactttgaaataatgtctactttgatcaaagtagcctattaaaaattattccttttctttttttttttttttttttttttttaagacagtcttgctctgtcacccaggctggagtgcagtggcacaatctcggctcactgcagcctctgcctccccatctcctgggttcaagcaattctcttgcctcagcctcctgagtagctgggattacaggcacatgccaccacttccagctaattttttgtatttctagtagagacagggttttgccatgttggccaggctggtctcgaactcctgacaaaaatgattccttctaagtgatcaagtgagggaattcatttaagaagattcatatggccacattttgtttcccagaggcaagttgttataacaaggtttagaaaataggataacgtatagaaagcatttatctcaatacctttcatacaataaatatccaataaatcttggccattcataataaggtaaacatagaataagcagtgggattagtttgataaagacagttaagcaataatcatagtagctcatctgctggctctagcacttctgtttctgcttagagacttgatttttatttctaaggaaaggctgaaaaataatgtgttatggctcagacattttaatgagacgactgaatctcattttagcattttataataacatccactgtgtttagtttctctgctcactcccaagatttccatatttcctcagggtgcttccctggctttctgagctcagcgacttgtagttcgttaagcaacctgatctgcttttgatctcttctggctgtcagcagcttttcttgatgtagtcatgccaaatgatgactctgttccagtgcctttcttgaataggaattgtagcatttgccacatgacttaaatcaactcaacatgcacggagcattgagtaattaagttaccggaactggatgagaatgttctcatgcaaattcttctctgtatcctctttctttctgttcttcctccctgtactcacacactctctctcttttcaatatctgagttgaaaacaagtttaaaattcatcaactataccttcaagttgaagcaatgtccattttccagagatttataggaaaaaccagccctcaaactagtttagggtttattttggcttacaactactagtttgtaactattacatttaaattgttcatttctgatatttccttttttccccttatgtttgaggacaggaaacaaataagcttttttaaaaataacattttacagtggtccttcccacctatccaaggttttactttccttggtttcagttacccacagtcaaccttgatccaaaaatattaagtggaaaatttcaaaaataaacaattcatatgttttatgctgggcactgttctgagtggtatgatgaaacctcctgccgtctaccttcatcccttccggcacgtggatcctcacttagttcagcgtattcatgctgtatatactgcccacctgttcatcacttaggacagtggtccccagctttttggcaatagggaccagtttcatggaagacagtttttccgtggacaagccagtgggggatggtttcaggatgattcgagggcattacatttattgtgcgctttacttctattataattacattgtaatatataatgaagtaattaaacaactcatcataatgaagaatcagtggaagccctaaacttgtttttctgcaactagagagtcccatctgggggtgatgggagacagtgacagatcatcagacattagattctcctaaggagcattcaaccgagatcctgcacatgcgcagttcacggtagggtcctggctcctatgagagtctaatgctgcagctgatctgacaggaggcggagctcaggcggtaatgcttgcgatgaggagcggctataaatacagatgaagctttgcttgcttgctggccactcacctcctgctgggtgtcccggctcctaacaggccgcagaccagcacccatctgtggcccaggggttgaggacccctgacttaggagccatcttggttatcagatcaacagatcacaaaaagggtgagtatagtatgataagatgttttgagacagagagaccatattcacagaacttttacagtatattgttataattgttctattttattatttttttttaatctcttactgtgcctagtttataaattaagctatagcataggtatgtgtatataggaaaaagcatagtatatataggtttcagtaccatctgctgctccaagcatccactggggatctaggaaggtattctccatggataagggaacactactgttttatgatttttaaaaaaaatttaaaaaaaatttattgaggtaaaatatacatacaaaatttaccatctttaccatttttaagttatattttaaaattaatatctgtttagcataggaactttagacaaccttgaaaaatgtagagaagaaaacatttgtatttccacagttccatgataaataatgtttatcttttgttctatctggtaggtaggtgtttattgcatgtgcatacatacatgaattatgcaactgggattatgatgcacataatttttgcaatttttgtccactcagtttctggtctatactaggataatttaattttatttatttacatatatattctattaatattttctttctggttgtctatttgataaatttttaaatatctcttcctaacacctccaataacatttaagaagatgtacatagtattcctgttaatttactgggtaatcctaaatgctaacatattttgtatactatacaattttataacatgctataaatttatgtagtatatttattcttctaaataagatgaatgttttagaacattctaactaacaattgaactccttctactttcttttcagtttttttccagactttgggtactgtcatttttcttaaaaacattactgctgtttaataattattaggtaataacatttatgaatatatttaaataattactgtgctatcattgttgcatcttatattcctcccccctccacatttgatgttctttcagtgtgagtgaatgggtgttaaactcttagtccgggccgggtgcagtggctcacacctgtaatcccagcactttgggaggccgaggcaggtggattgcttgaggtcaggagttcaagaccagcctgaccaacatggtgaaaccccatctctactaaaaatataaaaatgaaccgggcatggtggtgggcgcctgtaatcccagctactcgggaggctgaggcaggagaattgcttgaacctggaaggcagagtttgcagtgagtgaagattgtaccactgcactccagcctggatgacagagcgagactccatctcaaactgaaaaaaattgttcccccttgttttggaatgatagtttcaccagaaatagagttctagactgactgacttttcatcagtattttgaagatatttttgttttcttctggtacctcttattttcaataattttcattcttttgtagataagctgtcttatctctgatgacttgtataattttctcattgtccttattcatttttggctttccttggataagtatggtatgaatatattcttttaaaattttttgtattgctctgtacttagaacttcctattaaaatactgatggcttccttaatgtgtagaaaaatttctcagccactgtctgcccaagtattacttcacttttctcttttttcctgaaactccttttagatgtacattggtctaatccctgttagccccttaatctaatccccatgtctctaacatctctttcatgtgtttaaaatcaccttccaccttttgctattatcttcatgcattcctcaacattatcttctaattcattcattctctcttgactctgttaattctaatgtttatgttatcaatgcagtaaatcataataattcttgtttccaagatatctaatgtttttatcatattcattttccctctaatttcttattcttgttttggatatttatcttccttttatgtcattgatatttgtaaaaatatattaaagtccttttcagctgttgtttcatctgaaatgaattcatcttccactcagtgattttataagttgtccttcagagtcactagtttcctatgtggtgttagaatgatgatttttataaaggtgtcaagttcacagttacagattgaactgctcgttctattctttacccccttctcactactgcacttgactagtctttaaaaaaaaaaaagtcaggaaattatggcctatgggctaaacctgtcctcttttgtaaataaaattcagttggaacacagccacgcccaatcatatacacattagctatgactgtgtttgtgttacaactgcagagttgaagaattgtgatagagaccttctatcagtgaatgtgtccctccctgactcccttcttctgacccccaaaatcattcactgtcttttgattttttttcaattgctttaacttggcctgcctttggtacccaagtcacaatcaaagcttctagcagcagcatagagctcctgccctgtgggcatattaggtttattgtagatccagtctccacactagtgaatgacttggctggggtctgggctgggaagctgtggctacttactcttgctgccccaggcatagagttgcatgtgggctacagccctaggaagcagtgaattgtaggtgttttcatcctctttgcatgagtttgggagaccagttaccactctgggtttccagtagagagactggttcctttccctcctgtctgttctctcccatccccagtcctcacataagccaagatctttatctattcctccacgatcatagttcgatgacttctacttccgccctgtttattaactttggcttctctactatttctggtccaaggagatatttacattttttaaaagcatactatgtctgcttagtttcctctttatatgttaccgttcactgctctgtgttttcaacagagggaaagctcaggctataaattgattataagttctgtttgactggaattctgtattcacttttatatcttacgtttttcctcactgaaaattatagcagaaacatttttccatactatttcatatacttcaaaaactgcttaggatggtttcataattcgtctcatgaatgtgctgtagtttagtgagtaatttgattcttgtaggaaattagactcctcccagttttcactgctcttaagtatatcatgttgagcattcttatttatagcccttttaaaagttgtatctctggttgtttccataatatagattcagatttataattactggatcaaaggtaatgaacattttttcaagttctcgatattaccaaatgttataaaaatactttctagaggaaaactgatgaattttatgggtgagttgtttcttaaagtaaaacagaataataaaatttatgaaatttagattagtaaagaatcttagagacattgtggtctcataccttaatcatttaacaaatgtttattaaattaacagaaaataaaaagtagattctttcctcatagctcatagactaaaaagaggactgttgatgatatgaataaccactatacagtatacaattttttttcattatatggaaacacagaagtagtagttattaggtatacttggaaaattatatttaaattggacttcgaaagatctgtaaaattctcccaagaggaaaaaaaaaatagtatttcaagcatgggaaagagcatgagcaaagttacctatcctgtgaccatttggactttgattatttactggttcctgatcccagaagtctctcaattcatatcaggtatatatctaacagatataaaatattcaaacctgagacggggctcattgcagtggaattcacaaccagggtgaagactgtgcgcatatgtggtttgaaaaagcctcccagccagtaattctgatatgtctttcaaagtagcttgctatgactactctgtgtcactgttttacatgcattagctcatttaatccctatgccatagataggatcattaatcctctctttagtgattgcataactgcaagttagagatagtaaatgctctacaaaaagtcacatagtgcaagctgaggctggatctgggcctgaggaagctgatccagagctcacccttttaaccccaacacaaacaccgcctccttttggggttcactgcgcagaacccttcagggaaggttgataagccgaacatacagatataattgcactgaagtatagtaacaaccgtgataaaataggagcagggagcagagtggaaagtgagcctgattctatctaattggttagaacaggcttgagttaggtagtaccatgagaactgagccatgaatataaatactttaccaggtgaacaaatttatgcaagaaaatttgaatagatgagccaccaagttcaatgagatgaaattaatgcatcttggaatttgcagcaatctgacatgattcaaatactggctgagtacagagaagtagaaagcaataaagacatagacgtacgtagtgagcagatcaatctcacatagacaggcaggaagattctgagtggacaaggggtgtgtgtttgattgggtcggcggggagtatttggaaggaaatggaggaggagagagagaggcatttcaggtagaggaaatgtcccaatgccccagcattcttagaacacagtgaccatgagatgatagaaaatgttttctgattatagaaactcaacaaacttctatactttataaggaattttcattttactctaaatgcaatatccagccattgaaatagtctattcagggaaatggagtgacatgatttatgtcttgaaagtactgctctggcaagaggagaatttgtgagaccagtttggaaacaattgtgattttgacaaaggagggagacagaggagctgggaagagctaaacaaatctttctatttttagggacagtcagtgttctagatagtaactgtttagaattttctgtaatctatgtataaatgcttcttaataaaattgtgtcattccatgatttccttcaagtcaatagtatgtaggttactgtgatgttttgctgtttgagatgtctgcatttctttccagaagctttgaaagaaacattttcatttgtgatttttttcccaaagttgataagcctcaagtatttctctttctcctcactccttcctccacactaacatgtatgtgtactctatttaaatcaacatttttcagtattctttgacttttttaaactattagtctcaaaatatacattactttcagtggtgattttgccattggacaggagaattaatgagaagaaaatttttcaaatcattcaagtcattagtcgttgaattctaagatttgatgccatttatatatattagaaaaaataacaaaattgtattttctcctttttactgattgcctgctgttctgacccagctgtctggtgaaaactgcagctaattaaaggtgattacttccctgtcattttgagttaaagtacattttattttataaattatctgtgattgtgttacagtgtgtactttgcatactttgcacaaatgtttgcttttaaagcaatagtcaacttagtttaatgcaaagccatgagattctgtttctttcagggacctggtataaacaaattatcacataaaaacatggtctacacatatgtgatacaagtttaccatgagattatagtcatttacaatagttttcatgagaatgtttcattctcataactgagtcatttctttttccatttttaattggcaaactgctcattcttctagatgattcagctaaaatgaatatacttagctaaaataattcttcttcagcaaggctgtctgatgaacttgccctacaggagaaccttgacaaagattcactgatagccacataaacagtgatttgcagcagtgcctgacaacatgttaaatatgagagtgtaaatgtcaataacttttcaaatcatgctgagaatttcatcttggtcagtatgtctggtgattggtattctttttaaaactgttaaaagtcagagaatgtgaaatattggcaaagatgtagattggtgagaacgcttttacactgatgatagaaatgaaaattgattcgatcccatgagaaaccatctggcaatatctttttttgttgtttttgtttttgagacagagtcttgctctgtcgcccaggctggagtgcagtggcctgatctcgactcactgcaacctctgcctcctgggttgaagcaattctcttgtcttatcctcccaagtagctgggattacaggtgctgattacagcatgcaccaccatgaccggctaatttttgtatttttagtagagacagggtttcgctgtgttggccaggctggactcgaactcctggcctcaagtgatccacctgcctcggcctcccaaagtgctgggattacaggcgtgagccaccacacctggctatggcactgtcttattaagtcaaaaatgtctatactctgacccagcacttggcccctagatatatactccagtgcacaggtgaccaggtgaaataaaaatggcattcatattgatagcaacagcaccaaaaccctcagatatttttcaacaaaataatagctgagtgaattatggtatcttctttcaaaggacatcggttgaactgtcaaactgattgaactgtatttacctgcattaaaaatgggtaaatcttattaacacaagcttgaggaaaagcaagttgtaggaaaaatatgaacagtatgatttcagtttttaaagttcaaatatatagacaagtacagtagtctccccttatctgtggggagtaagacccccaatgaatgcctcaagccacggatagtaccaaactctatatgtactatgtttttcttatgcatacatacctatgataaaacttaatttataaattaggttcagtaagaaattaataataataataaaaataattataacaatatactgtaataacagttatacaaatgttgtatacaaatattatttgtatacaaaagttatacaaatgtggtatctctctctctctccctcttaaaatgcggtaatattttccgactgtgcttaaccattggtaactgaaaccacaggaagcgaacccatggataagggagggcaacttcacttgtttagggatagccgggggatgagaaacacaaagttaaaggttgtagttacctctgggcctgagagagggacagagagaaacacactgaatttttccaaagcattggctatgttctgcttcttaaactggaaatgtagtaggtgaatattcatttagtctttacatgtaacgtacatgttatgtatgctccgtagtacttctttaataatcgtatacaagaggaaagaaaaataggcaaccagtcaggaatatgtttgaatttgagttgatatttagtcccacaaatttaaaatatgtgactgctcagcctttcctatactttatgaagaaattatataacagcatattcaaaaataagcatcattaaagaacataagaaatttaaagaacaaactatgtttaagactttatatatttgcgcatgatggtgctaataatataaaacttatttgggaaaaacaatctgagaaactggcatattttatggtcaacaattcaaacagatattatgtataagcaattaataaattagaaataatttccagtgtcagaaagctgttgagtacttagagaaacataacccattaattttggttactgcttctactatttctgtgtgaagttggggaaacaaaaaccacatttactattttaatagcagtaatttaacatagagaatgaagttaaacacacgttgaaggatgttaaatgcagaaagaggatgctgaggaaaatgtggaaagcgtataccatccgtacggccaggggaataaagtgaaaatgttggggttagcaaagaatcatgtaactacctgaaaactacagctggacgttccactgacatctgaaacctagtgagttcaaaaccaaatgcattttcattcctctgaaacctactcttcttcctccatctccatctcaaagccacccagactctatatccattcggaatcctctgttctcctcccgacagcactcatcaacgcacattagaatctccatgtgagctttctatgagccttgtcgtggagattacttttcttttttactttatatcttggggttttcttcaacttttattttagaatcgggggtacatgtgcctttttgttacaaagatgctaaggtttggggtaggaatgatcccctcactcaggtagtaagcatagtacccaacaggtagtttttcagctctttccccctctgtctctccccactctaatagaccccagcgttgatcgcgctcatctttatgtctgtgtatacccaatgtttagctcccacttgtaagtgagaacatgtggtatttggttttctgtttctgcattagttcatttaggataatggcctctagctgcatccatgttgttgcaaaggacatgattttgttctgtttcatggctgcatagtattccatggtgtatatgtaccatattttctttattcattccactgttgatgggcaggcaccctggttgcttccatgtttttgctattctgactagcacaacaatgaacatacaaatgcatgtgttcttttggtagaacaatttattttcctttgggcatatatacgcagtaattggattgctggatcgaatgctagttcaactcttagttgtttaagaagtcttcaagctactctccacagtggctggactaatttacatcctcatcaacaatgtataagcatttcatttcctctacagccttgccagtatatgttgttttttttactttttttttttttttggagatagagtctcactctgtcacccaggctagagtgcaatggcatggtctcggctcactgcaacctctgcctcccgggttcaagtgattctcgtgactcagcctctcaaatagctgggattacaggcacccgccaccatgcccagctaatattttgtatttttagtagatacagggtttcgccatgttgaccaggttggtctcgaactcctgacctcaggttatccgcccaccttggcctcccaaagttctgggattacaggcatgagccaccgcgcccagcctattttttttttttttttgactttttaagaaaagccattctgactggcgtgagatggaaagagatcacttttcaaaatgacttaggttggagccctgtcaggtacattctgaaaagagtccccagttgattctgaagtttacatcttcatgaaggagcactgaccttccgttcaattaccaagctctgcaaattttaccccctaaatatttcttgtgtctgtatcttcccttgtctgaatttaactctcgcttttgtcagtacatatacagtacttgtgaaaggtagtgaggccagacatcaatgtttttactgtttctatgttttttgtttgttttgttttgcttgtttgtttgcctcactacatggagtgactgggttttctcaaattattttcccagtgtccggtcactagctctgtggatattgagaggcagagttggtgcacagggcaatgactgatttgatggtgcagacttaacaagtaaggtttgagtctaaaaccaaaagtcgagcctgtggtacctaccacacagcataggtcctgactgtgccatatatagcatgcccctggtgggctgattttatagtttttgttctgggagtcatttttggagaccaagtgtagagcccaatgtctgtgcacttacacctactttgcaagcatcttgctgcctacattgatctgctttaagtggctacaatggtgtctgtttcctaaaactgaacccagaataatgtacaaaccaggcttacgtgggaaacagttggattttagaagaaagctttctgatctgattacagttatttcttttcctttgtatctgttatgtgacttccttcctacttgctgaggctggtttgtagatgccaatgaaactttctggaagctcacagaaaagcagcaactctaagctgtgattaacattgattgaacttgtagacttgtataaattattccaattccctactcaaaaaaaaaatagccagactcttcatgatcatggttcattccagggagtggcatgtcatgtccttgctttaatctgacagtgataaactggtgtttgccccacaacgtgccactctgtggatggcatggatgtattggaacccattgtctggtgggaatgtctgacatttttctttctttcctctggctgggttattctttgtatttggaaacctaatgcatgctttctgatactagcccttcaacatgatataaaatctttttgactcagagaagtctttaaattaaacaaaagttgagatgattggaattactcggttatgccaacagtctcctaacaaatgttttttaatatttggatttgactgcaatgcaagttttccaggaactctatctttgttctgtttttaataatgtttctaaatgacccttcaagtttgtgagattgtagtgttcggtattttttttttttatttacatagtcacataccaattttgaggatgataagtaatagccaagatgatatgttgtgcaacttgatgtgctacagttaagagaagaatggtgtccagtcttctaaatatattccttatatgtaagcacattgagcatatttatatgtggcattgtgtatgtacaaaatatatgagagttatgaatgtagaaactctagaacgtgacattctatttttacatttatccaacaggctcttccttcttaatatagtgaataagtaaagcaacaattaccaagaaataactgtacaggttttatatcacactgagctttggaaatttggatgtgagttttggtggtttacctcagtgaccactggagacttaatatccctattaaggaaagccttggccttgattatgggcatcattgaaagcactttctttcatacagggtcttagtacttcctctgcatttcagacacttgacacacagaggtgaataggatagcccttggcttcaaggaatgcaaattataatcagaaacaaagatacacaaacaaatacattcaatgaaataatataattaacagcttttttatttttaaaagagttttctaacagccagcttagcactttaagttcaacttccagttgaggctgagataatttaagtagctagcccaagattacagagctaatagaagaactggacttgcatccagatccgtttaaccagtgctttgattctatcctatatcatttgtacgtgttctgtagaaaagggagatgcaaagttgaggggagattgaccctcttgtcttgaggtaacagttgaaccagactctgggaatggataagtagaagttcaaaactggtcattaagtggtgagagtatgtctggtgggtgaatagcatggggaagggttggagaaatgtgcataagcaagacattttgcagataaacaagaagctcactatgacaggaagatacaatgaaattatttattcattccacaaagaactgttgagtgcatattgcctgtgggagattattctaagtactggtaatacagcaaagtgagtaaatggagactgtctcataggagatgagagtagagaagaaatctatcctcaaaacaagcagacttgttctgtgactcattaaatacctgaactatcagtggtggacttttaaaaacatctttttactttgtaatggcacaagtatttgtgtgactatatccagcatattttaaagcaacctccagacatgtcattccgcagggggtgcactgtagagagatatttactcagtatacagttgggaattctaatattttgagctgcttagtaaggaaaaagctgcccagaagcaataagaatgcacatgacttgaaacacccagacactggacaggtgcgtttcatgaccttctagaaggaggactgtagatgaggtgaggctgccagtaaatgactttacagtttttctagagctgaaattctacatgtttcccagtgtgcacaggaaattctataaattagggggaaaaggtagaagaaatagaaaaaatagtttttgcatgcattgatgttacaaatacagttcatatgaatggcccaaggacatcgataaaattaagtgaaaattaatttaaaataaggaaaattattatagcatgcattttcttatctgttgaatgttctattgtttcaacattagagtaaaaatgaagacccagaggatggttgtcaccatgtagaagactttgtcacagccagtctgtgatctttctctacttccccagctaatgaagtcctcctttaagtcaccagacccagtagatgattctggaagtttctagtgttagcgtgttcatacaggatcctagaccccaagacactgtatgatgtcatgggtgtgtatgatgtcatggatgtgtatgatatcatggatgtgtatgatatcatggatgtgtatgatgtcatgaataaaaggacagttattacttctactttttaacttaaaaatggaaaatgaaataattgtgaccagtaatgaaaatattagccttccttgcctctggcttttaggttttgcaaatcagtcaaggtgagagattagatttttttttccctgctagcctacgttattaaacatgaggctaataggattttactttcctcattgggattgaaaagtcactacttgaagactgtaatgtagtagaagacaagctcgctgaggacaggggttttgtcagttctgttcgtggcagtcttcagcacctagagcagtcccttgaatcagtagatagttgatcgatatctgtgtcatgtgtacgttagaaactgctcagaggccggtagtaatctcagcactttgggaggccaaagcaggtggatcacctgaggtcaggagttcaagaacaccctggccaatgtgatgaaaccctctctctactaaaaatacaaaaattaacagggcgtggtggcaggcgcctgtaatcccagctactcgggaggccaaggcacaagaatcgcttgaaccgggagatggaggttgcagtgagtcaagatcgtgccactgcactccaggctgggcaacagagcaagactttgtctcaaaaaaaatttaaaaaaaacaaactgctcagagacttttgggaacactgtgtcacctgacgttgctagaaataacccactgaaatgataagggctgttaaatctcggcctcatttcttttaagtgatgtaacttgtcttccatatattcagtatccttacacagttttaggaaactctcaaatttatgacatgatttaagtatatccttaatatgcatctggaaacattgttaaagagcagaatttccagccacgtgaggctgtcgtaaatgatacagcccacaggaagttgactacggatgtcttgtcatctgacccatccctttctacatttctgacaagcagtcagctactttctgaataatcccagtgacaaagggctcaccccctcagaaggcaggttacgtcactgtaggagttctgtaaacactagccatccctgttaggtagaactaacatctctctctaacttctactcatgcaacttcctccttccttgagatcaacacagagaatgtcaacacccggtcattcatgagaccacacttcagctctttgaaaacagctactgtattttatcttacacttccttaggctgaactccacttggtcttataaaaacaatagcagcaatagctactgttttttgtgcatgtacttagccagcacaaagtcagtttcaggcattttacactcatagtggctgatcatcacactaacgttagagaattcattaaactcactaccatataatgcaactaagatccaaaaatgttaggtaattagccccaaatcgtaaggcacattcagtggatgggtgacctggaatttaaaccctgtctgctagattccaacatctagaatgttatttccacttaagtaactatttatacagcaactaacccatccaacagcaatttattgcctaagtcaggcacaaatggaaataagatggatttcctttcaagtagctcagtctagtggggcagaagacacatagttacaaataactttaatatagtgtggtagttgatattgaatcccacctcctcaacttgtgaactatagaaatgtgggcaatctctttgtagttcatttttcgctgatgtaaagtaagcatattaatcatctacttcaaagggttttatgaggattgaatgggacagtacaggtaacatgcttaatgtgctccctggcacataaaaagtactcagtacatgacagccttaactctgtatgcacaagatgccctggaatcaccaaagaaggacgcctcatcctgcttggagacaagtggcagggaatggagaaaagcaggccctgtggggaggtcagggaatgctgttcaggggcagttacatctggagattaacatttgcattgagtctgcagaagatatcaggactagagggagatggatggtttaaaagttggcaaggtctacattgtagcgagtgctacaaatcatggtgtaggctttgcaattcttcctgtattcagggtgtagctgagagggcagaggtcactgaacagtttcaggttaagcggttgggtctcttctggatggctttttaaggctgtgaggaggagcatggatctgtggaagactggagatgagaagccaagggtaagaggttttcacagtagcctcagtaggaaaaatgaaggcatttgtaccagcatagaacaggaatggagaggatagggccaactgaagaatggaggcaaaaacaacaggatgttggaataaagagagggggttgagaataagtctcctgttttggctcaagttatgtaggtcaggtggtggcaccaccaatgaagggagaataagggaggtggcaggtttagagaagtctgtgaggaattctgtactggtggaagtttcatatgttgagtctggagctatgaaatacatgggctatagatacaggttagaaattctccagcatccagcctgcaagaggctacctgggcacaggtgagggatgagaagcagacgggcagagagaaccctggatctgcctacgctgatcttagattttactaagcccaaagtcatccacatttgctgggaaggatgtgcactaataatacagccttcctagattcccatgcttagataaactaatgacctggaagggaaaaaagaggacactgtagctttataaaagaaagaaaatatattagaaatgcaatgacaaagtctcctgggagaaatggcaaccttaccttaagaactgtagtgagaggttttggggatttttttgttgttgtcgttgttgtttttttttgcatcagatgtgttctatccaaagttttgtgtttaaatatgtacttttcattgttgaattacttccttactggctccggtttcttgctattaccaaaatggcagacatttcttcagaatcttcttagaggtacttctcaatattaacccaaatggaatctgtagactacctaagacatttatgatgccacaggcatgaaaagaggataaactttggtgttagatcaggatttcagttatgaatttgctgcatattatctgtggactcttgggcaaattagtgccttatttgagccttaacttcctcagctataaaaggaggtaataagtctactttatgggcttcattctaaggattatgttaaataatggataaaatgcatctgacatgtaatagatgctctacaattattggatgctatactaacattaccacccatgttattatttattatttttcagaaatctggtctttaggaataaacttttattataagtcagttgatactgatgatgatggtgatgatgatagaaaatagttacatattgctttactctgtgccgggcattattctaacacttcacgtctcttcacagatctgatccttataactgcacagtgaggcaggctctgctatcatgcccattttacagatgaagagactgagatttagaggttatataacatgcccaactgattggtttgggaataatcaaactgagattataaattctgcataatttctttttacagccctctaaaaggaagccttgatcatcggcttctcatgtccgtatttggatgtttccaaaatgtgtgcagaacatatgctgattaggggagttaacagaattttctaacattagctaagatgttttcaaaattgccttaatgctccactaacagtgtgacactctaaataatgttctgtctaatttcagcctgtgaagttgaagcagggaaagtataccaggtctcctcaaaagagcatatgcagcctttcaaggaaaacatggaacaatttattattcaaggtaaattccaaagagatgtgttatgtttttctcccctttcagcaaaaaaaaaaaaaaaaaaaaaaaaaaaaaaaaaaagctacaaggcattgtttaaaaaatacatattgctttaaaagggcttattttgacattacagaaaaacagattaagttgaattatgagtcacagggttgtaagaggctagcaatttgataaacatgctatttgtggataatgctcattattaatgtttgtttgcttgcatgacagtatatacactagatattagttaaaatagctcatcttttaaaagacattaacaattctgtgctttttgtgatagaaaattagatagtattattttacattttaattgtactgatgagctcatttcaacctggtatttatttggcttgtcaaaacattgtacccagggaacaaactatattgatgttgttcggatcttcagagcattatttgcagtttttttaatgggatacgccaatacctctggatattcaacacctgtcttccagggagcttaaaaacattataaatattatctcatggactcttcctgcatttctaggagataggcagggatggaaaattttagaagataataaagaaaaaaatttaacaggaaaagaaagcatctattaagtcttgatgtttgaaatcactgaaacttataattatatcaaagcatttactactcaaaatatttcaactttggaatgttccatctcttctaaagatcagatttatatcatgccatgctctgggaaagttcttgctgtttcaggaattctcctagaggctgacatggcttgagactgaggccaagaacactctgaagattggctccatactttattttgttataggttgttcaagtgtcattaatgatgatttaacaatgaattagtcatactacaatttgattaaatgttaggcacagcttttttaagatgggaaaatactatttaatcatttaagataattgtgaagattgaaacagaactctggtgaaattcataaatcacgttgaatgtcattttcaaattctgaggtcttcataacttagagtggaaaatctactcattgattcttaaccgaaatcattagtcctgtagtaaatattagggaacattgtaaactcatcccactcttagtagtgaataaaagtgaatcatgctttttccatctagtggggttgtggaatcaagaatatgtagcacattttttaaaaatgtaacaggaaataatataggtaaaagcatagaatattcatttttgtcttataagaagaaaggaatccttaatcctaggaggatttattcaaaaaagcaatcaagcaatttgctggatttcacatccaaaatataaacaaatgtcactcttattcttggtcacattatatgtgatttattatataatattttgaatctgcaatttatagaccaggcattgagactagtgttttccatactgaatagtgaaattatgttttgcaacacatttggaatttaggaattgtgctttcaaaacacagatgatcagccgaatatgatatctctggtagtcatttataatgatttgaaaggcagttagaggtgtttaggatttgtctagtagttccctggtaggaaagacgggattgcccagtcatactaactgtgtaagtaagtatctcttcagattttaacaaccttacgggttttttttttttttttgagacggagtctcgcactgttaccgggctgatgtccagtggtgtgatctcagctggctgcaacctccacctcccaggttcaagtgattctcctgcctcagcctcccgagtagctgcaattacaggcacccgccaccacgcccggctaattttttgtatttttagtagagacgggttttcactctgttggccaggctggtcttgaactcctgagcttgtgatccagcctcttcggcctcccaaagtgctgggattacaggcgtgggccaccgagcccagccaggaagatcttttaacctccttgttatgaaactcagatattaactttttttttaatacttctccatgttaaatgaaaacaatgttgtaaggatactaacctatatactgtattcttagaagtaggaaatgcttcacctttttgccattaagttaaacatgatgagtcttcatggcacctcttccactactttcagttgcctttttatttcttctttgcatctgttcgagttttctgtttctttgttcatttaaaaattcttttaatgctttcagtatgcccagctattctgttgggtatgacttacagcagtgaataagaaaatgtatgcgtcttaatggaccttacattctgcattacctggaagacaggtgataaaaacaacataaacaacagaaaattttttggaaaaaaacctatgtacatcaaatgtatgtagatcaagtgtgtcaacaatatgaaagaatagaagtctcactttaaacatagtcactctcaaagctgttttcaagaacatgtagggaaacagtggagttccgaatatgtttcctgttctagtccattttcacactgctataaagaattgcctgagactgggtaatttataaagaaaagatctttaattgactcacacttcagcacgtctggggaggcctcaggaaacttacaatcatggcagaaggcgaaggggaagcaaggcatcttctttacaaggtggcaggcaggagaagtgctgagggaagggggaagagccccttatgaaaccattagatctcgtgagaactcactccctatcataagaacggcatggagaaatggcccccatgattcaattacctccacctcgtctctcccatgacacatggattatggggattacagttcaagatgagatttgggtggggacacaaagcctagccatattatttcccttaaaatacatttttaaggccaggcccagtggctcactcccataatcccggcactttgggaggctgaggtgcgcaggtcacatgaggccaggagttcgagaccagcctgaaaccccatctctactaaaaatacaaaagttagccgggtgtggtggtgcacacctgtaatcccagctactcaggagactgaggcatgagaatcacttgcacccgggaggcagaggttgcagtgagccgagattgtgccactgcactccagcctgggcaacagagcaagactctgtctcaaaaatttaaaataaaggtaaatttttaagaagatagccaattcctttgcccccatgtttcttctagtttatcaggacatgattctaaaattaaaattataaactaaagaaaatgccatcttagcacaaataaatgccaaatctttgcttataattaggctttcatcaataatagtattcttacatcagcctctgtgcttagattcatttatatgggtatgattatatttttgtatatacaagcaaggtcttttttaatgtgcctcatcctcaaaatataaaatctcttgaacaattcaagaagctatgcccaacactgcccaaatgtctttattgcattagctccctctgtataatagaaacatctcttatccctgtaattcagctattgtgtggtctgtggtccacactctaagagtcttacggaattcatctagccctgcaacccattcaattttccctccctatcttcctagttctactgaagccaagatttcatggtctatgtttaaacacctcctcactgggaacatctctcacctctgccctaaaataggcagatttagagaatttagccctactgtcataaggcattcattgtttgtaaaggtgctagatatgtaccctccttgagagaattgagaatatactcactcaaaaattgttctgacggccacctggctttatattcttcataacacttatcactgtctgcaactgcatcatttatttgtccatcaatagtataagcttcattaagaaggcagttttgctttgcttcttgccgtacccctgtacctagaacaatgcacagtatagcatacactgtcttgctcaccaggcataggtctagcaacccttgttaagctcatctctttgctttctccatatttgcaccacaatattgagcagctgatcatttttgtatgcaggaaggtccttaaaaggacaccgactagtatcacgttaaattcataaacccactgacaactcagtttttttcctcaacaatgttactagatttcccttgcaaatttagctttctctatttctgagatttgtttatatcatcccttctcaaacctttgcaatcttcctgttccatttaccgatgactctaatgataacctcaccttatacctcgatgagaaacagttacatgattatacagaagctcccacacttacccaccatcacatctgcaaaccaacagcatctgaatctgtattttctgtgcatctttcactgcaagagaaggaaaaccctgctctcattaaaggcagatctttacccacatgctctggacctgatacttctatttttatccaggaatccactcctagagttacctccccttctctctcaacttcagttgtacgttttccttctgggcttgattccttcaacagcactcagatgtactctatcttacagagtgtgaaaccataagaagggtgctaaatatacacctatggcgaggacaagtctttttagtgactgttaatacttgattattagaggaatgattggggggtgagagagtttacgtatgtttattgcggcactattcacaatagtaaagacttggaaccaacccaaatgtccaacaatgatagactggattaagaaaatgtggcacatatacaccatggaatactatgcagccataaaaaaggatgagttcatgttcttcgtagggacgtggatgaagctggaaaccatcattctcagcaaactatcgcaaggacaaaaaaccaaacactgcatgttctcactcataggtggaaattgaacaatgagaactcttggacacaggaaggggaacatcacacaccagggcctgttgtggggtcgggagaggggggagggatagcattaggagatataccttatgtaaatgacaagttaatgggtgcagcacaccaacatggcacatgtatacatatgtaacaaacctgcacattgtgcacatgtaccctagaacttaaagtataataataataaataaatatatgtgtatatatatatatatatatatatatatatatatatatatatataaaagagtttaaagaaggaaaaaaacacgacacgaagaaatggacacaagcaaattggtagttgcgtcgtgggagggagtagcatgtgatgaggccgaacgtgtattcctggctgagggacttaggcttcatccagaagtcttggggagcagaagttgctcttggggagcaacagtttcccagtgatcaagggatcggtggaggcagattggacttggaagcaggagaccacttataagatcgttatggtacgctggtaaagaaatgagaaagccttggactaaggaagtggggatggtgctgaagagagaatagcagtgatggtactgaagacagaatagctgtgagggataataataagacagaaccaaatggacgaggagatgatggataggtgtctagattttaggtttgagtatctgggtgagtgggggtactaatcactgagatagagaatatgcatagacggaaagatttgaatggttggcatggttacccatatgtaaacacgcaagtgggcatgcccagtggacatgtgggtatatgagctgaacttggcatagagatctgagattgaggattggacatcataagcaaggtgattcttgcatggatgtggtcacctaggaggttaagaaaaattagatccagggatagtattctggaggagaatagcatttttaggatggacagaggaaaaccaggtgttagtagtcaggtagataggaagaaaattggcagatgaatttgttacggaagccagaattgggaagagtttcagaaaagggcaaatgcgaatactcatagcagcacatgttcaaatggactgggtaaatgaggactgaacaacagctaggcttgtggatatgaaggtgggggtcagtggacggaacatgtttctgggattggcataagcagacgctgattttctgagcttttaacatagaagtgaagaactagtgtgcacagctcttattgcgggacaactgtaactgatgcatacgtgttggactgaactcttgaatcagagttactataacttagcttatctctattttctgtcacatatgtgacaagaaaccatatgtgacataggatttttctgtcgcaaaaccaacatatgtgatggttttgtttttgtgcatgtgagatgaagacaactaattcttaatctccagatggtcattcagcatttatttacaatttggtgttaaattttctatttttttaatagcagaaaatgtgggatatagaaagatgagataaatgtgatcactggggactcatgttttcctaatatatctctcagaactcagtacactccttccttttttctctctctttatttttgaatctaatttgtagtttggacaaagtatacacacaaaaaacatattatcgctgaactataaagaaccttaggtggaatggatgacctttatatatggatctgctcatgttgaagtcactgggagagaaatacaagcctggttctcctttgttggccttcagtgctcccttagtcatatggtacattttgataagtgtgtattttaaaacttaagctcaactgtttttttggatgaatggcaatttctttaaaaaaaggagtgggggctctctccatgcttttacataaagtccctaccatgattttataaatcaaaaatagctaatgggatttttcactgaccttgctcttcatacttctacccgcctccccgcttttcccaaacatttcttctttaagcatagtaaattgtggctgaactaggggaatagaaccaaaatgaaaatgcataaatctgtaatcacatgcttataattaaaagaatgatgaaacctcagctcttaaatatacagtctgtagtattggtaatgctatacttgagaacaaagagatgctgaaagcagtggctgttgactgtgccaaagactgaagagcctagtagaagagaatatctttctcagaaaggaatattctttatgcagggtgagcatgtttcatgttgtacttctgtgtttttctgaaaatatgataaagacactttttccagtaatgaaaacaggtatgtttgattttttggtgtaatctcccttcattgaccatttaatgttgaaaaagaagcaaattgtcttttaagcaaaccgctttttaccattgtgaatttggtgtgatttgttgtagatttttaaattttaatgaatttggtgtgattttctgtagatttttaaatttcccttttggagagaaaaaccaaaacacttgccctgctggtaaatcatgggacttcgtccaagcccttgcttggcccctcccagttttaagcttgaatgagggcaggtctctgggaccctgccccttgcagcaggagcatcttgtctcgtgtgcgtgcgtgtgcatgcatgtgcaaatgttccctgagacccaggacagaggctgcatcctaagggctggttttaccctcttttcattctgtatgtcctcccccacctgcctgtgaagctctcaaggtcctgccagctctacacgtccccaactctgtttctcccctccctttatactaggggttcagaacttccagccagaagccactgcccttgtactaccttgtccccaacccctttgtcccctctgccccccagcctgcttcctgcctgatggctcaggtgtccccatgctggtcatgctggctcaggctgcaggagcaagcctgggagacttccctgcctctgccactttgtgtgggtaattgtgctttaggggaaagtggggggttcagtaaatttctggtgcactagtgggaaaaaaaaggtcataggataacaattattaaaccttaatgctatttctgctgtgctgaagaatgaagcaaagccatttatactccaggcaattttactttcgtgactctttaggtcagtctgagcagccattattatcctcattttacgatgaggaaacaaattctcagagggctcattgcttgactgaaatacaatagatggcaaagtcaggctggaaccaagatcttttaaaggaggctggagcagtattttaatttaaaaatcattgtaatatagtaagagacccagatagggccgttttgtggtgtcaggtggtagaaaccataaatacagatgaaatcccatgtaagataatcaattaaactcaaaagtcaccaataactggactgcaaaatgaatacgcttttgtattagtgcaacattcatgcggacaccgtgaaccagacggacaaaactctttcctctcttgtagtgacaaatgatgattccattttaaaggtacctttcttgccactcttaacatttgagaagcatgaatttgaagtgattcttctggaaacaaaaatagtttatatcaccacttctctctgagggttagatttccagcagccacaatcattcattccacaaccgtagatgagacttgatcaaagagcctctgaggagtgacagggaatcgattccatatgggagtccctaaccaccgcctcctgcatatttccagtcggatgctcccactggcacctcacactaaatatctccataatgtgttccatgctgtgtcttcagcacctagtacgtcgcagactcccaataaacatttacttcacagatgaatgaatgaaggaatgactgtcaattcaacacaagcatctcagttcttctgctccgcttgtgttctctaacactgtaagtagtgctaccacccatgtgattgtctaagacagaaagcttggcctcattcttcatttctctatgaatgagtgctgggaatgtttaaataatgcatgtatctattataaaatacaggaccataatggaatgtaagtcttctcactattactgttctctactttaaccaatgttgtatttcatttctagccttccagagataatttgcatggataagcatgtatgtgcatatatagatatagatatatacacatatacatacatacatacgtgtgcatatatatacatacatatgtgtgtgtatatatatacacacagacacacatatatatacacatatacatacatacatacgtgtgcatatatatacatacatatgtgtgtgtatatatatacacacagacacacatatatatacacacacacacatttgtatttatatagtttttactagtggttacatgctctatatgtctttctgccttttgccttttcatttccattatgaaatattttatatttctttgttttatattttctatatagagataactatatgcaagtgtatatgttttagatacacacatacatacaacataaaattttgtactatattcattttatgttgaacacaaaaataaaacattttattattcatacactatttatgtgagacagccaattctcctcattttctatagttaggttttatagagtcactgcgaacactgaattagtgaatatggaactattcttctatggggaaatacaagtttaggtgcctgcaagcctgtggtcatattcttgtcaactaattcactcataactttgtcttatgtgtgtttatgtttaatgacaccttagctaataatatacattgttcattcattaatgttgaactcatggctggcaacactgttactcatgccttaatgaactttacttaacacatgtattttctccataaggtatatcacagccatcttgcacataggaacactagctaacaactgagcactctgcttgggggccatttaaaacagtgaaattaccaaaaatcccataaagatgtggaaaatgtggcacaaaatagatggtgacaagggcacttttcacagtgtaagagctgaaacaagaaggcagagtgttaccttgcaaaacctcagctggaaacatgctagtttatataacaaaaataaggttatattatagatctatatgcatatcttataacctaaatgaggtataaagatgtatcccaatagccatatacacccagctcacagaatagaacatgatcaataccggtcagtcagctcttccatttatctttctccaatcttatacctgtgtccccttcagaaacaaccactatcctgaattttctatttatcattccgatgtttattctttatagttttgccaaaaatgtaaatcataaccaacgtattgtttacaattttaggaactttgtgtgactggaaatataagcataccctgctgcaacttagttttttctccactgaacgtggtttttgaaattctttcatgtttttgcatgtggttctatttcattaatttttattctattgtaggactataatagcacagattgtctatcctattctatccttttttttttttttaaatttgagatggagtttcgctcttgttgcccaggttggagtacaatggcacgatctcggctcaccgcaacctccgcctctgtttaaagcgattcctctgcctcagccttccaagttcagccttccaagtagctgggattacaggcatgagtcaccacacctggctaattttgcatttttagtagagggggggtttctccacgttggtcaggctggtctcaaactccccacctcaggtgatctgcccgcctcgacctcccaaagagctgggattacaggcgtgagccaccgcgcccggccctctatccctgttttattgattatggacaatacttatatgaacatttgtgttcacaattcctgatccacatccatactccctttttgtgttgcaaacctaggaggtttgctgaggtgtgggacaagtgaatcttctgcctcggaggtaaagtcaaagtgtttttaaaaatgattagttctcatctgcacttctatcggcagagttccaattgtgttaaatccttaccagcaccgagttctttgattttattttttttagttgtttttgacccaattgactctttaaagtggtatttcgttgaggttttcacttgcattttcctgattatttttgagaaatcatgtgttttcacacatttatagttgtttccttttctctgtaatgccattgtgagtcttttggctgttttttaatgacttgtcttttacttattgagttattaggacatctttatatattgaggacattaaaatgtggtcagataaattttcccaagccctgctcccactttggagcttgtcttttcatttttcttttgctgactattgattttaaaagttctttatttctatgtagtgatatctatcaacctttttcttgatggtgcataatttttttgccttatttaagaaatccggcggggggcagtggctcacgcctgtaatcccagcactttggaggccaaggtgggtggatcacgaggtcaggagatcgagaccatcctggctaacacggtgaaaccccatctctactaaaaatataaaaaataagccgggagtggtggtgggctcctgtagtcccagctactcgggaggctgaggcaaaagaatggcgtgaacctgggaggcagaggttgcagtgagccgagatcacgccactgcactctagcctgggtgacagagcgagactcagtctcaaaaaaaaaaaaaaaaaaaaaaaagaaatccttcccttctctaagttggtaaagataatgtcctttattttcccaagaaaattttatagttttgctttcacatttaatccttcagtctatttgaaattcatttttatctatgatctgcaataggaatcacatttaattttacgtcatatggataatgctgttttagttgtttagtgccatgtaaggaataagccgttttctctctaatatgctgtaccatttctatcatgtaggaactttccatatatgtatgaggctttcttgggttttctctatactattccattagcctatttccattatttatccttataacaaaacctgttactattctatttactgtagacttctaataagtcttgaaatgtgaaaaggctagattcctaccttctttagatttatgcctcctcttggtagtttattctgctatataatttaagaattaagttgttaagttccaccaaaacaaaactattaggattctgacacaattacacaggctatagatcagactgggtagaactgacatctttatgatatcaaggctttctatctatgaacatggtacagactagtgtttatttatgtttcctttaatatctgcccaaaaagtttaaaatttcattaagatttccatatgtttttgtacaaatatttctaaagacctcatttttgtttgtattttgtaaactgcatttactctattttgaagatatgtaaaattcaaatagcttacatcttacaaacttgttaagccctcttattaatttaacaatttgagatattaaaaaatttctctggcgatatcactgcgaataatgacagttttatgtatgtatgtatttatttgctatgtagtttcttttttcttccttttttctggtcattttgcactgtgttgtacctttagtataatatggacagaaagagtagaaatgtcatttcacaaaggggcataattagaggaatacaaataaatattttggccatctttgtaaacaaattaacacaaattgattggaggttttcatatcatttaattttcccctctactacttttcaagtgatattctgtatctttattcttttagtgcctatcttggatatattgacacagttctttttattgtgtatatttaaagtgtacaacacaatgtttatatatatatatatataaacacagagtaaaattattcgtcaagcaaattaacatattttatcatttcacataggtaccgtgtgtgcacgcgcacgcaccctgtgtactgctgaatagacagatctctggacatatttatgctacatagctgcgattttgtacactttcacctccatctccccacttccctccacctcctgccttttctactctttgtttctaggcatgcaagttttttggttttgtttttagttgagatttcacatataagtgagatcaagcaatatttttctgttaacacaattatttagcaaagtctaaagttgctgtttttacttccctctaaacaaattcttagcatgttttaatgctaatcttaccatttgaatgccattcctttccagtgttttagtttcattttatattgtctgttacccctaaaatatagaattattattttatgtattcatttttggtttacatttaaccaataccattgtcttggctcactattccttcatattatgccgccttctaagattatttttcttctttctcaagtacacccttgaaaagttgctttggtgtgaactccggattgtaaattctgtttttgtctgtgtgaacatatctttatatcaagcctgttttttagcaatagatttgctaattataaaattctaggttcaaagtaaattcctttcagccgcctggaggcctctgctttctctattcccttgttgcattgacaactctactcgggtccaatttttgcttctttgtttctaatctaaattttccctcaggatcttttatgtttttctgtttctccatatgtttgttttggctaatcatcaggaggcactaccaacccaaactattttaaaataaatccttgccttgcatgttaggatcacacattgggcgtttggggcctaatgcagtgtggttgcccatgatgggtaagggattcctatgtgagagagtttccccttcccccaaagctactggtgaggtggatgcatttccttaatgcctgatttagtggggtgattcttttcaatttcttcttttaagatgtctctgtggttatgtcggacgatttgaggcctgttcaaaaatttcccatatggccttaaaaactaaagttctaggttgctaggtttagcgatgtcctgaggaagttctggcttgcacctctttggaatcctgctcctgtttgtttttatggcctcagagaattttccttattttctatccaactcagccatgcattcaatattactttaccccagcttttttgtgttctttgttctgaaactttttgatatctatagtcttgttgaaattagaagtctatcttgtttttttcaatgaaaatatatttaaataattttacattagtacgttcttcttaatgacttcatagtatttcactataaaaatgcacccaaacttacttgctcatttctctacttacccaccttttttctaaaacattgttttcaaaagcaaaagattatggtaaaaacatgtgtgtatgtctcacaattcacatttggtactgtacagcccgaaatgttgagctgctgggtcaaaagcagtattagccttattcttgatgcctccttttctcccatacccttgccatccttgctttccttacctcatcgttgttaagtcctgtggctttgctcacatgtgtccactccactctaatcccattgcatcaacctatctcagacccaaattatcactttttttccttaggctgaccgtttcctaacaggtctcacttttcctcatcaccgccattctgttaccgtataatcaccaataacctgatagtaaccttcagtcttctggaaaagattgaataatgttagtataataaattattaaagtgtgcgactactcattaaaatttatgtttaaaatatagagctaatatattttaaactatgtaaaatatcaaaaatgtgtgtttatttatttttgggagaaggagtccttgctctattgcccaggctggaatacagtggcgggatctcaactcactgcaacctccgcctcctgggttcaggcaattctcctgcctcagcctcctgagtagctgggattacaggcacatgccaccatgcccagctgatttttttttattttttgttttttggtttttttttggtagagacgaggtttcaccatattggccaagctggtcttgaactcctggcctcaagtgatacccccaccttggcctcccaaagtgttgagattacagtcatgagccactgcgcctgacctgaaatgtatttttaaaatataccttatttgcccttcatgttagataatacaaaattaattgcatattttttcatggttaagtctaagctttccttccttaggttctgggtacttggatatgctctgccatgaagaagaatcctgaccaaataaatggttgtgttcttgtagctgaacctcaattacattctttagtgactgacgtgaatcttccagttttttttgaagaaaagtcagccagaaactgagttcaagactagcacttttaaaattttaaaccttttttgttaaagcaattctggtataataaaacccaagggtccatttgtatagttacctaagaaataccaacgtgttgattcagaagtaaatcgtcataacatattaaattgcaccatttaaaattatgatattttctggttaatgtctaaaatctgccagtttattaattttctgcttgacacatgttctaactacatgttacttgggcatttggatcattagggaaataagagttgagtgtgtttgttgtacgttgtctatggtttcctaagtctcctctgaagataagcaacacttgtgagacagatgtgtcacacagtggagggctttggtgtaattaccgctctctgttgtgcatgaataaaatctaagtgaaacactgctaaaccatgttaacttatgagaagggtcagctgggcatggtggctcatgcctgtaatcccagcattttgggaggccgaggcgggtggatcacctgaggtcaggagtttgagaccagccaggtcaacgtggtgaaaccccgtctgtattaaaaatacaaaaattagctgggcatggtggtaggcacctgtaatcacagctacttgggaggctgaggtagaagaattgcttgaacctgggaggcagaggtttcagtaagccgagatcacgtcattgcactctagcctgggcaacagagagagactccatctcaaaaaacaaaaacttatgagaaaagtcatctaactcatatggcaaatggtctcatatcatgtgccaaatctgacagattgatactggcttaatggaagtgtgttttgaggataaatcttaggtcttacctgaattcttgggtttgaaagagtagcatgagtaattagtgatttctgaaatatgatagggaagaattgagtagtagcaagtatttttcctccaatgatttcttatttttttcttcataaagtttatgcttatatttttatagatggaatatattatatattttgtatatattatatatgctatgtttatatgtaagaaataggtataaaatctatagagatttattgtatgttaaaggaaaaccaaacctaaatcacttttggaggaagaatttctttttttttttttttttaaggctgttttgaaagcttgtatacaggcatccctgggagatattacagaccaccacagtaaagcaatattggttccagaccaccacagtaaagcaataaagcaagtcacatgcattttgggggttcccagtgcatataacagttacatttatgctatactgtactctattaagtgtgcagtagcattatacatttaaaaactacgtacataccttaatttaaaatatatttaaaaatgctaacaatcggctgggcgccgtggctcatgcctgtaatcccagcactctgggaggctgaggcggacaaatcatgaggtcaggtatacgagaccagcctgaccaacacggtgaaacctcacctctactaaaaacacaaaaagtagcgcgcgtggtggtgcacacctgtaatcccagctactcaggaggctgaggcaggagaatcgcttgaacccaggaggtggagtttgcagtgagccgagatctcaccactgcactccagcctgggcgacagagcaagagtccatctcaaataaataaataattgctaacaatcatcttagccttcagcaagttgtgatcttttttctggtggagggtcttgcttccatgttgacagctgctcgctgacaggtcagggtggtggttgctgaatattggggtagctgtggcagtttctgaaaataagtcaaaaatgaagtgtgctgaatcaattgattcttctttcactaaatatttctatatagcatgagatgctatttggtagtattttacccacagtagaacttctttcaaaatttgaatcagtcctctcaaaccctgctgctgctttatcaactaaatttgactttctaaatcttttcttgtcatttcaacaatgttcacagcatctttaacaggaatagactccatctcaagaaatgacttcctttggtcattcataagaagcaactcctcatccgttcaaatttcatcatgagcgatttgctgcgatttggtcacatcctcaggctccacttctcattctagttttcttgctgtttccaccatttcttcagttctttcctctgcggaagacttgagcccctgcaagtcatctgtgaggtttggaactcacttcttccaaacttctgttaatgttgatattttgaacccttctcatgagtcaagaatgttcttaatggcatctagaatgatgaatccttttagatagttttcaattgattttgcttggatccaccagaggaatcaatcactacctacagcagctatagccttaccaaatatatttcttaaatagtaagacttcaaagttaaaatgaccccttgatctaaatagatgttgtattagcaggcatgaaagcaaaatgaatctccttgtattaaaaacatctccatcagagcttttgggtgaccaggttcatggtcaatgtgctgtaatattttgaaaagaatctttttttctgagtagtaggtctcagcagtgggcctaaaacactcaataaaccatgctgtaagcagatgtgctgtcatccaggctttgttcttccatttatagatcacaggcatagtagatttagcataattcttataggctgcaggatttttgaaatgatcaatcagcactcacttcaactgaaagtcaccagctgcattagcccctacaaagaaattcagcctgtcctttgaagttttgaagcaggcattgacttctctctagctatgaaactcctagatggcatctgcttcttgttttatctacactgaaaatctgttgtagtgtagccaccttcgtcgattatcttatctagatcttctggataacttgccgcagcttctccatcagcacttggtacttcaccttgcacttttatgctatggagacagattctttctttaaatttcatgaactgacctctattggcttcaaacttttcttctatagcttcctcgcctctcttagtcttcatacaattgaagagaactagggccttgctctggatgaggcattggcttaagagaatgttgtggctagtatgatctaatcggaccactaaaaatttttccatcagcaataatgttgtttttgctttcttgtccttcatttcttcactgaagtagcactttaaatttcccttaataacttttcctttgcattaacaacttgtctgtctcacgcaagagaactagctttcattctctctccactttggacatgcctaagtcactaagcttaattatttctgacttttgatttgtaactcttttttcacctgagcacttagaggcctgtacagtttttaattgtagggttattaactgtatggttattaattggcctaatttcaacattgtagggttattaattggcctaatttcgacactgttgtgtctcagggaatatggaggctgagaagaggaaaagagatgataaacagccttttggtggagaagtgagaacacgaacagtatttattgattgtttgccatcttatgtgggcatagtttgtggtgccccagaacaattttaataaatacatcaaagatcactgatcacagatcaccataacagacaagataataatgggaaagtttgaaatacggcgagaattaccaaagtgatatgacacaaagtgagcacatgatgttgtaaaaatggtgccaatagtcattcgactacagttgctgccgatcttcaatatgtaaaaaataaaaaataaaaataaaacaaaaattaatacctacaaagcacagtaaagcaaagcacaataaaagcaggtatacctgcaatgagatgttatagctgcaacacagaagatggttagaaggcatacctaatggatctcatacaattcatggaagtgtttttattaataaagcaatgcatttaggaatatttgttgctctaaccatcaaatgaaatatttacccttttgaactttcctattcccatccatttcccggcatgaaacttcagaggcattcttaactctagattgtctctcacatggctttctactttctatccacattatcataatagtttctcaattgatatgtctgtctccagcctccattccctgcagttcattccccagctgcaagggtgacctgtcaggttttcagggtattgtataaatgtctccattgctttgacagtgttgtttaatatgtctttactgattttctttctaatttatttatcagttagtaagaaggctgtaatctctagttacaacttttgattgtctattttttctttctgttttgtcagttggggaattttgtctttctttcattttatttttcttagtttttgcattatgtattttgaagttcataatacttttttggaggcaaacataggtagaattgttatatcttctttttgaattgatccctttatcattatgtattgattctccttttttcctggtactatatcttgttctgaggtctgatttgcctatttttaatacagctacttcagctttattatggctagtgtttacataatatacccttttatcttttactttaaacctaattgtgtatttatattttaagtgaatttcttttcctagagagcataaagttgagtcttatttttcttatcctgccaaacaatctctggcttttaattggggacatttagaacatttacatttaatgtagtaatgatagagttgagtttaatttatgatctttatatttgtctactatttgtttcatctattgttttccttctttttttctttcccttttttcttattaattagtattttttaatataatcggcccttcatatctgtgggttctgcatgtgtggattcagtcaactgcagatcaaaaaacttcaacaaaaaagggatgttcgtacctatagaatgtgtatagacttattttcttgtcattcttctccaaacaatacagcataacaactgtttacatagtatttatattatattacatgatatttacattattacagagataatttaaagtatatatgaggatgtgtgtaggttatatgcaaatactgcatcattttatataagggactttagcatccatggattttggtatctgtgggataccatagatgaactagtctcccatggatattgagggacaactatatttcatcttatttccaccattggcttatatgttatacatctttgtttaatattttcagtggtcactctagtggtgtgcccctttaatttatcacagtctatcttcaaatagtattacacaacttcacaggtgatgtcagaactctacaacagtatactgtcattctcccttctgttgtttgtgctattgttgtcatatattttacatctacatatgttataaccaaaacaatatattgctcctacttgcatttaagtcattatcttaaaaaaattttaaatgacaaaattgtattttatattcatcctcataattagcatttccagtttatttcactcatttgcatagatccagcttttcattaggtatcatttttattctacctgaataacttccttaacatttctcattatgtagatttacaggtggaaaatttatttagccattgctttcttgaaattatttatttcccatttttgagagatattcttacagaatgtagaattctcagttaacaggttttttttttttctttctgcagttaagatattgttcttttgtcttgtgtttgcatagtttctgacaaggaatctatattagttttccgttagtgctgtaacaaattaccacaaacttcatagcttaaaacaatacaaataataaatttgtaatttcttcaggtcagaaactcaaaatggacaaaaattatattagcagtgctgtgttccttctggagtatctaggggatacatttctttgcctttttttagactctagaagctgcccacattccttggtttatggcttctagctatcttccaagctagccatggctggttgaggttttcttgtgatgtatcactctgtcgctaactctcctacctttctctttcacttacaaggacccagtgattgcactgggacaacgaggtataatacaagatgagcttctcatcttaaggtcagctgattagcaaccttaattccatatgcaatttaattcccccttaatttattatattatattcccatgtaatatatttacagctggggattaataaattaattcccccataatttattatattatattcccatgtaatataacatattcatagctggggattgggacatggacatttttagagggccattattctgcctaccacaaagtcttgggaatttatatttttgttacttgttataaaatgtgtttccccactccttccccatctaaactctggttgtttttaaattttacctctattgctagtttataggatttttattatgatgtgcattggtatatgtgtatatgtgtttttctctttcttttttgtttcttttttttattttttattattattatttttttagacagggtttcactcttgttgcccaggctagagtacaatggcatgatcttggctcactgcaacctccgcctcccaagaacaaacgattctcctgcctcagcctcccaagtagctgggattacaggtgcccaccaccacacccagctaatttttgtatttttagtagagatggggtttcaccatgttggccaggctggtcttgaactcctgacctcaggtgatccacccacctcggcctcccaaagtactgggattacaggtgggagccaccatgtctggctgtgtttttctctttcttgaggttaattgggcttttggatttaggtgtttattgtgtgtatcaaattgggaaaacttttgaaccttatcccctcagtgatttttctgtctccatctctcggtttgttctgggactaaaatgatacattatgctagaatgtttactaatgtcacagttcatcaatattctgctctcctttcaatcttttcctttatgtgcttcagttggaatagatccaaattttacatcttaaagtttattgttattttcctctgcagtgtctaatcttacgtgatttccattcagtggactttttatttcggatactgtatttttaactttacaagttccactgagttcttttgtttatatcatccattttcttctcattatgttcatgtttttctttaatatttgagggtggttactaaaaaactacattcgtattaatatccttatttgctggttcatctcctgtcattcctgggtctgtgtctattgacttaaagaatgtgattgcgctttcctgatacttggttggtctagtaattttcttattaagtgctagacactatgcacattatgttgttgggtgtgtaggttttgtgcatttctttagaatatttggctttctttaggcagataatttaaacaacatgtgactcagttgatccctttaaggcttgtttttaagctttgcttaggctagtctggggcatccttcatgccagtgataatttggttttactaataatttacctaccccactgaggtctccaagaccatcctgtctcttgtgatcagtgacagctctccactctggctctttagacatcgaacatcttttggccctgtaaaagctttgggaattgttaagcttatattttcttggtggttctttgcttgtacttgtataattttactgtatacaggtgccacttaatacccagctaaaagtcagaaagcttaatgcagatttttgatccttcttttctgcaaagtatttcctctctggaactctgttcctcatcttttagtcatgtcagcctacctagacttctatctgtatttcctcaactcagcaaaactggttggcttatttggggtctcctttctagcatctatgattttaaaattgcttttagacagaaatctaggaagattgaagggcactacacagatcagactcctatactgcttatttttcagtatatgaaaacagtttcatatattaaatacatttttctagttaattacagcaggagggtaagtttggttcttttcaattaagtccggaattaagttcaattaagtggaagttccacttcaattaagttgataaaggatcaacaaaacaaaacgttggtttcttgaaatgataaacaaaatagatagaccactagctagattaaccaaggaaaaaaagtggaaatatttttccactggtttaaatttaacacaattcatcaggtcaacaggatttcactatccaaaatatatatgcacccaatagcagagcacccagattcatttaaaaaaacatattggtggacctaagacaagagatagacagcaatagagtaatttggggacacttcaatacaccattggcaacattagtcagattataaaggcagaaaatcaacaaaggaactctgggcttaaactggactctagaccaaatggaaaaacatttatagaatattctacttcacatcaacagaacatatattttttctcatctgtccatgaaacattttccaaaattgaccatgtgcttagccaaaaagcaagtttcaatgaattttttaaatgaaaataatattaagtgtcttctcagaccacagtaaaataaaattgaaaatcaataccaagaggaactctcaaaaaactacacaagcatgtggaaattcaacaacttgctcctacaaaacctttgggtaaacaacaaaattaaggtagaaatcaaaaggttttttgaaatgaatgaaactagatacaactgctactgggtacatatatattttggataattaaatcctgttgaactgataaattgtgttaaatttaaactagtgggaaaatatttccacttttttcccttggtcaataccaaaacctctgggatgcagcaaaacagtgctaagaggaacgtttatagcattaaatgcctacataaaaaacacagaatgatctcaaattaacaatgtaacattgcatctcaaggagctagaaaagcatgaacaaaccaaactcaaaactagttaaaaaaaaaaaaaagaaatggcaaagatcagagcagaactaaatgagattgagaccaaaaaaaatgataaaggatcaacaaaacaaaaagttacctctttgaaacgataaacaaaatagaccactagctagattaaccaaggaaaaaaagattaaaataagcacaatcagaaatgataaaggtaacaatacaaactgataccaaagaaatacaaaaatcatcagagactattatgagcatctctatgcccacaaactagaaaacttagtaacaagtaatgaaattgagtcagtaatttttttaaaaaaatctctaaacaaaaataagcccagaaccagacagatgaacagccaaattttaccagatatacaaagagttggaaccaagcatattaaaactattcaaaaaaatcaaggaggaggtgttcctttgtaactcattcatgaaaacagtatgaccctggtaccaaaatcaggctagaacacaacaacagaaacaacagaaaacaaaacacacaggggtatatctctgatgagcatagatgcagaaattctcaagaaaatactagcaaaccaaatccaacagcacatcaaaaagataatattatacatcaccatcaagtgggttctattttaggaatgcaaggatggtttaacatacacatgtcaataaataataatttaccacacaaagagatttaaaaaaccatatgatcatcctttttcttttttttagacagattctcgctctgtcacccaggctggagtgcagtggcgaggtcttggctcactgcagcccctgcctcacaggttcaagcggttctcctgcctcagccttctgagtagctgggattacagaaacacgccaccatgcccaactaatttttgtatttttagtagatacgggacttctccatgttttccaggctggtcttgaactcctgacctcaggtgatctgcctgcctgggtctcccaaagtgttgggattactggcatgagccaccctgcctggccaatcatcttaacagctgcagaaaaggcattcagtaaaatccaacattgcttcatgataaaaaccctcaacaaagtagacattgaaggaacatatctcaaaataggaaccatttacaacagactcccaggcaacattatatggaatggggaaaagattaaagcattttccctgagaactggaacaagacaaggatgtctactctcaccactcctaatcaacatagtgctggaagttgtagccaaagcaatcaagcaagaaaaagaaattaaagacattcaaattggaaaagaagaagtcagattatctctcctcactgatgacatgatcttttaaacctagaaaaccctaaagatccctccaaaagataactagacctaataaatgacttcagcaaagtttcaggttacaaaataaatgtataaaaataaatatcatttctgtacacgattaacattcaaactgagaccaaatcaagaacttagtcccatttacaatggccatatacacagaagtaaaacacctaggaatatttaactaaggaagtaaaagatctctgcaaggagaactacaaaacactgatgaaagaaattgtgtagatggcacaaataaatgaaaaaacattctgactcatggatcagaagaatcaacatcattaaaataccggctgggcctgtaatcccagcactttgggaggtcaaggagggcggatcacctgaggtcaggagttcgagaccagcctggccaacatggtgaaaccccacctctactaaaaatacaaaaattagccaggtgtggtggtggctgcctgtaatctaagctactcaggaggccgaggcaggagaattccttgaacccaggaggcgggggttgcagtgaaccgagatcgtgccactgcactccagcctgggtgacagagtgagactccctctcaaaaagaaaaaaaaaatgaccatactgttcaaagcaatctacaaaattgcagaagtgcaattcctatcaaattaccgacatcatttttcacagaaaaaacaatcctaaaattcatatggagccaaaactgagcctgaataaccaagtaatcttaaataaaaagaaaaaaaaacaggcatcacgttttgtagcttcaaattgtaccacaagactatagtaacccaaactgcatggtactggtacaaaattaggcacaatagatcagtagaacagaatagagcaccaagaaacaaagccacatatgtacaaccaaccaatcttaaacaaagctgacagaaataaacaatgagtaaaggacactgtattcaataaatggtgctaggacaattggatagccatatgtaaaacaatggaactggaccccagtctctcaccatatacaaaattttactcaaaatgggctaaagacttaaatgtaatacctgaaactgtaaaaatgctagaagaaaacctaggaaaaattcttctggacattggcctaggcaaagaatttatgacaaagacctcaaaagcaaatgcaacagaataaaaaatagataaatgggacttagttaaatgaaaacgcttctgcacagcagaagagataattgacagagtaaacagacaacctatagaatgggataaaatacttgcaaattatgctcctgaaaaagaattagtatcaagaatccacaaggaactcaaacaactcaacaagaagaagacaatcccattaaaaagttgacatttcttaaagaagacatataagtagtcaacaaatttatgagaaactgctgaacattattagtcatcagtgaaatgcaaattaaaatcacaatgggataccatctttcaacagttagaatggctattattagcaagccaaaaacagcagaggtagacatggatgtgcagaaaagggaatagttatatactgttggtaggtatattagtacaacctctacaaaaaacagtttggggattcctcaaagaactaaaaggagaactaccattcgacccagcaatcaaccccattgcttggtatctacccaaaagagaagaaatcattgtgtaggaaagacacctgcattcatatgtttattacagcactattctcagtggcaaagtcatggaatcaacctgtatccatcaacagcatcacaacagatgactggagaaagaaaaaaaatatatatatatatattctttatatatggaatactactatactatgtgtactaccatatatatatggaataccactcagtcataaaaagaataaaattgtgtcctttacagcaacatggatgcagctgaaggctattatcctaagcgtattaacacagaaagtgaaaattaaatgctacatgttctcactttcaagtgggagctaaataatggctacacatggacataaagatggaaacaatagacctggagtctccaaaggtgggaagaggaagaggagggaagggtcaaaaaactacctattgagtaccatgtttattatttgggtgatggattcaatagaagcccaaacctcagcattatgtaatatatctatgtaacaaacctgcatatgtaccccagaatctaaaataataatatttaaaagaaagaaatatattctaggcaaaaataaataaaatgaacacagttcagcctcttttgctttgcctgttgtatgatcacaccatgagaggctggtgctgcctctgcacagcatttttgccagctcttttccattgtatttccagttttgtctcctttatctttcttcttgacatctcgaactatggtgcacctttgcttctgtgtcttttttcccactgttcattgtttaccctctccggtctctgctcctttttctacttgactaagacttgttcatcattttagtcccaactcaccctgcattgcctttgtcttttccttattgacttctctctcgataggcaaatggatgtttcacttaactgtactcataactaatttgccagtgttaaggctttggagtcagactccatgagttggaatcctgtctcatttatttagtgtttctggaatctaaatcaagttttttaattgctaatttcctgattttaagtgggaataattataaaccctttcttacagggttttattatcttgggttattatatgtaaagaattagaatagtaatatcaacatcattccatattaacattcccatttaaacatctctaaaacatctacatgtatgattatttgtctctctctccatctaccattttcttaaaggaaaaaactatgtaatatttacctgcatatgagtccccaacaaagctagacattcaaatgttgactgaaatattgtaatgttaaattatgtggcttttgtctgtaggattggaatgacctaggctttaagcattgttttggcaagtaagattaggaagaaaagaaacacatcagaagtttttttggctttcttatttttgtttccagcagttttgtgttttgatagtttgaatccctaaattgaaattaattggtattgctttcaatatggaaagctcagccctaatgcgtgtatttacttatttttagttaaaggctcaacgaggttttcgttttatccgaaggatttttatttaagttcagcctggtattagtaagtatgtatgcttcatttatattcttcaatagggtagttgtctcttagcaaagaaaaaggaaaggaattggcccaaggcatgtctttatttctatgctacattagtgaaagtccaggagagatttgcttagcctgtaggtagagtaatatatagatttgggtatgatttgatataaaaatttagtttgagttagcaattttctagttggaaaattgttccagctcctttagactgtactgtctactgtactgtctagctcgtggatgcgtattatgttttcccatgtcttctctactttgggtttaaaacgaagatttggagaggaatttcactgaggaccacttcaatacgtacatcaggctgggtgataatagcacacggctttcctgtattttatgtttggctggaagccacatatagaatttttaaagtatgtgtcattttctattatgtatatgtttcttgagtttttaataactagcccccatatgtttatatacacctatatttctagaggcacaatgatatatatatatatttatgtacaaagttgaaataaccctcagtattaaataaaaggtagctgtaaattattgcaaaagtcaggttgacattttatgcctcaaatgctctctttcttcctcctaggagtattccacaacattgttttattgtcctaagaacatgcacagcatagagaaggaagatgcattgggacttagttatttctcttgcagtctaaggaaagatattctgaaagtcatgcactgtgacatgtatgaactacttaaatttacctgacttttagttcattgtcaaaaggaagagtgtgtcaaaaatctcaaaactaaggcaatatatcttcagttaaatgacaactttaaatgagtcagaagaaaggcactgcatctgtctaaaaaatatcccatactggctgcacttaaaagcaactggaatgcacattcatagctaattataaacaaaaactagttaacactttaaataaaaaggaaaaatagcaaaaagatttagagcctagacaaacagatgaaagggttctgagttgccttccatctgatattactcaaatgcaactctgtctccaattacctgggaatatgtggtattccctcatgaaagctcaagatcagaaagggcgtccatttcgtgtctttgcttactcatagccatttggaacaagttcagcagaagtatttcacattgcgaaagagtctggagccagacagcgactacagacactaatcactgggtcaaaatagtaacttagtaggacagcaaccaccagaaagtatttgtggaggtagaaatgtggagtcggatatattagtgccgttggagaagatatcaccaaatgcaaaaatgctgtaacagaaccattaaatcactatttgtaatcagtttcatgttcagtggcacaggactgtctgagccgatggtctctttggtaggatcagacctaaaaggtaatcttatgcccttaactctagaataaatagatggaaagagaattaaccaaataaataaaggctgcctcctaaaacatttggtgtttcttttattgtatggttccaagtacaggctttctttgcctcaaactgcagatctctagcatttgagatttgcggggtgggcaaaaggggaaacatcattgctaaaataataggtgcagcaattgatcaacttccctaaggagctgcaattttaggtctattcaaataagagttactggtattctctgaatattgtcattataaaccacttttcattgttgccttttttcttaaactacatcatcctgttcctttcctccagtgtcagtagagaattgattgctttattttactatcactctactccgctactacttctattttcagtagactctatctcggaacattttccttggcagtggatctcaaactccaagctatgaataattacccacagtatgtttggaataaaaaggtgagctttagaagaggattaagcattttttaaaaatcattcttttagatttcatcaggttctcactaaattcacatgaagtattatcttatcccttgtagcaattttatttactgctatgtctttaaaaagtggggaggggactaaggagctattagcctctgtgtttatcctgtaggcattggacttctccattctatgccaattaaaacaacttcacacacaaattaagtagaaataaaatctattaaatatattttaaagcaatcccgtggttttataaaggtcttgggccataatttctctgttgctgtaaagaggcaaccttattttagcaaagtatatttttaattcaacatctggattctgtatagaaaaattaacaaggaaatatgtgagattcctacaatggaagacttttcacatattgcaagcaatgcatctccatcctactttgtagtaatactgatgtgggcataaaggaaagacaggaagaggatgactagacaccaggtgatttatacattatcttattaaatcatgaaacagctcggccaggcacggtggctcatgcctgtaatcccagcactttgggaggccgaggcgggtggatcacgaggtcaggagatcgagaccatcctggctaacacggtgaaaccccgtttctactaaaaatacaaaaaattaagccaggcgtggtggcgggtgcctgtagtcccagctactcaggaggctgaggcaggagaatggcgtgaacccaggaggtggagcttgcagtgagctgagagcgggtcactgcactccagcctgggcgacagagcaagactcccatctcaaaaaaaaaaaaaaaaaaaagactaggaaaaaaacgtggtgctcaaagcaaaaaaaaaaaaaaaaaaaaaaaaaaatcatgaaacaactcaatgaaaaagaaattattaccctgctttaatgatgaataaaagttattacatcaaagaagcgattattcaaagttattaaaatctactgcaattcagtggctgcattacaattcaaacccaggtttgcctgactaaagctcatgttctagctcccaacactggaccttgtgggatctgaagatgagaggcagagtgtgagaaagaccttgcaaagtataagcatttacaaaaaagtgtagcttttatggtccgaggtggaggagaggtgattgctctcagagatctgggatgcccttggccagtgatgtccattaggcgtcataaaaatgtttctgtcaaaagtggtctttgggaggctgaggcaggtggatcacctcaggtcaggagttcgagaccagcctgaccaatatgatgaaaccccatctctactaaaactacaaaaattagctgggtgttgtggcatgcgcctgtaatcccaactactcgggaggctgagacaggagaatcacttgaacctgggaggcggaggttgcagtgagccgagatctcgccattggactctatcctgggcaacaagagcaaaactccatctcaaaaaaaaaaaaaaagggggggggtcaagcattgctgggcgacagtagcacagaaagcccggtgatttgatgacaatgtgaagatcaccagccaagccttgtgcctatttgtctattttgaatgctgcttttgctaccctataattatcttgattatgaatgactggaaatctgccatcctgatcatttgaatcatgtcaaaaagaaatgaggtgtctactctaaagagttgggaagttaatcttgtagtagaaaattgaaatcttttttatctcttgtatgcaattcactcggcatactttatttaaatgaagtttattaatagttgattatctgtacataagaaactgctactaaaagttacactggctttcaaaactctgcaaaaccatttatgccattagagattatctgaaaatattttttgtacttctagaaaacaatacatgtataaatatatataaataacaataagttgttgcaaatagaaaatcaccttattttctgtgttaccttcagcaaagtcatgtttgaaagtctgtgcttataacagtggtggtacacagcctataaaagttgtttctcaaactgaaaagcatagctggtctgattggggtcactgcatgtaattagcttgcttgctccataaatgaatggcagatttgttttattccaaatgatatcttaattttcaccgattaaattacattttattttggtttggaaggttcaccctcactatgtaaagcaaccacatcctgcagttgtcactaagttaacaccataagtatgtttaaaagaattgttggccaagcatggtggcttatgcctgtaatctcaacactttgagagaccgagacggaaggattgcttgagcctcggagtctgagaccaccctgggcaacatagcgagacctccatctctacaaaaaatagattgaaaaatttagccaggtgtgttggcataccctgtaatcccagctacttggaaggctgaagcaggaggatgacaggaggaattgcagcttgcagtgagccatcgttgtaccactgcactgcagcctgggtgacaaagtgagaccctgtctcaaaaaaataaaattgtgacaataaaatagtgatgatgcatttatgcaaacaccatcttggaaaaagggtatctctgtttttccataaaatggaattgcaccccaatttttcagaaagtttttcctgagattggtatacaaaggaaatctgttcagttctttgaattgttgactctacatcaggaattgaaatgtgtactctaatgttcttgctttgatctctcatttgactgtttatcaaagctgattacagtttgaatacccaaatcccgttagcttcaaaactatgtaaaataatgtataatagagcattttaagagatttttttcttattccagtttgtctttatgattgtgatatggctattaggtttggtaagaagctttggttttatattttgttccctcgataagaatcagtcttctgccaaattggattaaagtttttgtttcggccaaacttgctcacgcaactaagcaacagctgtttcggtgaacatcaaaagaagtcattatgaacaaatgaaacttactttattccactaaacacaatttaggagcttatgctttttgaaaagctgtatgtgttttctttattgaatataacattggaatataattattagttgacttactcagttaaacattatgtatgatatcactttaagaattttgagatcttcaggtccagaattttccaaggatatttatctattaagtttctactgattattggaggcaccgtgctaagtattttgtacatgttaacagatgaatctgcctaaagtcacagagctaatttaagtggcaaaatcaggaatcgaatacagatctctggcatcttgttctactgtggtgtgtttttaagtttcataaatcatttactttaatcttctaaaatagtctagaaattccttcttctaatctgcctgaatctctgtactttgcaaagaaaaagcaaagatatgtgagggcaactgaaaaaataaccttcctgaaaatagtatgcattgtagtgcttttgttattttgcctaaacaaactttatgtgttcctagaattgtttctggaagcaaatcatcttttatgctaggcaactcagagcagattttgtataaaacaatatgttcgtgctggagccttttcaaagtaaaatcataggatattcattctttttttaatatagttaacaattgacctgtaagtttatacaaacaatctgacatacaaaaagggaaagaaaagaaagaaaaaagtatctgctgccacctgaaatgatccctgtgaaatcctgaaaatcctggcaaagagtggcaacgtgacactgggttatgactttgcagataccatgcaaacctttgaaagaacactgtcttgaggctgtaaaacatgaactagcctaagccgtactattgtgttgtaagtagtgataaagacactgacagttctcgagtgaccatgggttttatttcatgcacagttcccattttttttataatcaatttgccctgctccactgtgtctcctaagttctccaaatggccccacatgtgacccaaagaggaatgataataaaaagacaacttcttctttaactagtcccaggatttattttttacattttactttttttttgtcctgttactcagtgattttcaaactgtgggtcacaaaccattagtgagtcatgaaatcagtttagcaggtcccaactaatgttttaaaatctgatagataggctaaaaatatcagagagcattgcatgaaataagagtatcttcaaaactttcaggtcaaacatatattaatatgtatggaggtatggggaaatgggtgaaggtgaagtagtacataattcctagaatgcttacttgtcaaaaaaaaaaaatgaagtcacagccatactttaagtgatggagttcttatgttattttaagcagttcgaaatactgatttaatctccttaaatttgacctttgggtttgtagcagatcacaattctttatttttaaataaaaatgatagcaagtaaatgggtatattatcacattcccccttttcagaacagaccatgatctgttcacctgtggtctgatatgaactattgaaatgagttcaaaattcttaacataactgagaaatgtcacataccatttctgtttagggtttttttttttgacgtgtttacacctttgcttgagggaattatttccactaattgttggcatttaaacactgacacatctgatgtaaatatgaaactagtgttttcttttctcaggttaatgtgactgagttaaagaaattttttcagaatctgaaatttttgattagataatatatcttgtctgtgtcaatataataagatcaacttaattaaaattaagtagaatcatttaaatcatgtatctatgacatccatagatttgaaataagcttctggttgtagtacaatagaattaataattaaaataagttacgttatgtagggcagatgttgcttgaaatagtgtaacaacttatcatttatctcatgtacttttattttcttgcactttcagccaaaattgaccaagaggcagaggaaaattcactgacagagactcataaatggtgagaaattactttatttcctcccagaatagcgttataacatgctaagtgtatttcatcttaaggaaccaatttttagttcaattttaattttcaagcataaaacaaaaataaatctaataaaatggtgtgctctaaatctacaatgaatttctgaattttatttttgttattctgggtaacatataattctgttaaataccaaattattgtgaatagcttagcatcttctcttttacctgggatttagaactatggaaatacacaaaagaaggaagatagcaagaacctgtttcagagtttgggttatcaaaaaaaaactatgtgatttccatattcaaaagtgaagtctaggtaggaagcgatgagcttcccttggatgcaccttcatttccagaatggagacttgcaattatgggtaaacatagaaaatatctcagaaatctccctgcttttctgcctccattttctcttcttctcgcatctctctatatacgtcagggttctgtagaaaaaaagaacaaactggcgatacagatataaacacacacacacaggcatacctcattttattgcacttctctttgctgtgctttgcagataagtgtattttttttttttcacaaattgaaggtttgtggcaactctgcttctagcaagtctatcggtgccatgtttccaacagcatgtgcacacctcatgtctctgtgttacattttggtaattcctgtaatatttcaaacattttatttttattatctatcaccacaggtgatctgtgatcagtgatcttttatgttactattgtaattgttctgggacaccatgacctgacccatataagatggcaaacgtaatagaaaaatattgtatgttctaactgttccaccaaccatctgttcccttgcgtctcccctctcctcaggcctccccgtattccctgagacacaacaatattgaaattaggccaattaattacccaacagtggcctctaagtattcaagtgaaagaaagagtcacacatctctcactttaaaacaaaagctagaaatggttaaccttaatgaggaaggtatatccaaagccaagatatgcccaaagctagacgtctagtgccaaacagttagccaagttatgaatgcaaagaaaaagttcttgaaggaaattaaaagtctatttcaatgaacacatgaatgataagaaagcaaaacagcattcttgctgctatggggaaagtttaagtggtcttaatagaagatcaaaccagccacaatagtctgttacacaatagtctgttgccaggggtttggtttagcacagctacttgccacacagaaagccaatcactgagatgagtattgccagggaagaaggctttaattgggtgctgcagccgaggcgatgggagctcagtctcaaatccatctccctgactaactaaaattagggatttatatagcagggaagaaatgtaaccatgtgtgggagaacaggaattagggaggggtaaggaagaggaggtactcagcagcaagcagctggtgggttaggcagtcacaatgggtgaagggtctggcctctcattgtccagatgcaatgatctggtgagtttcagttccttgatactgtcttggaagcctgatggttggtttctggagaaaggaactcaaaaaagacaaatgtaactttctcaagtttcaagaccagaagggtcagtttctatgtttattcaaattaaatcataaacatcagttctatgggaccattgagcctgtttcaattcccttaaaccaaagcctaatccagagcagggccctaactctattcaattctgtgaaggctgaaataggtgaggaaactggagaggaaaagtttgaggccagtagaagtggggtcatgaagtttaaggtaagaaacctctgtaacaaaagagtgcaaggtgaagcaacaagtgctgatggacaagctacaagctatccagaagatctaagataattcatggaagtagctaaacaacatatttccaatgtagatgaaacatcttctgttggaagaagatgccatctaggattttcatagctagagagaagtcaatgcctgactttaaagcttcagagaacagggtcgggcgtggtggctcaagcctgtaatcctagcactttcggagcccaagacgggtgaatcacctgaggtcaggaccttgagcccagcctggccaacacggtgaaaccccgtctctactaaaaatacaaaaattagccaggcatggtggtgcatgcctgtaatgccagctactcagaaggctgaggcaggagaatcgcttgaacccaggaggcagaggttgcagcgagctgagatcgcgccactgcactccagcctgggtgacagagtgagactcattctcaaaaataagtaaataaataaattttttaaaaagtgaagcttcagaaaacaggatgactgtcttgttaggggataatgcagctggtaactttcagttgaagccagtgcacattcaccattctgaaaatgctagggcccataggaattatgccaaatctcctctgcctgtgctgtataaatggaacaacaaagcctgcacatctgtttacagcatagcttactgaatattttaaacccattgctgagacccattgctcaggaaaaaaagaaaagattgccttcaaaatatcacatctcatggaccatgcacttggtcacccaggagctctgctggagatgtacaaagagaatcacgtttcgatgcctgctaacacagcattcattttgtagctcatggatcaaggagtaattttgactttcaagtcttattagttaagaaatacatttggtaaggctatagctgccataggtagtgattcctttaagagatctgggtgaagtaaattgaaaccttctggaaaggattcaccattctagatgccatcaataacattcataattcctggaagcaggtcaaaatatcagcgttaacaggagtttggaagaagttaattgtaaccctcacagatggttttgaggattccaagacatcagtggagaaagtaactgcaaatgtggtagaaatagaaagagaattagaggtagagtctgaagatgtgactgagttgctccaatctcataataaaatttgaacagatgaggagttgcttcttatgaatgagcaaagaaagtagtttcttgaggtggaatctactcgtggttaagatgctatgaacgttgttgaaatcacaacaaagaatttagaatactacatcaacttagttgacaaagcagcagcagggtttgagaggatttactccaattttgaaagaagctctactgtgagtaaagtgctaccaaatggcatcatatactacagagaaatcttttgtgaaagactgaattgatgtggcagatttcattgttgtcttattagccaccccagccttcagcaaccaccattccaatcaatcagtagtcatcaacatcaaaaagatattaagtcactgaagactcagataattgttaacactttttagtaataaagtatttgctaataaagtatgcattttgtttttcagatgtaattctgttgcatacttaatagactatagtataatgtaaacataacttttatatgcactaggaaaccagaaaattcgtgtaactctattacaatattcattcactttattgcagtggtctggaaccaaacccacaatatctccgaggttttcgtgtgtgtgtgtgtgtgtgtgtgtgtgtgtgtgtgtgtgtgtaaagaaagatagagaattgactcatgcgattgtaaaattggcaagtctaaaattagcagggcaagctgacaattctggtaggagttgatgttgcaatcttttttttttttctctttataaattttaacttttagattaaggggtacacgtgcaggtttgttacatgggtacattgcacgacactgaggcttagaatctaaatggttctgtcatccaggtattgagcgtagtactcagtgggtggtttttgagcccgtgatccccctgcattgttgagtagccccagtgtctgctgttcccatgcttatgtctatgtgtggtcagtgtttagctcccacttataagtgagaataggcagtatttggttttccgttcttgcgttaattctcttaggataatggtctccagctccatctgcgttcctgcaaaggacatgatttcattcattttatagttgcatagtattccatgatgtatgtgtaccacattttctttatgcagtccactgctgatgggcacctgggttgattccatgtctttgctattgtgaatagtgctgtgatgaacatacgagtgtgtgtgtttttgatagaacgcattattttcctttgggtgtatatccagtagtgggattgctgagtcaaatggtattatagttctgttttcagttctttgagaaatctccaaactgctttccacagtggctgaacaactttgcattcccaccaacagtgtacaaacattccctttcctgcacagcctcgccaacatctgttacgttttgactttaataattgccattctgactggtgtgagatagtatcccatggtgattttgatttgtatttctctgatgattagcgatgttgagcatttttccatgtttgttggccacttacatgtcttcttttgagaagtgtctatttatgtcctctgcctattttttaattggattgtttttgcttgttgatttgtttaagttccttgtagtattgcaatcttgagtctgaagcagtctagagacagaattctttcatattcaggaagctgagtcttaaggtcttcaactgattggaggaaacccagcatgttttaaagggaaatctacttttttcaatgcctagtaatttaagtgttaaccacacctaggccaggcacggtggctcatgcctgtaatcccagcactttgggaggccgagacaggcagattacttgaggtcaggagtttgagaccagcctggtcaaccagcctggccaacatggcaaaaccctgtctctactaaaaatacaaaaaattagccaggcgtggtggtaggggcctgtaatcccagctattcagaaggctgaggcatgagaatcgcttgaacctgggaggcggaggttgcagtgagccaagatcgcactgctgcactccagcccaggcaacatagactccttctcaaaaaaaaaaaaaaaaaaaaaaaaagttaaccacacctaaaaactgctttcacaataccatctagactggtgtttgaccccaaaatgggcactatgacctggccaagttgacacataaaattaactatcacaatttctaaagagaaaccttattagccttgaggaaaaaatgtattaaagaagttctctgccattaattcagtaggcaagatctttttttttttttttgagacataatcttgctctgtcacccagactggaggacagtggcaccatctcagctcactgcaacctccatctgccagattcagacaattctcattcctcagcctccccagtagctagaattacaagcgtgcactgccatacccagctaactttttttttcttgtatttttagtatagatggggttttgccatgttggccaggctggtctcaaactcttggcctcaagtggtctgcccgccttggcctcccaaagagctgggattacagggatgagccaccgtgcctggccggcgacatcttttatattcactgaacagatatcacatatttagtagttcttggcttgatataaaatattgtcttagcaaactagtaaacagaattctccagtttctgtgaaaagcaaaagctgaggtcaaaggcctgaaattataaaatcagaaatttcagtgagttgcatgaaaaaattactagcaaatgacaaaatcgttagtaaaagagccatcttttataattaaacaatgaaccccaaaattcaaaagtaaaaataagaataatgaatcatatgaaacatttgacgtttctccgaagaaataagtctgtgtgccattttctcagcagtcctatgtaaccggggcaacaatcagtagtaattctgtgcaggaaagcagtgtaactctgatcctctggccttttgagtctgaatcttatcttgcctcttacacatgatagctctatgaccttagaccaatcccttcaccccaggaaaatagtatctactttgtaggtgagaattaaatgatctctggcagatgcttagtcccaagtgatcaatagatgttaattgctatgttattttcacattatttttataatcagaaattataaaaagtttagtggtagaattagaaaccagagtcagatttcagactcgggcaatgtatttgtttgttgtcatgtttctcgctgtctccatggattgcagccctgggcagtctcggatggttatggagcatagattttggaatcagctctgtattttggtacctgcaccaaactgctggcaccatggctccgaggatttatctcaggttttgaatccatgtccttatctgtgagaaaaagaaaaacaatgtccacattataaatgtggtgatcagttcattacttaactgattaagtaggttaaatgagtaaaatatgtatgtcgagtatcaacttcataagagctcttcacaatttccttttcttccatttaccataatacctgagcttgggagactgacttttagcatgaactatcttcatagcaaccattaaactggaaaaaacaatataaaacagttatttaacatgtctagaaattgttctatggacttgcagcaaatgaggaatcatttgtccaagaaaatctaaatcatggtaagaacagtgagagtctaaggcattcgaatcactccctgttgtgtcctattacgtcttatgggagccgctgcaggagctctaatccagacacttatggtaatgaagataggagcttccactctcccaagctcctacgctgaggttatggcttctcactgagtcagcaggctgccagaattactcattccaccacctccagcttattgcagacgttctgttccagactaacaatgcagataagagggggctccctttctcaacacttccttacttaaagggcagatgctccagctcaggtgtagccaaccgagaatgctgggccccagtgcttccactctagctgattttagggcagagattctacaccaggagggagaatacatgaagactaggggccccccacctcagctccttcttacacagcaggagtgttgctttggaagaagtggaccactgtcctaatcctagctttaaccattgtgcaggtgcacagaagtcctgcccagagctctacagatctgcttgagaaggcagattttgtttggaacagaacatgaagaatttcatacctaagagcttcgtctgaaagaatagaggtctagatggagagcagttgagagggcgttcgcagctccatgatacagcagcaacaagcaaaatggctaagcaatcagaagtttaacagagagatcaagggaagaagatagccaagaaggatccttttgggatcataatcaatcccagaggttggaaggctgtgcataagcttactaggctgcacccactaatgagcatcagatcaggaggtcaggctgacgtggaaacaatccccaagctgtgtagggatccatgaatatatgctgtaagcctcactggcagcagggaactcagcgcaaccgctggccaccactggcagaacaataagatatgtaacccaggggcaactcatgggaagccaggctaaaaaataaaatcacctatattccttcatatagtctgtctaatagccacaaaataagcacaccagcatcagccgagttaactgcttctaggaccttgtatgtaagcaggcagaaacatttctgcctggtgtactgtgggcttccacctgcccggctggctggtaggctgcctcctctcaggcctttgagggaatggtggactttgacccagattctagagtcccaggtctccttcccagctttgaggccttgaatattttatctgccaccccaatctcaacagtggctcaccatatgtactctctccccatgtaaatttctttagaacccaaagcctcagttttttatggagttcttcttttgcttgaattggccaagactttctttacttccccccgaccaccacacacacacacaattgaaacaaaatacatacacaggccgggggcggtggctcacacctttaatctcagcacttttggaggccgaggcaggcagatcacctgaggtcaggagttcaacaacagcctggccaacatggtgaaatcccatctctactaataatataaaaaaattagccaggtatggtggcatgcacctgtaatcccagctactccggaggctgaggcagaagaatcgcttgaacccgggggtcagaggtttcagtgagctgagatggagccactgcactccagcatggatgacagagtgacaccccatctaaaaaaaaaaaaaaaaacatagacatgcacatacacatatacagatcctcactgtattttatctctaaatatttcagttgtcttggcaaagcctagagggagaggagagctaggagtatgaatttaggcatacatttttcctgtcttccatttctccttttatttttattatagattattcttatcatgttccatgtatcatattatcacaaaccagatgaaattcactttggaggcaagatttggaggtactcaaaaagttgttcttcattttccagccttccatttagccctttgacgttgagacagaaaatacacggggaagtttcatttctatgaatatatcaaaaggttcctaatccatggaattggctggtgagattctgtttttatctcagtgatgctgtaacagccagacacaatttagttttactttacaccctgtggcaggagatccactgacaaattggtgacaaatttttgtgcttgatttttaaaaatggttgagagttatttacagataattgtgatagctgagttgggctatcagatgccttaaggatcaaagaaggatcatataataactgaacagccttttctgtaccaaaagagaagtttcccagagcttttgaggcaatttggcattccatatgctcaccaaggttatcatgaaagaaggcagggctgcgtggtggacaggacgctgacatttcctcttagcctagctctgccactccagaattacaagtgagtaaaccacagaaagttccccaagttcccgggcctccacttcgtcatatgtaaaaaggaatataacctcaccctttctttcatcctccagggctgtaggaatatggagtaccttgttctttgcaaagcttcttcaagtgtggctcctaagaggcctttcttgaaggcttattcatgtgaaaacattttgtaaacctcacacacacattatcagcttgctttgaaaggaattatactcatttgtctttacattctagtacattttttaaaacatcttgactcttagcccatttaaaatggataagctgaacttttatcaagaaaataattagaattgtcttctataaatagtattaaaaacaaacaatggtgagtatattttttaaatcaagccagatcatttttcatattccatttgttagcataatagttttaaatgtgctaattctgtttattcatgcatttttgctattaatctagaaagtggaactttgagctcctttttcacatgagcaaaactgtatagctttcgaataaatggtttaactgaactctgcagttctcctggaaagtaaggcggctgggcagatgagtcttgaaccatacccaaaatgcaaatgcaaagcagatgaatatattctcatcttcagatgatttcactgggcaagccaagccatcatattgtattacaagatggatttcggcagaatattgttaaggttggcttcatccccattgtgtgtgtttatgtcagcttctgcttctattttatttttaattagcatacacggctttcttcaattatggaaaagtatcaccagaccaaatatgattgtttttatttcctacagagtcacttaatgtctatgtcagctcataggcagagaatgtagaaattttgaatttgtctaataaatgtccattcctttatatttaaatttaaaaaataatgagactgggaatgataaaatctgctttattacttaatgaactaaggctaacttgaaatttttcttcagacttttttcttctatttctttaaattctacaggtaaaaactatattttcaggtgaaattgacttttgacgtagaaaaagaaaaggttttagaaacacagtttgttccagctatcagttgcattgatttcactaatttaattctggcatcaataaagctagtagaaatgactgaatgtaaagtttgaattctattgcaactattcagttagatagcttacccttgttagtcagttgaaggtgacattctggacaaaggaaatcagggtgagaaaggtgtacaccctctgtgagtaatgacaaacaaagtaatgtgtatgaactactcctatcattttaaagcaattgttttctaggaagtttgtgacttttcctacagattaaaacatttagtttaagatgtttatatttttctacaagacatacatgctattgaaatttttatataaaactttaaaaatgcctaggtgcagtggctcacacttgtgatcctagcactttgggaagctgaggcaggcaggtcacctgaggtcaggaattcaagaccagcctgaacaacatggcaaaacctcatctctactaaaaatacaaaaattagcctgatgtggtgacaggcgcctgtaatcccagctactcgagaggttgaggcaagagaattgcttgaacccagggagcagaggttgcagtaagccaagatcatgccacatgtttcaaaatagaagtctttttttttcctccaggagctaaagatatctagaaagattatatataactaatcttctgatgagaccgtaagatgatagtgaatttgtttaataaggaagcaaatagcacaattaaacttagagaattaataagtaatgtgctttatttggacattattatgtgataaagattggactgtatagtttaaaaatgtactcaatggatctcataggatcttttaaaaaatattcttaaagagaatacactacattccctctcctacttaaataatagcaaggcaattggaaacaaccagtaataaaaggcaagaaattgtaatggaagaacgcatatttgtagaagaactttaaatcacacattttaaaaaataaatactatttctgcatgtaatattgcttaagtggtattttagcaaagccaagattgtataacaaatgagttgaaatggaaaattaatctttcatgcaaaataaagacaaaaaaggggaaagaaagaaagcggaatgtgggttccactagtttcatacagtatgtaactattcatttgtcacaggagagaaaatatttaatcggttctgaactgatgcacacatactttatcatgtttagtgacttttagagtgtcagtttgtaaaatgtttatccaaggaatggacttctggcacatggataaaatgaaaagtgaaatgtttagttcataataggcatattttccagaatctttctgagtaactatccggagatgaatagaaagactacaggtctgtgtttatctggcttaggctggccgaccaggcaggctccagcctggtattaaaactgaagtgacatggaatgtctttgcaaaagccccaaacaatgacatcattcccttaataatattgataatgtagaacaaagttagagtttgttatttcccaatttggatttcttagttaactacttctaatcctggcagaagatttactgtctggaggcccagcagagcaaggcttcccaggtggaaagctgttgtttcatgccttttattttcgggccgtgtggtaagttttagatacagcaacttttctttgtacaaatggattttcttctgtggctacattatccaacttttataaaatccattgactttcaacagtaggggagcccatgacaccctttgcagattttctggccttggaaagttatacaaaatctgaggtggagatcgctcctgaagtttgtttgttagcgttagcgcttttcaagtagaaggatttcaggattttctgattatgagaattttaatgtttttttccagtcttggttgataattataagagaaacatcaaagaattcctgccctttggaaaagttatgttgtaaaaatggaagctttcctttgtataaacttgagatccttcccaccccaatatttaaaaatatttgttggcctagaacagactaaactgtctccagaagctatgttctccaagttaacagaggttagaactcttaaacttttgtgccctaaaacctaaaggaagagtaatgaaatcactgtgtgtttgccggggattctaatcaccgtgctcttgaaatgcaagtagggcaagggctggagagggcgaagataataccagaaaggaaggatatactattttgtctacagttttgttttttaaaaaaatagaaagtagaaaggataagggctagcaaatgaggttatgaagtgtctttaggccgggcgcggtgcctcacgcctgtaatcccagcactttgggaggccaaggaaggtggatcacctgagctcaggagttcgagaccagcctggccaacatggagaaaccctgtctctactaaaaatacaaaattagcagggcttggtggcacatgcctgtaatcccagctactcaggaggctgaggcaggagaagggcttgaacccgggaggcggatgttgcggtaagctgaggttgcgccactgcactccagcctgggcgacaagagcaaaactccgtctcaaaaaaaaaaaaaaagaatgtgtttaactgtagtatcatgttccagatccattaggattgtccatcttgagaaaatacgcttcaagcaccgcagagattccagaactcaatagttaaataaattgagtctacaatcattgttcagaggaagaaaaaaatttttttctaaggagaatgaaagcatgagttagtgatttatatctacgttttataaggcaaatcagaaatcagctttagaagattgtcattagaagggctcatttgcctacaagttacaaaggatcaattcaattacattacacgcccaaaggcatttctcagaggcctccagaatcccatgcaaagggaagcagcctcaggagtgggggaagcgaagggaagcagcctcaggagtgggggaagcgaagggaagcagcgtcaggagtcggggaagcgaagggaatcagcctcaggagtggggggagcgaagggaatcagcctcgggagtgggggaagcgaagggaatcagcctcgggagtggggggagcgaagggaatcagcctcgggagtggggggagcgaagggaagcagcctcgggagtcgggggagcgaagggaagcagcctcgggagtgggggaagcgaagggaagcagcctcgggagtcgggggagcgaagggaagcagcctcgggagtggggggagcgaagggaagcagcctcgggagtggggggagcgaagggaagcagcctcgggagtggggggagcgaagggaagcagcctcgggagtgggggaatgggtcagatgcaagcacagaatctcccccatggcggcgtctagtgcctctgttaagatcgcgctctgagaaacaacgctggcattcaaatccaggtatagccccttttattttctttttcagttttctgactttggggaagttattgaaacttctgtatctccattttcttgtttctaaaatgagggcaatggaacggtgcgtggctagagttagcatattataattacttgatatcattgttacctgatgtttattgtagtgacctgccactcatggctctagtttgaattttcttcatgggtgttaatgcaaattctcaaaagggtgaatgtggttggttcctagataggtaatataagctcatgaaggataccagctcccccagcccggtctatagttgagacaagttttctaaaatcaatgtaaggaaggaaaatggaacattaactttttggggagatgggaagggctagtgaaacaatcaagcttacagatataaccatcctgaaaagagaaaatttggagtatattgagtgaacttgtttaaattgaagttttttcattgtgagagcgttacctcgagaaacgttcgtcgtctcattttttgttgtctactccggcatgcatcacatgtgggtaaactttaaaagtagcatgaagaaatgttttggctgatttccctaccatttgtcttgaaagatgatgtaggtatgggtttggaattgtagaaattacagctacaatactttttttttttttttaagaccaagtctcgctctgtagcccaggctggagttcagtggtgcgatctcggcttaccgcaacctccgctgcccgggttcaagagattctcctgcctcagcctccagagtagctgcgattacaggcgcgcgccactgcaccaggctaattttttgtatttttagtagagacagggtttcaccatgttggccaggctgttctcgaactcccaacgtcaggtaatctgcccgcctcggccccccagagtgctaggattacaggcgtgagccaccgtgcccggccacagctacacttttcttgcaaagttgtaatcggggttggagaagggaaatgactgattccagcaccgttgaagtcctgcatctgcagagagtgtcaaggagggagatagcaagatctataggagattaattaattcttccttcatttgttgtgagaattcaatgtgatcacatgatattttacttaataccataactaaccatgcagtaagcatataataaatgcagatttgttcccctaaagagtgtgcattcttctacctttcaaacagcaatttatttcaaaggtccaaggttttccacagttcctctcctgcctgctcctcctccaaatgttagcccatttgggtgagaccaaggtcacactcccattcctggtcacaaagtctcttaaggagaaatgttagcatatttgcaatgaaaatatgttttaatccctctagtaatactgtggcatggaaagttgcatctatactgatttttgacagagaaagggtattactggcacatgaaaccctagatgagcatgaataaatgtagatttcgcatcctacttccagaaaattgccaaactctattgtatattatttaacccactaaaacagctcccaaagttgactaggggttatttttaaatggtatgaaaatatattcttacaaaataatttacaaaatcttttttgttgtttttgtttgtagtcttgacattgttagcaatgaatcatgagtttttcggggaaaaattgatgaattgatcaaaattatctgatttgaggatattgcacgtaagttaaagagaatagggatatttgacatagttttcaaaattggtctaagaaatatttgagcaactaggccaaacattcttgatttattctaagtcttaagtagattcttaagtctaagactctaccagaaagaaaaggtagaatgaaaaaggcaataagaacaacagagattagaaaataatttcaataaacgggaaaaaaagaggaaattagaaagaggacataataaagacattgtgatagctacttgttcaccttgttttattctaggtttttgcagctgaatatccaaagtatcatatcccatgttttttttctgaactgcaagttagactttaccattttaaagttgatttttatttcaagcattcaatgatggttgaaagtatagtttaatattggtaatataggtactttgtagtcatttatttagagaaattaaagtatggatgcattaaaataaccataaaattatttttttaatattcaatctatgaatcgaggtgctgattgattcatagtttatgaatcaataaactatgattagtttacacgaaaaaaacttagattcttgagtttctcctgaagcctctcagattctccagtggtgtcttaggcaaaacaaaacaaaacaaaacaccagtgccttataggttgacaagcgtattttcaaaatctatattcagggctttctaatttctgttgttgtgagtgttttcaaaactcgtgcagcttagccttccttttcccctttcacatcccatatgctcctggttagacatgcataaattaacataacatcccaaatctctcaactgtatttgaaatatttgttttgtccggtgccctatttaagtggctaagccgtggtctcagatatgagattgtagagtttcaacttccttttctcttatttttttactttttatttttttgagacatagtatcactttgctgcccaggctggagtgtggtggtgggatttcagctccctgcaaccctcgcctcttgggttcaagcgattctcctgcctcagccaccaagtagctgggaccgcaggcgtacaccaccacgcccagttaatttttttgtgtttttagtagagatggggtttcaccgtgttggccaagctggtctcaaactcctgacttcaaaggatcctcccacctcagcctcccaaagtgcagggattacaggtgtgagccactgtgcctggtatcaacttcattttaaaagctacctctatacttagggtgtacgtttgcataagacattttgcatttctgtattgttaaaagtgctatttgtaaataatactgtagaaaatgtgaaattattttttaatagattacaagatatgaattcccaatgtaagtaagtggggtcaaatgtcttttctgtcctttccagtaacatatacaggcacaattattcagcattgtaatatttgtgtagactccataaattatcctgtattgtagtattgtagtattttaatagactaaataatgcccaaacaataaggaaaatagcaagatgttaaatagtgataaatctttattgtctttattggtttactaaatctatagtcagcaaatattacatggaatcagacaatggcattttaaaaataacctattatgtatttcagggtcaaaatgtactagcagtgtgaggacatgtatatctaagtaatttttatattaaaatgttttaaaaatcagtagccataaataattacacactttagtactcttttgaccaaaaaagctagtttttaaagaaaatgtcaaaattcaacacttggtagcttacttaaggtataataagctgaacatttgatgcaaaataaatttagtgaagttaattaaaagatgtacagcaaagttagtaaaagatgaaatatactgtctcccagataacagtacataaatctgaaaaaaaaaaaatagaaggtttatagctagtggatatttaaaaaacatcttaaatgtagaaaaatacaagtgtttcttcttttgtaatttttaattccatccaaaaatatatattcaagtcccagatcagaagcaaacactattggtaagcttttctgtttgaaattcctctctgagtggatctaacgatctgaaaaattgaaaatcagtgacagctgcaaaattgagacaatttgcaataattgaagcaaacttttaaaatccataggggcaaactcagccttaggattataaggttctgctagaagtaagatctggatttctggatttccagaatctagacgaagatctagatttctagatttttttcctcagatcatcaaccaaataaattccaaaaggattaaggaagtaaatgttaaaatttcaactttaactagaagaaaatattgagaaattttttgggatttagaaattgggatttttgtcagcatcatagccacagaatattaacatttgtttctatttctgctacttatttctaagtgataaattgtctgcttttctgagcttattgttatcgtcgtgtttttacacatgtatattgcttcttcagttcatttccctttttattcatttttatttctctcaaagttgtaagtgtagacatagttgcaaaagtcaattagtaccacaaggctgataacaaaaagcagcagcctcctgccctagccaaccctaccctctcttatatttttctcagctgttttctctgatactttctaccatggttttcagtaacatacttgtgctgatgtatcattatttatcaattaaggcattttctgttaatttatgataatggttgatgtaatttttatcttactctttcttagtccccatcctacttcttcttgtattacaatttttagtcaggaaggttgtctagaagatatacaatataaattttcagacacgcaagttctcaaaacacttccctcacacttatttgatagtttgtctagacatagactcctacttgaaaattattttcctttaaataattgaaggaattacttcattgtcttttagtcttcagggttgcttttaagaagtctaactacattcggccgggcgcggtgtttcacgcccataatcccagcactttgggaggctgagacaggcggatcacgaggttaggagttcgagacctgcctgaccaacagggtgaaaccccatctctactaaaaatacagaaatgagccaggcatgctgtcacatgcctgtaatcccagctactcaggaggctgaggcaggagaatcgcttgaacctgggaggcggaggttgtagtgagcagagatggtgccattgtactccagcctgggtgacagagtgagactccatctcaaaaaaaaaaaaaaagtctaactacattcttattgacatttccttgtgtttgatctgttgttttttttttttctctgagaagcatttcatgttctctctgttggcgtgaaaacatagaacttagggattgcttggtgtgtgcctttttgtttactctgctggaaagttttttctggttggagttccatgtccttctgttttagggttggtcacaaatgatccttaggtttctgatgtggatgattaacatagcatttctaaaattgaaatgaggataaaatgagaagtttgagatgggtaataagccagccgtgtagaaatgctgagtatttggttcagtgttcaagtccgaagctcaggagtgatgtggcaggcggctgaactttgtacatcctcaatataaacagataggagcagaaagagagagtccacgtgatcaccttaggagatggtgtccacagatgatcagcggcctaagaccgaagccatgagaaataccatatttgagttgctgctagtggaaaaggatcacataattgaagagggatgccaattcaaagtgaaaaggggagaaataggagagtgttacattacagaggtctaggtaaacaagggtagcagaaaagctcaagaataattacaatgtatgcctaaagacaaaatattaatttgtgatattaatgggagatcatatgcacccttaacaaaaattgttttatttgaattttgacgcactttgagtaattgggtcaggagctgtattgcaacggactgaagaaaataaggaaatggaaactgaggataagctacttttattagatatttggagagggaaggaagaagagagattggatggaatgtagagggagacgggtggtccattttttaaaaccacttttggttgctacacatgaagatccagatatactgaaggccataactggagagaaaatctgccttgtagggtagacaattattgtagtcacaaaacacaagaaaatgatgatgtagctaactagcagcagtgaggcagtgaagcagttgagtaaagtgtaagtgatgccagaaactttaaaaaaaaaagtgtgacagaattataggaatacagtggttgggaacagcactggaagaccagacatagggaggctccctttcttgattcctgaatttgggagggtaggagatgggaaatgcaatgcttccggagaagatcattatggatgatatgagtgtgtctggtgaaagccatgctttgattaagaaacagtaggcctggtgcggtggctcatgcctgtaaatcccagcgctttgggaggccgaggcgggtggatcacgaggtcaggagatcgagaccatcctggctaacacggtgaaaccccgtctctactaaaaaatacaaaaaattagccgggtgtagtggtgggcgcctgtagtctcagctactcgggagaatgaggtaggagaatggtgtgaacctgggaggtagagcttgcagtgagccgagatggtgccactgcactccagcctgggcgacaaagcgagactctgtcaaaaaaaaaaaaaaaaaaaaaaaaaaaaagcagcaaataaacataatagagaaggaaagtaggggtataaatgtccttgaccccaaccaaataatcaggatccagagggcttcagaatgaagttggtagagctagtcagtgggtggtttttatggaacccgatccatgggggtgtcattgcaaggagaagaaggggagttgggcttgggaaggagttatatacttatcggtgaggaagggtgggttaaaggctcataggagtgacatgagaactgaagagcatcctgggcagaattattttagtggctagtgccagtaggtggaccaactcatcatgaaatgttgtagctcagcttctgcatcttgacctctgagatatgttggccttaattggcttaggaaaggctaatagagatcctgacttacatttacactgagagaagggcttgtttcctttgggtgagagagaatatgagtacacacagttaaagaaatagaggggcattgtcaggctggaccagagaacatagaaactcagtcaaagtgccccagtagcttacaatggtgtcttcttggtgacattgtcttttcatgtttggacatcataggagatgggccctgtagattcggactagaagccaaagaatttttctttatgttataaactgcattcgtgccttcaaaaatgttaggatgccaaagaatctaattagcttgcaaatacttctatggtagtgcttgttctctgccttaacaactgccgtgaggctccttgctcactcttataagaaagatattccactcagtgtggcaatgctatgcggttttcaacatgccaggaatatcttacaaatatcgttgggctagtgaaacagagatttatccaagcactgaaggaacatttttaaaatgccaaatagtatgtgatgattattattttctttttttagcttcacaatctctgaatttaccccagggtgaaatttaggtttgtgtggacttggttgtggtgagtgcctcctacgtgagaaagggagttctgtcatagttctgattgtcaatgtcaccgaagctaaggttggatcgtctgtgccttttgtatctatatctaagatgaggaggggctgcagggctttggaggccttagccagctggctctccccatgttctggtgatgaatgggtagggtcattcttagtacccattttgcaggtgaggaaatgaagagagagaacttcacgtctgttaaatgacttcaccagtattgtggagtgcggtagcacagagccgagaatggaattcaggccttcgtgaaagctgaatgctttgtgagtaatagtctgctctgcaatcctggaattcaattacgaaattttaaagccaaaataattaataaaatattggcatttgtagggatgttttgctgctattcagttctgccaaataataatttgtcccttttttcttatcgtgtttctgccctgcctaccatctaataaccttctaaggataaaactagcaacagatgttaaaatactttgtaaactgtatggcaacatgtaaataggagatattcacactggtattatttacaagtatatgtgttttgttgcctttaattatatcagtgaaaatgtaaacagatgaaaacaacacaaatggtacttgtaagcttataaaaatctactattttgaccctgtggtggcagagttttatatctagaagtggaacccaactgtaatagtaaagtttgttttttaagacaagtgggaaataggtcatatatcagaagaacttgcttgtctaggataactttatacatctttctgaaaattgcatttgagaataaatgtctgacattagaaatgccatcatctccccaagaaacacccttagcattgatgcagcttagcagaacttacatagcattgaccacaaagcatcctattctgaaaagaaatggctggaaaacttttttaaaaatatgttgaatagcaaagtcttggaaccaacccaaatgcccatcaatgatagactggataaagaaaatgtggcacatttacaccacggaatactatgcagccataaaaaggatgatttcatgtcctttgcagggacatggatgaagctggaaaccatcattctcagcaaaataacacaagaacagaaaaccaaacaccacatgtcctcactcataagtgggagttgaacagtgagaactcatggacacagggaggggaacatcacacaccaggacctgtcagagggtgggggcctgggggagggatagcattaggagaaatacctaatgtagatgaccggttgatgggtacagcaaaccaccatggcacatgtatacctatgtaacctgcatgttctgcacatgtaccccagaactttaagtataataaaaaaaaaaaaaattgaagtctccacctgatgttggtaatctatcacatgtgtataatgattcttgtaatatctagattatgcagcacctgcactcggtgtaaaaacaatactgttagcatcttagagactcagcttctgaggaaagcattagtcataatacacctagaaggtagtaatgataagcatttaattagaagtaggcctgaagtttgcagtgcaatgcagtaagtatttaccgagtgattcatatgagtaaggatgtgatagctgctataagagctgcaaagtttattaagatacatccctgtcctggaaacactgccagcttcgatgagaatacaacaatgttagatatattcgttttggaagatacctttcccccagttattttcatttcacagcttctccagcctccttcagcttctattctccctctttgcttttctgtctcaattttcctgcccagccctaaattcacagagtaaatccaccagaccagagccccttcctctttctgtatgtgaaactactcctgcacacatcagtctccttttctaccaccagcctgggggaagtaactcctcccatcagtatctcatctggatacttctctctcctgatttcaacttctcccttctagccattaatacatttactttattatcataaaataacgacttaagaaagaaacaaaaagcaattccttgcctgtacattccctttccactcttttttttttttttttgagacggagtcttgctctgtcacccagactgcagtgcagtggtgcaatcttagctcactgcaacctccacctcctgggttcaagcgattctcgtgcctcagcctcccaagtaactgggactacagacgtgccaccaccaaaaattagacactggctaatttttatatttttagtagagacggggtttcgccatgttggcccggctagtctcaaactcctggcttcaagtgatcctcccacctcagcctcccaaagtgctgggattacaggcgtgagccaccatgcgcccagcctccctttccattctttgtagccaatcttctcctcctcattccatctgtacttatgtcccttgttgatatttatgttatttaatcttgcctcattttctgattttgtagccagtcttttaggatgtttctctattttattggtctttgaaagaaccagaaattttgatttgttgattatctctctcttctttttttttttaagttgtttttttaattggctttctatttcacaaatttctgctctttaatattctcttatttctgcatcctgtctctcctggctttgtccgttgtatgaatagttcatttatttttaatttttctttttttaaaatcatatactcagagctctagctttgccattaagttcactttaacaatatcccactagtttttaaatgtagaatagattttattgttgttcagttataactttgttattttctctttagctgatgagttacttatgtgtatattcgttgtgtctgtttcaaatgcatgggttttgtgtgtttgctttgctggtaattattttcctattgatttacagtaaattgtattacacttagtttgggatctagtatggaacctgtcttagtaaatatttgtatgtccttgagaagaatcagtttgccctgtgtgtgattctatgatatatattctcatccgcatattttctcaccctttaacatctctgagactggggtacgtcttacagtggatggcatcttataatcgatgtgggctcgatttaaagtcagcttcttccagagaggatttggatttgtgtgtgccattcaactgaggacactatcaatgtgaagctactttaattaaattccctgctttagcttgagagggttttgttttgttttgtttttatagggcctggtactgtgaattcagatggaaaacctgcatgatttctgtctggcttatgagtcatatttgcaagggaactttttttggtgtcatctgtttgcccagtgccagagttgaaacaagtttccttactgtccctttcagcatgggaatttctttctcattttcttttacgtgagtcctttggtatctcagtttatggtttgcatatgggagcaactcctctattaagactcttcatattggactatttgtctttcttagtggtacataaaatattatttttaaaatccatgacctgctaaataagtgaaatacagcatattttaaaataaaatttatttatcgtaaatttcacatctacatcattactaatttgtagaatcttctgctataattgtgaatgtttgtttcatctttcaattccatgacgttttcagacaatatactctatatggttcttatcatcctgatggaatgttcttttttaatcattatacaatgtccttttttattgtcattaatacacttcaccttataatcctctattgattaatgcttcatcacgctttcttttcacattttcctggcatatattgtccatctatttatttttacttttctgggctatagtgattaagacatgtcatttgtaagcagtatttattttatctgaatttttattttgatattcaatctgatagactttgtttaatagttgttttaaattcttttatatttattatgattttttttttttttttgagatggagtctcactctgtcgcccaggctggaatgcagtggcacaatctcagctcactgcaacctccacctcccgggttcaagtgattctgcctcagcctcccaagtagctgggactacaggcgcccaccaccacgcccggctaatttttgtatttttagtagagacgggatttcaccatattggccaggctggtctcgaactcctgacctcgtgatcccctcacctcagcctcccaaagtgcagggattacaggcgtgagccaccacgcccagcctattgttgatgtatttttatttattgctattaacttagtagtgtgtttttaagtttccaaacttaagggattttcgaagttccatttctttcttaattacataaaggttacataaaagaagactgtctgcataagaataattctttgcattttttgagatttgctgtatggtccaaaagatggccaacgtgtataagtatacacagtgttccagtgttggatgtagtgttctattttattattttaaactgactcttaaatattcagtatctttcctgattttgtcagcttctctctgtcagttaccaagagtgtatagtaaagacttatagctgtgcatggtggctcacgcctgtaattccagcactttgggaggccgaggcaggtggatcacctgaggtcaggagttcgagaccagcctggccaacatcatgaaaccccgtctctactaaaaatacaaaaaattagctggacatggtggtgggcgcctgtaatcccagctacttgggaggctgaggcaggagaactgcttgatcccgcgaggcggaggttgcagtgagccgagatcgtgccactgcactccagcctgggcaacaagagcaaaactccatctcaaaaaataaaaaatataaatataaataaaaagacttacaggcagatatgtcagttactccttacacttctgacatttttaccctgtgtattttcaaatgctttcgttttatgcctacatatctagagtttttcatcttcctggttaacctaatcttgttttcagtgctatctcttttctggtaatgctttttgcctaaatttgtactttgccttatgttaatattggtacatatcagctctttttggttcgcatttgtcatagcacctccacaattttactttcaacctttctgtgtccttatgggcaaaaaaaaaagtgtgagggttattcctcaaacacctgagggcatcaatcccagttgtgtacccagagtgggtgattgaccactacaagctgtacttttgccaggattccattacttctgaccgtgtaagctcccgcagtaatggaagtggccatgtggaagctgtgggtctctggaaatcagtgtctcctcagaccctgtgtcctgtggccctcgagacatctgagtatttcccttttgcactatacagtctactgagtgatggctgcaggtttctttgtagaaggactaggggaaacattacagtgtatccttgctaccatgtttcagggtccttcctcacagggatgcaattcctttggtcagggggtcctggatctgaaattggctcagttctgggaactgatcaaggaatcatgattttctatagagcagccacctgtagcctcctgttttcccactcttgcccttttctgtggtcatagaggttgagcagcacacttgtcatttgcccctaaggatgctatgctccactaaccatctccacaatccgctgagagtcaggcctccttggctgccccttggctttttggttattatggtaattgtggtacccgggcttctggtcattgagctttaccacttggaccctattatttaggatcctatcatcccagtggattttaatgagcccagctctgcaacctcttcctacagagaagagctccaactgcactgttcagtgatgctgatacccctcttcctgatgcattctttatggcctctgggtggggcctctgggaacttccatggataatcctttgctcagtttttctggactcacacaatgcatgctggtgtgcctacttctctcagcttccacattccttcctcttccatctgccagggcaaccccagcacacctactcctctttaaattggctatcactcagaagagacctataagagaagagcctcttcctgaatcgctccactacatggtagctaattcttgcatcaccttccatatatgatctcttaccccttttcaggcctagcacttccctagctgggtcttccagggatgtctccttaattgttgtcctattgtcctgcagccaagagaagagctggtagcttctgagggggcgggccatttgttgcaaggtgtgatggtgttcacaccaggacatttttactaaagatatcacctgagctaacctgataaaatgtgctggtgtggatgccgtcacagctggtgtggacaccaggatattttatcagattagctctagtgatgtcttcagcaatcacatagccaccgtgtgccagagactgcccatgccccacattcccacacaggacagggggccggtaagagaacctgtcccagaactccatctcagtcccggttctcgcagactacttgtgctcctgctgttagttcaggttctacaaaaagcaagtgccaagattggatttatttggaaaaacaggaagggagccagaggaagctgggacagctgttagacctgatgcaggtccaacctccatggaggagagggaaggaaggaaggctgggtgagaaaagtcttggactgcagtgcaattataagaaagttttgtcgaagccaatggggagtccttgagccaaagtcccctttagaggagtcttgtgtctgtaggattgcacttgtatcagtattcttgcagctcactcactaccctgaaacaaacctagacctccgtgcaaatgaagtgattggtttcagagcatggcagccaaggcccttggccaacttttttttcctgcaattggaaatgtggaagatctgaaaggtgtgtacctttcagatggtacacatctgatgctatggaaatgatacatttcatttcgtttaattttaatgtctacctttaaattaacaatatttatttaacatctttgtcccttttccagataatataacacgttcaaattacctaatttttattgccaccattctacaaattgttgaccaataatttaggtctgtctgttttatttttgtgaaagatgggagatcggatgtctatgtttatgttcattttttcttagaatggacatcaaattttccaacaccgtttgttgaaaaaactattctttctccattgagttgcctttgttcctttgtcaaaaaatagttgactatatttgttttgtggggggtgtgggtttggcctggcaataaatattttaatttttcttgtttcattttttattatgaccaataattttcaagtttatttccttgtttgtttaaatacaaatctaaaccacaagcaggtacaaccaagacattttatctcatatttacactcctgtcagatcctcttccaatttgatgaccactgaccaggctagcaggggatgggagaacattttcttaggtagcagtgttgtgaggcctgtggtgggggtgggggaaatcaaggacaaggacaggctctcatacctgtttccacatttacctgggaccaggatgggcaggagacaccaggtcatggctcctgagcaccagcttcctggtttgaagaggcagagagtgagaactggacctgcatggggagagaggagagagccacctactcctcctgcagttggctatatttttatgagtctactgggcactctgttctacagtttcattgatctgtctgtctgttcttttgccagtaccatgctgtcttgattactatagctttatagtaactcttgaagtcagatagtatcagtcctccaacatcattttgcagtatggtgttggctattccagatcttttgcttttccatataaattttagaatcaattgttgatatctacaaaataactcattaggaaagtgattgggattgaaatgagtcaataaatcaagttgggaagaactgacgtcttgactactgagtctacctattcatgaacatggagtatctctttatttagttcttctttccaaaaattgatttctttcatctgagttttgtggttttcctcatatagatcttgtacacattttgttaggtttataccttagtattttattttttggtgatactgtaagttatataatttttatttcaagttttaattattcagtgctggtatatgggaaagcagttgagttttgtatattgacttgtgtcctgcaaccttgctatatttgtgtattagctccgggagttattttgtagattccttggcattttctacatagacgtattagtcttcaaatagggacagttgtatttctttctttccaatgtgtatatcttttatttccttttttgtcttattgcaataaatataagacaaatatacgctgactataatggtctgattcctaattttaggaacttttcttagttacttgatctttgggatcagcatgggtctcagcttacattgtccctcaaggccagtcagtacctgaaaatgtgtcacttagattttcaaacttctcttccaccttttgtatgaactaatacttgttcttgggttgaattacctttttttctaagagcagttggctgctctgaggtcacaattaccctgaaggtgtaagtaccacagttcttcatttcaagataaaagaaatgccagtttatcctcttaccattctgaattcctctgattttttcattgcctgcaacaaactgagtgttggcataaaaatatctttgtgctttttagaagacatggaggatccctcaaaggcttttttaataataagtgaaaggggatttattcttccttattggagtaataaaatttgttacactttatgtaagttcctatggagggtgggggaaggaggtggaaatgaagacgatgatttaggattccaaaaattaaagttacttgtggaaggctttaactgaaaatagatcttcctcttgagattttagtttgttctgaagaataatattacaaaatccaacactgcacaataaaaaacgcaaaagcaatggaagatttatgatgatgttcctttgcagttcgtttaaactggtatgctctcttggcctcgtctgtcatactgagaggctttatgatcttggttctgcctatatggattaaattaagttatacatgtgcaattctcattctgcctgtaaagtctcatttggtactcagccttttttgctgtactcccaaaggacaatgatattgggagaagaaagtagaggaaaacatcacagaagaaccagagagaaaggcagagacccccagggtgtatttagattgggccagaactgaattgctgactcgccaaaaggccagtccaatcatagatgtgtgcataagaaaagacctcacgagtcccttcatgtctacccttcaacataaacatcacagtgtctcaaaatagccagaactgctgcattgacagttgagatagggagggaggacattggtcccaaggctggttggcattcacaatagagggagaggaaattaataaatgatctgttcctgtctacacaaagcttggacaccccaacagaacataaaaacaactcagatctgaatcgtgatgttagttttactgataactacaggtatgtttgtggtgggaggaaagggaggttgaattaaacaaatttatttctttcagcatgtctctttgcttaactgttgattctgatacgtctgttaaacaggtggcaggaagctctgtgtctgtgtatacatacataggtgtacatgagcaacatgtcatgaaatatgaaatagagtcatatgaaagagtcaaaactaaaggatataatttctgattgtccatcttttatgtgattccagggaaaaagattatatttttatttccatataaataaaatgagaaattctcttggcagtagctactgcagactttcttctgagccaagtgagatagactctatagataagtaaggagaaatgggtaagggtgatcaagtcactgtggcactggcttgctgtactcttggaaaccagacatattgacatcagttttaatttatataaatgccatgagttatctcataattatgtggggatatgggaatgagggaaaggaattgctttccttaacttctctgtatgaagaatagattccttgtcttatcacactccaaatacaccaggatggctaaagaaggctcttttatttctggctgccacactgataacagaaccttcactcgtagaccttactgtggacctggcatccccataaggatgctcacaggtgtctgattgggtaggaagtactgtcattcttttataaatggggaacaaagctcaaaaaagttatgtcgacaaagctccaccactctgggttagagacagaactaaatcttagttatccatattcaaagtccacagaagacatggcttgaggttaatagactgcttctaatacgtagtcaaaaaatttgcctccagaaatgtctaggccccttgttcaggagacagtcattctttaagtaaacattcttcaaacaactcctgtgtgccaagcattgttcaggtgcctgagaataaagccatgaacataaatgctaaaaattccttaaagaggttaaatcctagtggagggagagccatagttatcacacatagaaaatatcttgtgtttctgatggcggtcagtgctgtagagaaaaggaaggaatattcaggggtggctgttgtggaaggttgggccaagtgttcagcttttactttggcttctcatgaggatctcactaagcaaggatttgaatgaggtgagagagagagagagagagagagagagagagccgtgagacacttgggtgaagagcattccaggcagatgaaaaacaagtatggcatcaaaacgtcatgctctgtgaggccagaatgacagaagcgaaaactcggtaggtaaagatgggatattactgctctagttggaatgggaagcctctctggcatcagctagccaaaagtaaagtaaaaacacttatgattctgaaagtcagctcatctttagcttactccccccaccccagttgcttttgtggatccattctttttttctatactcagaatcatttccggagctacctgccacacatcaaaaggtgctctcttaggttgtttagatatgcttctggttgtcgtagaataaacatgagacagtgcttatcattttctgaacaggatcatgaaagggtttaccctgatcaggaaagggtttctccttcttgaagcatatatttggtaagcagagaaactgttgagaaggagatccaagattgagagcatatggtaatgtctgccagcacgtgaacctgagggagaacgtggtgaatggctttgttctgtaccttgactctttgatttgttgacccattaggaatgtttttcaagaaagtcatcaaccagagcttacacttttctttgtcttcactctgccatgagtagtgcctggcatatagttactacctgctccctgatgaataagggcaaagctgtagtgccctcttctaagactacaacagagtaaacaccactaaaattactggactttaattcaagattttaaataatacttgaacgagagtaaatcctgctcatagatgggaaataactattggtaataccacagtatgctatttaaatagtgtttcatttgcagagaatatgcttctccaaagagatcataacttgtggcaagaaaatgctattttaggataattactagcacctcttttggttgtaataaaaaccaaattttgagtcattctttatgtgcacaattcccagacagagaattgccttaaaaacagatgagaagttgaaaagaatataaaatagttctcggtttgtggtatggcctcttttcaagtaaaaaaaatcaaagctgtctatttttattatctgtggaacataagtcatcgtcaaaaacaatatccagtagaagtctttaaagcaatattctaccctcttaaaaatatttctagaatgccattttaaaagatgtgtatagctattactttgtggtaccaatgttgtgtgtatatgcacttgtgatttttaaaaatattactctattatggaaaagttaaaatatgtgcaaaggtgaacagaatagtacagtgaccctccattttatccatcactcaacttcaacaactatcaatttgtagtcaatttggtttcctctataaccctacccgcttgcctcctcccatattgtttttgaaggaaatccccaacagatataatttcatccatatatattttagtatgtttctctaaaagatacccttttattttatttatttatttttaagatgcagtcttgctctgtcacccaggatggagtacaatggcatgatcttggctcactgcatcctccgcctcccgggttcaagcaattctcctcctgcctcagcctcccaggtagctgggattacaggtgcgcaccaccatgcccggctaatttttatatttttagtagagatggggtttcactatcttggccaggctggtcttgaactcctgacctctggtgatccacccgccttggcctcccgaagtgcttgggatcgcaagcgtgagctaccgtgccaggcccaagatacccttgttaaaagaaagcatattcaccaccagtttcactcctaaaaaatgattaggccctaatatcaccaaataccaagtcattgttcaaaaattcaattagttcatgtatgttacaactgattttatatatatatatatatatatggttttttttttgtttttgtttttgtttttttgagacagagtctcgcctgtctcccaggctggagtgcagtagtgctatctcggctcactgcaagctccgcctcctgggttcacgccattctcctgcctcagcctcctgagtagcttggactacaggcgcccgccaccgcgcccagctaattttttgtgtttttagtagagacggggtttcaccgtgttagccaggatggtctccatctcctgaccttgtgatctgcccgcctcggcctcccaaagtgctgggattacaggcatgagccaccgcacctggccacaactgattttattttggttacagtttgttttgagcaggatatagagaaacgccaaccattataagtagatgatatctcttacattttcacaataggtgcccctatgacacttttttctacttaaaattgattcgttgaagaaatgagatcatttgttctatagagtttctctacagtatggattttcctgattctatctcagtgttgtagtttcacacgatcctctgtcttgtatttcttttagataggtagttagctctagatactcgatcagcttcaggtttgaatattttggcaaaattactttataggtggtatggtgtgttctaccaagaggaagcctgacatattcagttgtccatttttgtgatgtcaccagcctttgggaatcagtgtctatatgttttaactccttataatttgtaaaatggtgactttttattttgttctcagttattccgtgaaatactttttctttaaagaaaaacttttccttatttggcatagagttattcaattgtgtgtttcttatacaggaaatgcaggattctttcctttagtttaccaattttcaaaataatgagcggtgtcgctagcaccttccaccaaaaatgaagaaatcttcttttttccttaagcgttgtaatgaactcatagaattaaacatatttgatgtgttttactcttttgcaattattattgttactgatctccaaaacatttcgcctttttttttttttaaatacagagtttcactctgttgcccaggctagagagtacaatggtaagatcatggcttactgcaaccttaaccccctgggctcaagcaatcctcccaccccaccctcccaagtagctgggcaggtgcacaccaccacacctggcaaattttgtattttgtgtagagatgaggtcttgctatgttgctcaggctggtctcaaactcctggcttgaagtgatcctcttgccttggcatccttaagtgttgcaactgcagacatgagccactgcacctggctaaaatgttccatctttaagttcaccttgagtccttttgacatgaccttctctgctatcttcttggatatgacactccaggttcattttgaacagtttttttcctcgagacctggattgagccatttctccaggcagctctggatctttaatacattgtggaatggctaaattgagctagttaacatatgcattaccttacatacttaccagcttttgtagtgagaacactttaaatctactgtattaatttacaagaatacaacatattgttaactattattactgtgttgtataatagagctcttgaacttatctttcctgtcaaactaacattttgaatcatttttgttatgatgtttctgttccattgccttgattgtcttcagtacaggaggcttttataatacacatataggaatttcttgtcttccatacttacaactttctcttaaatctttttttaaaatttctctttgatttaaaaacttttccttattttatttctgttttcattaagacattagctgttgtacttattaactcttgtgttacttctaattcagttttcatgtgtgagatgatcattttaaatttcagattctttactaagttcttgtaccttatgtctgagtttttaaaattttgagttttgttttcatagcctttatcattttattaatatcttttagcctgttttaaaacactaggcaacagtctttatctgttcagtagacatgtcgtcttcctggcatgtttgtttgatagacatgtctttctctcattggtctgcagagccattattttgctcctgttttctttcaataagtttgtttaggaaccatttgcaatctcctgtattccgtcttttcatctccttattgttctttctttcccacttctctttctctctctctctgtttttcttcctcctttcttggttagttgaggcgtaatttgtaaacattaaaaatgcacaaatcttaagtgttcctttcagtggtttcttttaaaccaaaatattaaaacagttgtgtttcccaatgtatttacttcacacttctctgaagaggtgatcattgttctgattagtcaacatagattaattttgtgtatgcatggacttttataagtggaatcatatggcgtgtataattttggctctgcttttgtcacttatttttttagaggaacttcatattgatatatcagcaacttcttcctttttattgttaagtagcatttcatcatatttatagatcacagtgtatccattcccctgttcatggacatttgggtttccaatttggggttattattagcagggctgctgtgaacattccttttttgtttttttttgttttttttttgttttttttgaggcagagtctcgctctgccgcccaggctggagtgcagtggtgcgatctcagctcactgcaagctctgcctcccgggtccacgccattctcctgcctcagcctcccaagtagctgggactacaggcgcccaccaccgtgccctgctaacgttttgtgttttttagtagagttgggattccaccatgttagtcaggatggtctggatctcctgacctcatgatccgcccgcctcggcctcccaaagtgctgggattacaggcgtgagccactgcacccggcctgaacattcttgtatgagtctgtttgtattcatgtttcatttcccttggaattaataggcgagggtaggttttctgagtcatgttatacatatataaatttatacatatatgtataaatgtataaggaattgtcaaacacttctccaaagtggtttgccattttacactctcaaaagcactgtgtgaaaattttaattgttctacattctccccaacatgtgagactttatcaagtctttttgatttaagccaactcttatgagtatgaaatggcataatggtatatttaaatgaaaggaatttttactttgctaaagtctgatttatcaactttttttctcttttgattagtcctttttgtgtcttatgtaataaattttgtttggcccaaagatgtaaagacttttttaatgttttcttttagaagccttatgtttctgtcttctacatctaaatacttatttttttttattggagtaaggattttttttccaaacagataccccattgttctagcaccatttgattaaaaaaaaaaaaaaaaaactttcctacccccgcattgaattggctcgccaccttttgtaaaaattcagatgaccttgtatgtgcaaatctccttccaggtccttataccaataccatactctattaatgtagctttataataactcttgaaatcagacaatgtaagtccttcacctatgttcttttttttaaaaatgtatttcttttttgctatttcatatgctttacatttttacataaattttagaatcagcatatcagtccctttaaaaaaaaaaaaaactcttgattgggattgccttgaatccatagaacaatttggggcaaatggatgttaacattactgaatctttcagcccaagaatatattatacctttacagttatttcagctttctttaaattctctcaacaatgtttgtagttttcacacttttatttgatttattgttagatagttgatgttttataatagtaatacaaattatattgctttaaaacatgtctttccccagtggtcttttccagggtgtataaaaatacaattgatttttaaatatctaccttgtatcttatgggatcaatattaagttcacttatttagttctgagtaaattcacttattggttctaacaggttttgttatgtttgtaaactccatagtgttttctgggtatacaaccatgttttatatatatatatatatatatacatatatatacacacatatatatgttttatttcttcctttccaattttttcctctattgactggctagagatttcagtacaatgttgaatagaattgggaagagcagacatccttgttttatttctgaactaaaaagaaaatatcaaataccattgcgtatgttaactgtaggtttttcatagatagtatttatcaaattgtgtaagtttacttctaggattagcctgcaaagagtttttcctttttgtaataataaactggtgttgatttttttccatgttttttatacttactaaaattatatttatttttctttattctataaatgtggcaaattacactgattgctttcactgttaacaccaaattgtattatgggggtaaaccctaatttgttatgtattatccactttagaaattgctgcatttgatttgatgatgttttattaaggtttttttttttgcttatgctcatgagggatatttgtctatacatttattttttttctttcataatatcttttttagttttccatatcaacatcagggtaaagctggcttcataaaatgagttgggaagtataccctcttctattttctggatgagttagtgtaagattggctttatttcttcatcaaatgtttgttaattcacttgtgaaacaaatagggtcagaattatttggagtgtggagataaatttgattaccagtttataaaaaataattttctatttatggaaaataattgaattgtcttagatttaggggtacttatattttctgtttcttttgtcagttttagaaagttctgttgtttaagtaatttgcttatttcacttaaggtgtcaaatctacaggcataaaattgtttacaacatcatcacattatcattttaagccagtatgatctataaagatgactgctttcatccctagtattgatattttgtattttctctctttttttcttcatcagtctgggtaggggtttatcaattttattaagcttttcaataaaccaacttctgactgagttgattttctgtaagatttagtttttatttctttgttttgtgttcttttttattatttctattcttctactaagttgggtttaatttgctcctttacagtttcttgagtttgatgtctaaataactgattttacacatttctttttaatacattcattttaaagttcaatttctctctaagtacttgctttatttgtatcccgtatattttgatattttttgtttttatttttatttagtttggaatgttttttcatttcttttaggatttctttttgatccatgggttatttatcacaggtttgcttaattgccaaattggatgttacctagatattatttttgttccttcataatttaataccactgtgctcagggaacttactctgtataatttcagtttgaaatttactgagacttgttttatgactcagcatatggtctatgttgaatatttcatgttctcgtgtatattctaccattggtcataatgttctacagatgccaactgggtcagtttttgataataatattcaactcttctgtgtcgttagtgatattttaatctagttctcttgactactgagaaagaggtgttaaaatatccaattcgatgatgatttttcctctttttccttttagtcctgcaatttttgcttcatgaattttgaaactgtttcattagatgcgtatctttatgattgttatgtcttcttgataatgtggatgcttttataattatgaaataacaccctggttatgttctttgtcttggaagtctactcagataataaaaccaggccaactttgctatggttagtgtttttacgtagctttttccactgcagtattttcatcttgcttatttttatttggaattaattttactgaaatgttaggagaaatagatgcgcgaggaaaacatttctaactttagtgctctagagtttcctcttttgtttcttttgcacaatgataagtgcattttacttgcattttctattttctttgttcttgagtttttcctgcacaatttgaattccactctcagcattttctctcaacgcagagcttagccctaaaagggagttttctcttgggtcagtactaagagttcatacagctcagactgcttccagtcctttcagaagttactatacatcctttcttctgttccatgcattcaattgtgtaaaacatcttccagtttcagcacagttctcaggttagccctgacccttttcaggaatacctttttgtaatttgagggttcttcctgcttttaggagagatttcctgttgcttccctctgcttcctcctatacagatgatgttaccaggtgggttttatgtcgtgaggagtttgtccttagctgtaattttgagtttcgttggggacgttagatacctaggtctttgtaggtctgttagctttgatttttaatattagttgctctttccatttttgtgtgggattcagagaaattccgaaatggtcctgcttctgtagctatcattttagagctctgcaggtacctcgattccattgcagagaagtatatttgtactgtctaatgtttgtaacaaaagacgtgtggtgttgatcttttcaaaaaaggaccatttaagaatccagaccacagggatgttgattgttcagtgacatctggagttatctgttattataatcatgcatttttttaaataactgaacatcttttaactactacctcttcatgtgccagggtcatttcgagggagtctcacagaaaagcctgtgtagtaaggaaggtcctaggtaagatgtctgtctttttgtagtgaatcctgtattggtatatggtggctgggatcctccagatttcagatttaaaagaaggaaataattcagaaaagatggaatttacccctcccacccaccacccaagtgggtctctttcgtgttatgcaagtttgaattcactgagggctacctaatgccggacaggattacataaccaaaaatgcctctggcataaaagataccttgataatctgtagaaattattgtcctgttatttgcttgtttttttttgttttgttttttgttttttgtttttttttgttttttgtttttttgagatggagtctcgctctgtcacccaggctggagtgcagtgacgctatctcagctcactgcaagctccgcctcccgggttcatgccattctcctgcctcagcctcccaagtaactgggattacaggcacccacaaccacaccctgctaatttttttttttttttttgtatttttagtagagacggggtttcaccatgttagccaggatggtctcgatctcctgacctcgtgatccgctgcctcagcctcccaaaatgctgggattacaggctgcttgtttttttttttaaagtatttacactttctttcagggagtactagtgtacagctgagacagcactcgtgatcctcagataattcttctggacactctacgtcacatactcaagtacacttattctttcaccatggccacatccaaagaaatagctaccagcgaaagtttctttttattgtgactcatgccaataataaggttcacatttgactttaaatcaattgttggatactcatttggctcacaggttcataaagttttatgcaaagaacatttttattgaaaaatttttgcctcttataaagtgaatacatatattactacttcagtttataacttgcaaggtacttttatttaatcttcatgacaaccttgaaaagcaaccacttacagatgaaaaaaactgaggctcagaagttaaattaactgcctaaatctatgtgctttatataacagagccaagaagaaattattgaataatcagaataattatcactagtatcagaagcttttgtgcctactggtaactaaaaaaaaaaaaatcttcagagaacatgatcacatgagaatctgttaataaatcagccccaattgaattagttataatttagagaatacttttaggaaatatatatttatatttatttaatatgcaatataaaatatatagcatatgtaatataacatatgtaatataaaatacatttgttttgtgttgacacattcaacagacactttggcaattcatttttacccattggacttcagaacaactgttgatgataatctctgttttacagtagaaaagctgaggcacaatgatgttaaatggtttgctcatatagctggtcatagaggcaggattcaatattccatgtcttctcattctaaatcttacattctttgcttttgataccatactacctcgtgataaaactttcaaaatgttgcaagataactgactgggtgaactagctattgcgacttacatatggctacccaaacaggtgggcttgctctgaaataatcagttttatgaagttcaaagaccagagcaatgatgaaaatgaataaatggatagaaaagacttgagacctaacttcagcctaacaggtcatacattctttttaggtatataaggaaaatgaccagttttccgagaaggcatgtatgtgtttatgttatcagttttaataaaatatgacccagatatgtcttagactctgtgtgttctctgccatctactctccgggcagttctgatgccatcaacacattccgccaggtgcattctaacgtcattaccatagcccgtggcagccagatcctcacatagcgtatgcacttcacagcctgactctttctcaggtttaattgactgtactctgtcatttttctagtaggctaactaaggagaaaaacataatacctgagatccacacatttgattaaatcagtcttgtcgtctctgcctagagcttaaaaagctgatatcctgggaatcttgctgctcagagacagccataggcaagtttaaacacagagcagattagtcatacattggtaacccacagtcaagagtagctgtgaatgtttgtttttacgtgtgaatgctctgactcttttatctcctgagcaaactcaccttaaagatctcagtattttaaaaaattagccgggcatggtggcaggcacctgtaatcccagctatttgggaggctgaggcaggagaatcgcttgtacccgggaagtggaggttgcagtgagctgagaccatgctgttgcactctagcctgggtgacagtgtgagactccgtctcaaaaaaaaaaaaaactcaatattttaatgctcaaactgtttttcataatagacatttcaaatcagctatggcaagctgaatacacacagagatatgtgtaagtgtatatgttagggtatgtatgtttatatatgtatatatatacttttgtcactgagcaaaatcaagttgcctttgatatttctacttcagagtagatcaaacttgagtttttgtggagcagaaatagtgctggccccaggccagagaaagaaagaaaagacaagcttatttgcatgccactcctttgcagcatctctgacctttctctaaccagttctcttgccacgcgttatcgactgtattggtcaggattcttctcagggcatcactcatgggactggaagacttttgtgaagtcagaaacctaccatttactagtggtatgttctttgtcaaataaccactttgaaactcttctgagctccatatagctgtaatatgaagcagcctctgagtggcaccttctgaaaactggccctgagcaatctaccgtcaaagtcctggctgccatattggtctctactcaatgatagcactgtagtctctgataggagactttgtcagcatctcttgctttttttttttttttttttgagacggagtctggctctgttgccccggctggagtgcagtggtgcaatctcggctcactgcaagctgtgcctcctgggttcatgccattctcctgcctctcagcctcccaagtagctgggactacaggtgcccaccaccatgcccggctaatttttttttctttgtaattttagtagagacagggtttcaccgtgttagccaggatggtctcgatctcctgacctcgtgatccacccaccttggcctcccaaagtgctgggattacaggcgtgagccaccgcgccgggctgggactcttgcttttattccttctaacaatgtaggaaggcaaatagtgtataagcaatataatatagatatggactacatactagtttggggacacatggttaatatttcatttgtttagggtttagaaagaaagtataggcccgccactttcaatatgtctcatcttgatgacaagttcatttctggagtatgtccaacacagagtgattaattttgaaatagaattggtcaaggggtagttattagtatgtggaggattctcgtcagttgctgctgtctgtatccaaaactcttaaccttaaaccataagagagctactgttggtgcttgaagagcttgagtcctcttggtaataataattgtgcatgaataaaatcagcatttggatagagaaagaatatcccatattggaaagtaatcatggcttttatgcttttgtgtgtgtatgatttgacagctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagaggtaggtattttcatttgcacaatggcattttaaaactggtgttttattaggtgtggcaccactgggttgccaattttcgtagcctgaagaaaaaattagatggccctcaacccggggtagcaagttgaagaggatgctgacatttggcaaaatttggagttttaataagaagagtcagcacagaagctgggatgctacagagagtaactagggtgctggcttgccaggaccactgtcgggtaaatcaacttctatcatgaggaaaccacgtaaaagtgaccacgtaagaaggctggaacaaccctgctgcaatggcagacccacgcacttcaaagaacagatagcaaaggctagaagggtaaaaggaatagtttgctcaattcatgggatattgtcagtttaccactcatatcaaaagttcatccagatatcaccaagaaacacagatgtcaaaattttttaaaagacctttcaagattcttgtagaattatgtgataccttctaaaataaatcttttcaggaagggaaatgtcccctcttcagtatatggaataaagtctctgtgattatgaaattccatagaggcatattacatattaagtaatgaagaaggctagccctcccagggcgccatccccaaatagctgcgtctagtgggaaactaaagggaaacgtaatctatactataaagcaagccataatgccaaactaactagtatacttcctaacatcactaacagtaactttgctttagatctttagaaaacttacatcctgtgagccaggatcagtggctcacacctgtaatcccagcactttgagaggccaaggcaggcagatcacttgaggtcaggagttcaagaccagcctggcaaacttggcaaaaccctgtctgtactaaaagtacaaaaattagccgggcattgtggtgggcacctgtaatcccagctacttgcgagactgaggcaggagaatcgcttgaacctgggaggcggaggttgcagtgagccgagatcatgccactgaacttcagcctggacaacagagcaaggctgtctcaaaaaaaaaaaagaaagaaagaaagaaagaaagagttacatcctgagaaactttgttcacaaaattccactgttttctgcttattgtcttcattttggtctgcttacacatgataccatggttgtccacctggttttcagttgtaattcaattttgatacctccttaaattagatgaattaattggttacatttatagagcctgtaaaccatgccagacttgcgcttactcctataataattacttagattccataggtctgtcatagaagaaactatcctcagtgaatagtaggtggaaaaagaaaatggtttgaacagaaggaaaaccctttaaacatgcctgctaaagataatgagcttattctgcttccaaatgcatcagtaacgtaaaatatgagagctttcagttacattatatgcaggtggggtagaagagataattgcttaaaaataagcgtatgcgaatcactgttcttttccttcagactaagtcatatattaagtgatatttaccaaaaacaggcttgctcagtttggaagattgtaaagaggaaactctttttttaactttagcacgtcacacagaacttcccttcatgcccttccctaagtccctacattcctccttttacctctaatctaaacctggtcccctagaaaagggtttgaaacttatttacactaaggttcaaaatgaaaagagtcgtgtttccccttgcgcgattattttcatcatgtctaggattagagtcctcaatggagtgtagatggtgtgattttagacatcagcaagatgggactgatgacgttgtcactttggagtagctggtccgatgcacatcaggtaagcaagtgcatcgctgtcggagaatggcttggtcctgtcgtggaggtcccaggccaggatgctggacaccctccctgtcgctttcttctgctagcatagaccagaatataagctggtgagatgcttcctcagagaaaatgttgagatggactaattcagatgctttgctccctaagcatcctcacagccccatctaatacatgccccatgacagcctcctcagagtcccatctaacacatgctccatgagatagaattgtttctagatgacattatcaataacaacccactgtttggtggcattatgtgcatctgacatgcccagaatgagctttccttcactctctaagtatctcataaaatcagctagatccattttttttggttctttatcctgtgcttgtcatgtcctagaactatgtgatgggctttgggttcacacttggtgaacttacattcatgttagcagtgttgcgaattggcagtttacaagtgctcttgacttcagacttctcagttttctaaatcatttgcttttaataaagggctaaggaagaacacgtggcagatgagaacgctgctttgcccattgacttgcaaaatctattaccctcttggcaattgataaccagtttgcttgaaaaggaaaaccattggttggagttgtttgaagaacaactctgttcctttccttagtgagggaccagctatgtacttcttaggaaacagtgaaaaatgaaaatgcacaatttcttgtataaaaattatttcaagacagcaaagcattaaagcaaccacagagcccttctaagggtggcgccccatctgacatctgactgcccaaatgcacacctatgccctgctttggtgtaaactttttttttttttttttttgagacatagtctcactctgtcgccacactggagtgcggtggcgcgatcttggctcactgcaacctctgcctcccaggttcaagcgattctcctgcctcagcctcctgagtagctgagactacaggtgcccgcctccatgcccggctaatttttgtatttttagtagagatggggtttcaccatgttggccaggatggtctccatctcttgacctcatgatccacccacctgagtctcccaatgtgctgggattacaggcgtgagccaccacacctggcctggtgtaaactttatattttctatagttaaatggaaaagtatttccaaaatgttttgaatgccctgggacatggataggaaatgccagtgtggtcatttaagagtgtgaaacttcttgtacagttactatcagtgtgagtagaacctcaagtggaattacaaatacttaaaatgggatactgttctccaacctgtttctcacctctgtactcctatcctatttactatcaacctattttcttcaatggctaatcttatactgcctaacaatacgtctattttataccattaattttttgatatttgcatattggtcttttttttttttttttttagttaaccactcggtgttggtcctcatatctggattagtgtcctcatatatggtatagctctcatatctggtatggtcctcatatgggattagtgtcctcatatctggtatagctctcactttcagcaagccacactgcctttcccctctttgtgtctccataagtatttgctgacttgttgcatcattacctttggaacagacatggaaataagaacttagcctagtaaagtaataaacatgttttcttgcataacttgagttgatcattgtaggtaataaaaccccgctctgaatacctcaaagcaaaaagagagagacagagagagagagagaaattttatttgtttagacagtcaaacctcagaagggcaagagtggaacttacttgtggaagtcctgaatgcagaattctacctgctgtgagtgtggttagtcagccacatgtgtctgtacctgtcccttccgtgatccatgtgtcttttcaaatgtcctctctctattctttctcctcctttttcctcttctttctctcaccctttcttcccaacccaccacccctctgtagcttagctttaacttcccagctaggctgtttcttagctgtcagccactgccatggcttatattctcataacccaggaggacagagcagtttccatatccatctgcaaaaataccagggaggaactccaaatgaattgtgtccatctctggatcagccctggtggtaccgtggttagcttagcagttcacaaacctgatcctgaagcaagagaagagtgttaccatgatcaacagttcccttcagagcagtgtttttgaaggaagaacagtttccccaaaaaagtaaacaataatctggcctaatttattaagcctttaaaatcacccatgtgattagcaaaatgtcttagcatggtagaaataacctgaaagatggtgttaatggtgtccttgaaatttttctgatagaattttccttggaatagtttggtgtatatagattgaaaaatatcgttaaggttttaaatcctgtattaatctttcttatgccactatttctaatttgcgtctgattacagagtgataataataactctattttcttgcttcatcctgatgacgcatgtgatttggttgatatatttctcaaaatagtgaatttctacacatccgtgtcggatagggcttctgtctttctagtcaatgtgtttggatttttaagctctgccacttactggctccagaatcgtagaaaatcaattagttttcaagagtcagtttcctaatctgtaaaagagaaatgataatacagtcttgcagtgttatcatgtagactaaatgacataacgtatttgaagtatatagcacagtatctaccttctgaatgcctatactgtttttccatcatttaataaaaatggtatcctggtcatggctccctacaaggtgacataacattgctaaggcacactgaccatcttaagaacatagtctgtaaacacaaagtattattgtgactcagttacattcttggttagacaaaatatcttggttgtgagtccaaggatgaacttttgtttgaaaatgttcatgtaacctacccctccatatctacactaggtgatacaatagacacagatcaagtgatcttgtcacgaatcagaaaaattattttttcatctacttggaactagacatgtacaattgttaataagaaatcctccttttttgaaaaaacaatctagacttgtcatcactgagcaacacaaaacatgtgcaagtatgcattttttaaaatttcaatttgtaggccaggcatggtggctcatacctgtaatgagcactttgggaggccagcactttgggaggccaagcactttgggaggccaaggtgggtggatcacaaggtcaggagttcgagaccagcctggccaacatggtgaaaccctgtctccactaaaaatacaaaaattagccaggcgtgttggtgcatgcctgtaatcccagctactctggaggctgaggcagaagaattgcttgaacctgggaggcgtagggtgcagtgagctgagatcacgccactgcactccagcctgggtgacagagcaagactcagtctcaaaaaaaaaaatttttttttcaatttgtctgtattcaccagaagatgggaagggagactaacatttattctaccaagcatctccctaaggtctcacagagcacagttgtagtgggtaaggaaataggcaatcttcatctcttattttcaggaaggcattggcatgactgtcacctagccactaatgaggctctgtggagctaggataacaagagctgtattaattaaaagaaagagatacagattgactaagaatgtgtgtcttttttttaccctgattgagaggctatggtctaggtcctgggaaaggagggttaggcttccagaacaacatcacttctctgttgtaagttgcgctcagttttcaggatgagtgttcagctatataaccatgtgaagctacctgtgattattcactcattccatatggagtcgtactggacactgagacgttcaagtatgttaaatgaaggtctcctcttctttgagctagcagtatagcactggttggtgtatcatgcagtgggaggaaccaggagcagggactaaggaattctgcccagaggacttttgacctagaacgtggagcaagtgtaggattttcacagacagtccagagagctaagggcttttaggcaagaagatctggctctggccactgggcccccagcctcatagtgtgtattgtggcctatcattatttcatttttagttggcctgagacattttaatttaataaatcatgacattagtaagggttatgtttaaagtattgtctaacttaatttactggtttattttactttgagacaggtagtctttgatgatccaagagaaaggatagctacttctctaattgcacaagcatgtggcagtcacgtcttgtttcagcccagctgaaacctgtaattagaggaaaataatttgaatgtttatccttagaaggttatgcgttacattggcgagcccctcgtgccttgttaacatttctttttccgtaatttgtattcaagtgatttgtattcaagtgaactacatgttcagatttatgtatgatattattggagtaagtttaagaaggaagagaccattttcaaagaaattgaaaatacatctgaagaatggagataaggaaagtttactcttatggaataacgtacttgctggatacgtaagtgaaactgcctcttggactgcaaggtagcattcttgcattgcatgataaatgaatttggccaaccattcactcttttcattcaggcatcaatttttagaaaaatgacccataaagaaatcctcttctcagtgccaactttctgtaaccaaaggtttggcagaagagtcgacaaacaggacagtcaaaatagtggccaatggaggccgagggtgtgagaagatttagctgtattcatgaattggagtaacgcatacacattaagacagtaagtaatgcattcaacaattttttatgatatgtatgccctactatatgccaggcaacattcctggccatgtggatcttttctcttctcatgagagaaacagacaacaaaaagtaagcgcatatttaagttacaagctgaaatcagtgctatgaggaaaataaacagggagtcatcttgcagaatccaacgggaggaggttcatttagagaggttggtcagaggaggcctttctgaagaggcagcattgctgtggacacctaaagaattcaagggaacagccccatgaaggggcacagtggggagggtgtaatgtgctgtatgagcattccgggtagatggtaaggatgttcacggcaatgtggcaggaaagattaagcactttccaagaaagatgggggccatgcaatgaatttgataaagcaagctgagtcctgagcattcaggccctggtaagtcatggtaaacattgacttttattgtgcattcaataggaagccatcaaagggttttttttttttttctggagagaaaataaccttatatgatacatgtaatgagaagattattggctgccaaatgggtagtaaattggagagtggagagtgctagtaaaaagcaagttaggaagttattttagtgacctaattgagagctaggactctgcagactggggtgaaggcagtaaagattgtggaaaataggtgaatttgagatatattttggaggaaaatctacatagatttgctgttcacaggctcctggatgaaccagtttttggaatcagaaaattgtaaatgtcagctcagatactgaaaagctaatattcactaggatgctagagatcaagaaaacaagaaaacagatttctcctttcttctaaaatgctgtagaaaaagagctgaggaaagatatgaaaaccaggatattaagatatttactttgtaaaatttagttctttttaaaaaatggaaagccctaacgtgaagattagctgggaaagggctttgcatttgcttctttatcttgccgtgttccaagaggtgtttttaaaactttgggaaatcttcaaaatcctcaattcaaaaactgaagaaactctcagtaggtagttctagagaatccggaccaagagctaagaacgtggcttgtccaaagatgtttttagtttggtaaggatttgaacattgtagcatcttttaatgagtgtgtagacacttgtaaggtatctgagcagtttttaattcccctttagcatttgctaaaagggttttttgatgtcatagcaaagtttgcagtagaactatcctggatcaaaatatacttcctggagtgaagatatttaaagttactcttttaaaaaataacatcatgtggcttatgtgggccgaaaacaagatcctattcaagctagatgacgttattttttcaggggcaatttttaatttctttaggatactttcaaatggttataatttgctagaggaagtacagacctgttgaatttgaataatatcaaattaacaaattgttaggtttgcgtggacttctgctagagcctggatttttaagataatcaaaaacgtaaggagccaaaggcttccccatggctcagtcccaccatgacatgctccgggctaactctcacacctttgggcaaaggaatttccacattcacacactcctcctgctcgactttaggatttcagcttcacacactacccctgttcccattagggggagtggagctttagaaaaatggaaggtgtttcttctgcacttaaacattagcagccttagggcaaatggataatcaaagactattcctgagagatgagggaagagattgcctccacctagaggtatcgatccctacggcagggttgaagctaacaacagatgttagaccaagacatgttagtggttattttatttgacagacagcaattcgctcacctggttttggctgctggactctggttaaggtttagaagcagctgtaatgagacgttaagctcagttttaaaaggaattatttgtgaaagcatgtgctgggtctgtgtgtgttgggggatgttgggaggttggataccaagaatggacatccgtattgaggtactttgagaatatatatttcaatataggacctacaaaaaataagataatattcaggtatcttggacagagaatgaaaagaaaatggtcctaaaaaatgtaagtagaatggccagtaaacacatgaaaagatattccacattgttagtcctcagggaaatgcaaatcaaaaccaaagtgagatatacttcatactcactaggaaggctgtggtaaaaaacacagacagtaacaagtgttgcagatgatgagaatgtacggaactctcatactttgctggtggaaatacaaaatggcttttgccattatttttatggcaaaaactgcaattacttttgcaccaacctaatacgtggggcctgaacgtagattcgtctttgtgaggagctggagtcttggggtacagagggaggaaaatggagagtgactactaatgaagtttctcttgcggggggtacaaaatgccctaaacttagatggttttagaggagtgcacaaacctacgcatctactcaaaaaaagttgacgttcactttcagtgagtgaattgtacggcatgtgaatgatagctcagtcaggctgttctggaaggaagaagaattaagtagaattcacacattagagttgcatcagagttctaagcatgagagtggaccacagttgaacatactgacaaccttcagtgatcgttattcagagtgttcacagttttgaaaaatctaacatcggtccctcttctgcctgcctggtacaactcctgctacttcccctgtacccgagtaattttgtatgtacccaagaaaacaaaccttgaaactacaaacatgagtattagctaacagaatttgggagataaatctgctggaaaaagctattaaaaaattgcacagctcattccagaatcaaaaaagaccatcatcaacttagataattagtcatttgcagtagtttgactctgtagtgatgaaacaggctggtgctttccctgtgtaaacccacttcacgaactctaagtcatgttttaaaaatatacacacatgcaaaaaatactatatgtatgcatatatatgtgtgtgtgtatgtgttttgaacaattattcatctattgtgaataaactttttcaaatctaatctccatgggaagagtcctattattcaagtttctgtaatacataggacctttattgctaatggaaagagataaatacttagaaaaaaagaatttggtcaggtgctgtggcacacgcttgtatccccagcactttgggaggctgagggaggacaattacttgagcccaggagttcaagaacaacctgggaaacatagggagaccctgtctctacaaaaacaaacaaacaaaaattagcttggcatggtggtgcacacctgtggtcccagctacttgggaggctgaggcaggagaatcacttgagcatgggaggttgaggcagcagtgagccatgattgtgccactgcactcctgcgtggtcaacagagcaagaccctgttttaaaaaaaatagtaattcaatatgataaaaagtggttaactggcagggtagggtggctcacacctgtaatcccagtactttggggggccaaggcgggtggatggctggagcctaggagttgagaccagcctgggcaacatggcaaaaccccatctctacaaaaaatacaaaatttagttgggcgtggtggcgccttcctgaattcccagctacttgggggcccgaggtgggaggatcacttgagtctgggctgttgacgctgcagcaaacagagatagttccgctgcactctagcctaggtgaagaaagtgagaccctgtctcaaaaaaaaaaaaaagtggttaaagtacataagaagaaaatgaatttgtctgtctttgctatgggtgaagatttgcatctttcccttctgtttaatgaacacttcaccctctctccggaatccttatgccccctggtacccactttccctgcctttcctgtgactttctgcttactgacactgggccccactccatggccttctgaccaagtcaccgctcaggctttttgcttgccatacaaggttggccttagaaacttgaaccgtgggcagctgctaggtcatgagaagaattttgagcccgtggaaaggaaacttttgtttaaggcagacaatactagagacagacctttgatatggtactttctagtgagcagatacccagtgaagattaaccatgctgatgctgaagaaccggctatagaattacagtgtggtcttggatattgacacttctagttcattcaagtttccatcgattaaaccacaatcatcatggcaaattaggatcatgtagcttggagttcttcggtttgtgtgaaaagctattgtatacaatttgttcctccttaaagggacatgtaaattgtcatcatcattatttaaatcattacatatatatgctatttcattttccagatttattgaggcttaattgacaaataaaaattatatgcataaggttatacaaagtgatgtcttgatatacattgttaagtacttatcacaattaagcgttaatatatccattaactttttgcggtaagaatacttaagatctttaagatctgttatcttagcaggttttaagtgtacaatacatattattattattataggtactgtgctgtacattaggtctttagacttgttcattttataactcaaagttataagtattctttgaccaatgtctccccatttctcatatacttattataatgtcacatcaaaattaaattctaaaattcttggtgttttagggcctatgattttgcaatttttaagagtaataattctgcagagccaaataaatgaaaacagcattacagctaatataattcctaaaataatgtaaaacatttttgttttacaattaggctttctaattataactataatttattaatacatagattagattatgaatacaacagaggtctgtctgcagaatccctttgaatattgtcttatgtgaagcctatgagcattttcatttcatttcattctatttcgatttactttgcttttgtttcctaagatctgtaataaaacacctaggatcccagataccttgaatgtctttctaagtctgaacactttaggtaatcaacctcatctgtcattttatcttgttggtaatactaaacattccctaactaatcttttagcattgtctccatcctctcccacccggccccagccacgttccacctccgattgattatagaggtcgctcccttcctttagggccagcagtgaggctggcacccgagcgtcacatgctctgtatctagatgaaagaacgtgctcctggccaatgtggctccgtagctcattgatctctctctggagaaaggctggtatgtctccttgcacatttcttctttgaatgatttaaaacttgatgctgagctatataaagttctgtctggatagctgtgccttacagagggagggtcatcctgaaagatgccacttctgcctttacagaaagggcacgcagaccgttcctagggcaagccacctccaccatggcgttgtgtggaattagctaatggttatacctggcaaagatgaaatgaaggttaacaggacaacagaggtatccttgtgctactgtacggtcagaaaggaattcagccctatcccttggagttatatgcagattcaagttgtctggttttttgtaaggaaatattaatttttaaaagcatttgtcttggctgggcgcagtggctcacgcctgtaatcctagtgctttgggaggccgaggcgggtggatcacgaggtcaagagtttgagaccagcctcgacaagatggcgaaaccctgtctctactaaaaatacaaaaattagctgggcgcggtggtgggtacctgtaatcctcatgaggctgaggcaggggaatcacttgaacctgggaggtggagggtgcagtgagccgagatcacaacactgcactctagactgggtgacagagcaagactccatctcaaaaaaaaaaaaaattgtcttgaggaggacagaattgcaggtgtgttggctgagtctgtagctgttttgctgtgagcagaatagaaccagcgtcattaggtcagtaccaactctttttgggctttacaatattctgcccctgcagtggttctggggatgagctgggaaatgagatgattggcgtgttccccaggaggaaatgccagcaagccatgttagagaggcccaactgcctgctccccaacaggggcctcatcccctgagtttcattaacctaaagatgacctctgtctccactaacttaggagtcactgggagtagaactagtagagcaatagaagaaagtgcgcttataagcctgatatagtaaaatagtgggtagcagcaccagcagtgagacatgaaggaagtgtagtgttgggtttatttttaaataaacagatagtatctgtcattatattaatgatttagtattttgctttgttattttagcactattaatatttctcttgttttataatggacatctaaagtgggctgcatttaccatgactctgaaaaataaaaaaacttaaaattcagttatatattgggaggccgaggtgggcagatcacaaggtcaggagatcgagaccatcctggctaacacagtgaaaccccgtctctactaaaaatacaaaaaattagccaggtgtggtggcactcacctgtagtcccagctactcaggaggctgaggcaggagagtcacttgaacctgggaggcaggggttgcagtgagccgagatcacaccaccgcactccagcctgggcgacagagcaagactctgtctcaaaaaaataaataaataaaaaatttagttatgtagccattcactctttttcaaaagaatatattgaatattcatgacttaggcattcatttagaatttcaaatacccagaagtgaaagttgacaggcaagaatccccactcctttaattagtcagaaaaaaatggttcagagatgagcctctaaaatgtattgaacaaggaaaaaggacagaggtaaaagtactaactctttaatctttaaaatattccaatgatcattatatttagataatatatatttttgcaaaaattttatcagaaataaaagtgtattcctagatcttaactttacgagacgggtttattttttaaaattaacctctaggttcaaattcctatggcctaaaggtaaatatttttggaaagtgataaaattccatttggccactttaaatttttccaggtgttcaggggaagtaaataaaatgaggcataaaaaggaaaaagtatgaaaaaggtagaaaaaatagtagaaaaaagtatgtcatcagttaagagatttcatcagttaagagaattgcaggtgctcacagataactcagtagctttcattttaaacatcttactagctgtagatattaatacattcttaaattcatgtgctgtttttatgacagaagcactcataattctatactgagtatgtacacaagtttatttcctacaacctctgattagttttcttaatgttttcgttttacaaaggctgaataaggtatgtagcaagagcacgtgcttgtaggttaaaaagacctggatttgatgtatatctctgagagcacccatgtaacccttgacaaattaatgtactctctgaacctgtttccccatttgtaaaatgaaggtactatacgcacccaattgctgaagtaaattaaaggagacacagagtataaaacatttagcacacgctttcacatatagaaacttcttagttaatgttagttgctgccattatcattaatatattaacgttgtttgaaaagcaataaacttactatgagaaagatttagcactaaataaattcatagaagccaaaccccacataattctattctaccagccacccttccttaggtttgtattcccaaacatgaatcgaagcattaccaatgataagccctttgaccttgggcagttatttaatcttagtgaacttcagttttctaatttaaacaatcgacatatcaatcactaaagtacatggtattgaggctgttaattatattaagtgtcatagtcccaacacagtgcctagttcatcacaggtgctgactattaaaattagtaccaatggtgttttggaaattactactattattataaatgagcccagtgtttttctctccatgaataaaacattgaggaagaactggacagaatgaggaagagcttggaaaaggaggagaatgagagtgggtattaatgaagcatagagatgaggaagaataatggtgcttaaaaatggaaggcatagggccgggcgcggtggctcacgcctgtaatcccagcactttgggaggccgaggcgggtggatcatgaggtcaggagatcgagaccatcctggctaacaaggtgaaaccccgtctctactaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgcctcaaaaaaaaaaaaaaaaaaaaaaaatggaaggcatagaacacatagaaggtaaaagtcactggaaataacttctctatgagggagttcatatctttttgtattagcagcatgatccgccacttaatattttaaaatattcttaccatggaaccctgtgctttcttcactgtggatccgtagcaatcatggcgttttctcttttttgtctccaccaaatcaactcactcttgctgagcatcattcttcattaagatatggctttggggccaggaatggtggctcatgcctttaatcccagcaatttgggaggctgaggcaggtagatcacttgaggtcaggagttcaagaccagcctggccaacatggcaaaaccccatatctactaaaaatacaaaaatttgctgggcatgatggtacccacttgtaatcccagctactcaggaggctgaggcatgaggctcacttgaacccaggaggcagaggttgcaatgagctgagatcgcaccactgcacttcagcctcggtgatggagtgagactctcactctaaagaaaagaataaatatatatggcttccaatcctttagattatagatctcctatttatagtagtgttgtgttgaggtcttttaaaggacaaggattgtgcctcttttgccctctttacacatcttgttcttcttagttaagcattaagcaaagctgtcaacatagcatagaaacacagaggttggagttagggatagagaaggggctgggagcattgaaaatagaaagccagacccaagtagcagcaccagagcacagggtatggagcctgaacttgaggctacataatattgatggcaaattcaagataaaggtggaaaagctattgttttttaatgtcatgggccaacaaatgaatggacggttggttagatgaggagttactggaaatgacacaaccattcaagaaagaatacaaacccaagttagcaaagtgatggtattatgaggaaagcttggctcctacgtttaaaagctctctactttattattagttaaaaaaaaaaaagtcaaatcactcacagcacactttgccactgattacaatccactagtgtgtcccagacattcaaatgagaaccagggactctgcacaacctcttagcttaagagaggtgagaacatgaccatcggaaagtaaagaggaaatgtgttgacttccatataagatatactttactattcattaataattattaaaagcgagtttcggccaggtgtggtggctcaccggggcaggagggttagttacttcaggctaggagttccagaccagcctagaaaacatcgcaagatccccatctctacaaaaaataaaataaaaagttagctgggtgtggtggcacatgcctgtagtgtaccaccaggaggcacactacaattgagataacaattgctgaagatggtattgatgctgctaatgacattaagtgcaaaagtcccaacgcagtgactagcccatcacaggtgctactaaaattagtaccattggtgctttagaaattactgctattactaccagctacttaggaggctgaggtgggaggatcacttgagcctaggagtttgaggttatagtgagctatgctcatgctactgtactctggcctaggcaacagagcaagactctgtctctaaaaaaataataataggctgggcttggtggctcatgcccgtaatcccagcactttgggaggctgaggagggtggagcacctgagatcaggaattcgagaccagcctgaccaacaaagtgaaaccccatctctataaaaatacaaaaattagccaggcgtggtgacaggcacctgtagtcccagctactcaggaggctgagacaggagatttgcttgaacccaggaggcagaggccgcagtgagccaagatcacgccactgcactccagcctgggtgacggagcgagactgtctcaaaaataataataataataataataataataagttgcataatgatctcagaaaaggtaagagcgacatgttcatatccaaatattcttaatcactagtagtcatgtgtcattttctacctgattatgacttctctaacaggaataatggagtctacacactttggggataattattataatatatacagttttattcctaattttatagtccagacccataatctcttatctacaattttgagacccaaaaacctcagaaactgaaagcttattcatatttttgtggcaaatttatctgtcagcaacactcaactttcatgaggctatgtacagtctttactcattctatagtgtgagtgttcatatacttacagaaataccattgtgtttaatcaaacattgattccatgctatgtcagacccttttgatagtgttatgctccatattcctatctgaaactggaaacgttctgaattgtttttattttttatttttatttgagacggagtttcgctcttgttgcccaggctggagcgcaatggcacgatctcggttcaccacaacctctgcctcccgagttcaagtgattctcctgcctcagcgtccccagtagctgggattacaggcatgcgccaccatgcccggctaactttgtatttttagtagagacagggtttctccatgttggtcagactggtcgcgaactcccgacctcaggtgattcacacacctcggcctcccaaagtgctggaatcgtaggcgtgagccactgcacccggcggaagagtgctgaattctaaaatccttctaagccctaagaatttggggtaaaggatgatagaatgaatggctggccgactgaactatgtattcactgggccttattctgctctctctagaaccgcacagataaatccaatcctttgttccatgtaataaatctgatatttaaggttcgctatgaagattctaccaggttttctattgccctgacataaaccctttgtcctcttcattgttctggagtctcttggacttttctgattcatttagcttcccgctcaccctgggcctcatcatctgatagttcagctatgccagcactggtactatgatttatacaacagattacacctctcaacttaccacttcccaaagttggcaggccagacccttcacacctcttgctctaggaaaaatcttctaagctggacaacttcaaaatcaatgttccccaacctaagttagattctctaaggaatggatatcctgagacaaatcctgggaagcatgaggggaatggcaagtcaagagcattttcattccaatttccattttcctctctaatcgttccccgtactgccaccttccacattcttcaaactgtaagcaccacttctgcatgcttcactacgaatgtatgacttgtccgcatacttccctgaggtccttcagtatgtacttattaagtgtctatactaggcagtggagttgtgaataaaaccaaattcctgccctggtggagcttacattatagaagggaggtccagaccatcaataaatatacagcgaagctccaaggaaaaacagagcagggcaaagagaagacagctatgggaggtggtttattttatataaattagccagacagtgcctctgagaggtgatgtctaagcagggactcggagatgagggaataagctaatggatatctgaagaaagaaccttccacatggatgaagcatcgcatgcaaagctcaaggaaggagcatgtttagtcaagtgcctaaagtggctggagcagagtgagtgagagttgagaggtagaagatgaattcggagagggagcattggggccagactatgtagcctagtgggccaagtgaggtcaggcctttaagaaggagcgtattgaggaagaaccatgcacactactgctagtgctagggtgagaaagatgaggactgagaactgacctggatttgggatcttgggtgaatgagtgacatccgcaagagtagtctctgttgactggttagggacagatgtctgattaactgggagcacaggaagctggggcagtgactctaggtaacacgctcttgaggcattggtatatgtaaagggtcacaatggaaaggaaagctagcaggagggcaagggaattagggttttgtttttgtgtttatttttggtgctgggataaacagcgtatgtgtcactgggtagaaatgatccagtaaaggaaaaattgtgaactttgttctctcttaatatgtgtgtttcgttgattcattcctgacttgtatctcccacatcttatcccttaattaagccattcttcctcttgcataattgcaaattattatgatataaatagctttgttgtactcttttatgagttttacagggaggaaattgcataaactctctataaagtaatttctatgtttaaaagcccttaagttctcccgccccatagcctgaccaaaaaagtcttactaaacaaaaataggatacaaatgatccatacacatcatcctggctagagaagggtcagaaactacagtgttgttagaaccaatagagcttaactttatatctcactggctttaataaaaaacttttctgagctatttgacacaaaaatcactaagattaagaaaatatcttaacacaggtggaaatagtaaaaggatgtttgcatgaaaaccgtcaaatgtaataaacagcactattctctgataataaaagatgaatctggctgtcagatgcaattttataatagcttcgaccatcatgtacggcaggagtatttttttttatttactatcgttaagtttgtggaaccagtgattgttgttttactattttgttaaggaaacctaaaacattcttagaatgtacagaaagaatatggtcattcttataggaccaaagggcgtatcaagtgagctgcttttgtaaataccatgaaaatccaagtctgacatggaattaaaatcatctctactacaagatgcagaaaaaaaccaaactcttttttttctatatcagagacttaaaaatattagtgatgaccaatgtgattagaagctttaaaatcctaacatttatgtgaacaaaaatcttcctgttttcagagacttaagcatatcatctgagcattgaaaaaagctcttaatagtacctttcagatttctcatctgttttcagatcccatattaaactccttgtggaagaatgagaaagaaagctactctaaattttacagaatagaattcaggctctttatttacaaaatggagtgtgaaccttgctgtttactcatctaccccctcaagcaattgtgttttccttccttatcagcacagaccatcacagttccaggatttgtctgagatgctagccacctctgattgctattcactggacactcttgtgattgtgatttaagattgtaggccaggcgcagtggctcacgcctgtaatcccagcactttgggaggctgaggtgggcggatcacgaggtcaggagtttgagaccagcctggctgatatggtgaaaccccatcctactaaaaatacaaatattagctgggtgtggtggcatgcacctgtagttgcagctactcaggaggctgaggcagaagaatctcttgaacctgggaggtggaagttgcagtgagctgctatcgtgccactgcactccagcctgggtgacagaacaagactctgtctctaaaaaaaaaaaaaaaaaaaaaaaaaaaaaaaaaaaaaagattgtagaggaagtatgctaactgtcctttcttctagatttttcatttttaacctcatatgagattagatcaccaaaaacctacatggcatacttgaagtgtttgtaagcattactctcctcagaaatgctttcaccaagttaaagtttcgtctcagttttcattgaggatttgtgtgggaaggaaaaaattggccattggaaaatgtctgtgtcttctacattttcagatttatactgactacaattcacatcctttatttagacaatcgtgtcaaaaattcctcctagaaattagagtcaggagaatgtggtggttgttttttcttctccggatgaatcttacatgcttttctttttcaaagatgaacgctatagcccactgtgtttccacgactacttttgcttgaaaagagttcaaaatttatccaattattcaatagaacttctcctctgtatttgctaaaagacatgcatccacttctctagttctcttttaaaataatatcttcagtgttgtaaaagattcagtctttcagaatcaaatgattgtaggccaagcgtgctggctcgtgcctgtaacaccagcactttgagaggccaaggcgggcatatcacctgaggtcaggagttcgagaccagcctgggaaacatggtgaaacgccgtctctactaaaagtacaaaacttagctgggcgtggtggcaggtgcctgtaatcccagctccttgggaggctaaggtacaagaatcgcttaaaccccagtgagacaagatcatgccactgcactcctgcctgggtgacagagcaaaactctgtctcaaaaaacagaaaagactcgaacgattgtaagtgaatagaaacataaataaataaaatacatgtaaatgaatataattaacataaatatataatgtatatataatatgcattaaatataaatgcatatattgatataagcaagaaagtaaaatattaaaaacattctgaaaatcacgtatttattaaacaatataaatattgtttttgtttgtttaattttccaaaatattatgctatgttatgctacctccaaacagaggttttcaacatgttctcctgggcaaacattgtcaccatcacctggggacttgttagaattatacattcttgaactcccactctgggcctgctgattatgggggtagaaaccagcaatctgtgtttcaacaagcctttcaggtgattcctacacacagtgaagtttaagagccactgttctgggtctcataataaaaaggtgcctatagttccaaccgcaagctctccgcttacctgcattcctgccttgctatttgcctgccttccttcttgcatcctgtattcccgctttttatccttcctatgtgtgtgcattgtgagagaaaatagtgcaatgatgaaagcgaacgctctggaagtacatgatgtgtgtctggacttgaactactacaagtctgccacaaattagtgtgtgatcctgaacaggtaatttggccattttaagtgtcagtttcatcatctgtaaaagttggacaacaacaatatctaccttagggggttactgcgaaatttaaaggagatggttatctgtaagctctcctagctctgcatttggcacattataaggtcttggtgttagctgctattgtgatgagccaggtgccgtgctgggcatggaatagagagagaaaaggcactctctgccttcagggtgcttacattgcattacatcttttaagatgcttcttctgtgggtgctctctaaagggaaatggatattgaacttgggaaatacattgcaagtcatctattcaaatctactttccactgtaggaatatcattttcatagtaataatggctagacatttaagcccatgattttgtcccctttttagtgctattgtgatatggaaagagtgcagactgtggagttaaccacatctgggttctcttcttcattcttctatcgcgtgacctcaagaggctctctgagccccagcctgctcatctctaaaataggatggtggcatcactcatgtttggtcacaaggtggtcaaatgagatggtgcacatgatatgcccactgtctctgcacaccactgccccactgtaaatagtcattttcttcaaataaaaaatcaacccaggcctttttctgggtatctgtgaatgccaggacagctttccctgttctcagattaaaacaatatctatataaattttaccagttgattatatttcaaccttcctcaatgagacactctttaaaaaaggaacataactgtatataaagtcaatctgttatcttccttgagcatgtttgttcattgtaaattcatctaggtatcctctcatgtagccatcatttctctttctggtccacagatatcccatgagagagtctttaaatgattttttggaatgaaaatatattacatatatgtctcctaacctaggagttagtgaggctaggttgacatgatttcttgctgtatccttacagtctcctaatggtcatgtattgaagacattagttcttctataagatagaagaaaacataatgccctaaatattttataactttaaattttatgtacattcattcaaactaaattgttatttacagatggaattatagcagcaagtcagtaaactcaaaggtcaagtccaataaaatccttagtagtttactcaaaatgtgaattggacatgcagacacattgctgaagagttcaccggaagaaggaggcaaaaaacaagtgatttcaatctaagcctagttgtttaccagaatttatctctgtgattttttaagcttaatcgtcgttttactgtgcatcatcatccattcatttagtcagctattttttaaacatctagtgaatacttgcttgtgtgagctttaatgtaatgccctggaaatataaagatgactatacatgactcctcaactcaaggatcttactatttagcacagtaaagacacagataaatagtcagaagtcatccttaaagtgaaaatctgggggggaaagaagtatgtgaaagcttagaggattacgtaaataagcttgcctggagggtcagatatgtttcctataggaggctaattttgagtgtaacctgaaaggcctcatgggagagcacaggaaaaggaaaaatgagtaggcagtcccaggggaacagattagcagagacatctcataggactgggaggtgcttctgtattgctggagcccagggaacattacagagaataaggggagattaggtgagttggagccagtctgcaaatggcctcgcagacctcgctaaggaactttaaacaatttttgcttggcaaatgagtaagtggctcagatgattcccgtgtttgtaaaggatggatagatttcacacatggaggccagtctgcagggtatggcactggttcaggggacgtgagaaggcttgaaaaacagggacagtggaattagaaaggttgagacagattttaacgtcattactgaagaatgacagaacttgttaactctttgcgtatgcatagaaggggtggggaagagggagagaaaagattcagaggtttatcaaggaactggatggatggttttgaatggttatgctcttaaccaaggcccaggtgggtgagaggaaggagaatgtcctctaggacctagagcttgggagaaaggtcaaggctagaggattggatctaaaagtcttcaccgcagaagtggtagttagaattacaaagtggaaaattcctacagatactatggaggccagattagagtcctggagggaaagcatgacatttgaaaggaagcttaataaataagcaacagaagagattaaggaaacatgtccagaaagatagttggaaaactcagaagttctctgaaaactgaaggataagtgagttgtcaagaattagggaccagtggccaggcctggtggctcatgcctataatcccaggactctgggaggctgaggtgggtggatcatctgaggccaggagttcgagaccagcctggccaacatggtgaagccccgtctctagttaaaacacaaaaattagccaggcatggtggggcacgcctgtgctcccagctactcgggaggctgaggcatgagaatcatttgaacctacgaggcagaggttgtagtgagctgagatcatgctactgtactccagtctgggtgacagagggatactccattgaaaaaaaaaaattaaaaattagggattagggactagttaaccatttcagaattgttagcatggtgaagagtaaagactagaaatcaacaagtagatttgccagttaaaggaggactggtggctttttgtgactaaacacagaaagaggcagatgtgtgtgatgatttgtatgtgtgtacaatttatttgttttgttggtttaaaatgagtgcacagcagcgttcatccacacccatcattactaatctatagccattctaaaattatgggggagagttcttcatttctgagggagctcacccatgagtcacagtgttctgcatcttatagaatctttgacagtcatcaaagagattcagccaccagggaattaatttgattggtcaaatatgttttcttatgagtaaatgatcctctcagctcttttcacccacatatacccgacaaaaaaatggtttcaggaaacacagatacacagaatatctgtgcattaattttatgttcatgggaggaatacatttgtggtttttggaacataagtatagatacttatctaattgtcaaggagtcctagattttagactatgaatagtctgtaaaattcggctcctgttgttgataagagtggctggtttgcttcatgtgttactgtgaagggaaaggaatacgatgtgtgtaaggcatccgtgctggccccggacccccagggagctgggggcagacccctccagaccccacagcatgatgtcctacttctgcactgtccattactgagccacattcctgtagtccctccagggctgacacttgcatgaagcagctcaaagatgtttttaaagcttgattttctttgtgttaggaactactttgtgctcattcgagttgtgattcctgatcatttggggtgcaagcgcagtgttttctctgagaaagtcagagattctcagtgatgaaatttataaataggtgcctgaggaagccttgtaagtttttttcctttgagataatgataagtgacttggggttgattttgtttccagtatatctcaggggttttgtggttttgtatgtgtgtattttaagtcactgaggttacaaaggagagaacagagagctcgtaataaacttcaccaaatcacctttaattccaaaagacatcgaataaacttccccagatcaccttaattccacaagacatctaatactcacttctgtctttacctggagagaaagactcacagctcctaagctggcttttctaaccagcctttgtctagaatctccaccacctctctcctccccacacactccctaccttatgcctccctctgtgtgtgtgtgtgtgtgtgtgtgtgtgtgtgtgtgtgtgtgtgtgtgtgtgtgtgtctgtctttctcttttttctctccctctacttttgggtaaaaaagctttaaatttcttagcagacctgatggtgttatgttttagtaaagaatattgtgaactggtagtaacgatcattatatctgctttttgtttactgttagcagatccatctctgctctatcagaacctcagacctgtgacatcccagctccacaatgcacttaacctctcccatgctgggagattccataggcgaacagggctacttccagcaagccgagctgcagccagcaggaaatgaaaccgtctgccacagatacttatttagaccaagctattaatgtttagtggcagaaaagtggctccctttctcattcgattgaatgatgaaagcatgtctgtttccctgataagactgtggccagcttggctttcggtctgaaaggtggatgaagatattctgtctgcagagcgggctgcagggatgtctggtttcttttctctgtatctatgccagagtgtatctcccttcttcatctcacaaaccatttttaaacttaatcacactgaacttttgtatatgtttgcctgacaataaatgggtctggggttacgtagggagagtgtagagaaaaatacatctttattaggagagaaatgagaaactgctgtcgttgtttaaaataacccttaatgtaaatgagcccagttatagtgaggccaaaatgggagaaactttttgttggttttgaaaaataccaaaataaaaataataggaatttaaaacaagttttaacaaattctgtaatgaaaagtattttttattctctcacatattcctctctgatattataaaacttaaaaatagtctaattttcctagactcaagtttttcttttcttaagaacttacttttatgcttaatgccctaaccaaatgaagctgttaccacttagaatgtttgcttgtaaggagtaaaaatttatatagatgtttcaaaatttatttagcttctctttaagttacatttacaactttatttttggaaaataaatttattataaagatttttttaaaggtaaatttgaacttaagttttaataagtaaagatgttttatattcatatggtcatttttgcccaagacctagaaaacagcttcaactgaggaataaccttatagtcatattcctcaccaaatgcttcacacctcccaggggtagttctctgtagcatcacaaactctgtcattaccaatcaacaatttcacactttttttaccttgataagcttgaatttcaggttttatattcattccagcattactctatctttatgggaacctgttgaataagccagttggaggatgcaatagcttagaatcttatattctttgaaatgtggagccgcgattccctgcctatctgtaagtcagcctttggggcttccctaaccttctctaggtgcgactgtgaacaatgaagtatgtgggagctgggggctggggagaagcctgcgacaactgaaattactgcctgtaagtccaggaactccattcgttttgttagaaacaaactcggagtcctactgctctcattaattagcttagtcatctggatttctctagagaagacagagattgtgaaaaggaaatagagtttctgcttaaggtaggcatgctggctctatcaagaagtgatcacagcctatcatcctaagaagaaacagaagacataataagtacaaacaaaaccggcaaagtacagtgttgggtcagggactgggcagactgccttacatatctcaggaggccttagtccttaggaagggggccctgtattacagcacattacaacagtgaagtgtccaatgatgaacatgggccatcaactaaaagttaaatcgttcctttttttttttttttgagacagagtctcactctattgcccaggctggagtgcaatggcatgatctcggctcactgcaacctccgcctcccagattcaagcaattctccagcctccgggtagctgggattacaggcacccaccaccacgcctggctaatttttgtatttttagtagagatggggtttcaccatgttggccaggctggtctcaaactcctgaccttgtgatccaccctcctcagcctcccaaagtgctgggattataggcgtgagccaccacaccaggccttccatttctttaagagagagaaaagtttaatttgtttcaagaaagactattcaaaattggttatacaaagatagtaccgtaaagggggcaagtttccattatctgggaattacacattcattgattaatctcactgtttctgagcattgctagaaggaaagtttgcttcgagatgaaatttattttactcacattggacttacctttgaaatttattcagcgtagttttgtttctgaagtttcatagacaataaaagatattgtaaaatattaaaataaacatcaagttttatagccattatctaccatttagtgtccatctcttccatctaaaagataatgctacatttcctgttttctagtctctgctttctgtgttgtttgattttttttccccaaagtcactaaaagtgatgaatgaagtttcttttcattatcatatggtttggttttgctcatattttccttctgttatctggattgctaattagaagttgcaactgttaaaatgagcctatcacagatgtcatcttaaaatttttacttccctttttagttctctaatagggtgaaatcttgattcacaaatgccctgggtagtccccctttgtgtgaatgcatccactaaaatatatatatatgtgtgtgtgtgtgtgtgtgtgtgtgtattcacacacacacatatatacatatgcacacacacatatacatatgcacacacacatatacatatgcacacacacatatatacatatgcacacacacatatatacgtatatatatctcttcatgaatcatgcacagagctgtgtctctgaacagcatccatagacccccaccaggattagaagttaaactcaagtgcagacacagtttggaagccttttgaccatcttcagccccgctctggtttcctctctcaggacacacttccctcttcatggtgattgcgttctcactctatcaatgaggtattgtccctctttttactttctcctccttcccaaacaggacatattggtcattttaatttattgtttgaaatgttatctccaccatgccttttcactaaaagcctttcaagtctggttgtgacatgaccatcttttttctacttagttaagaaatgttaggcatcactgaatgaggagtgaggcaggagagaaagtggatggaacacgtacaaacagttactcaatagactcagagtggcagctgatgaaatctgccaccgtaaaccaaatggagagcccaagtaggaagatcgaatgttggcagctggctcaggctgtcttcgtaccgacttctccctcattatttttcttatttctgccaactctggcaacatagtcgacctccagggacacattcttttttcctgccgaaagtgtggaaaaatgtcttgttgtcagagttttgttgaaataaaattggcttttggaagcagcaacatttgctgggaagcttaggaggagtgagactcaggagcaagttgatgtggtttgggtttgcaatctggtacaagagtgggaactgaggaagtgtcgttgttttgggggtctggcagcaccgctggggcttcagggagtgttaatgcctcagttccagggcaccgtttctcagggtggtccttacaggccacctacaccagattctgccagatgctacttctgaaagcatcctagagtgactaaatcagaatacctaagaataggcctagagagctgcattttaacaaattctccatgaatctcctgctccgaaattagaagaggaactatattcaaggttctggggctcagttttccagctgcccaggtcatttatgtgtgcataactagaggcgcttagagtgaggtgactgactcatcctagtcacacacataagaaaccgaggcataaacctgaaaaccagttggaactcttgcctccatacaggaatcctatggcagcagaaaggagaactgttcatagttcttgaagctcagtttgctgtttcttgactcttactcaacctttatatgttattctttcatgttcaatccattttccttttccaagagaagtataaacgattaagatgtgcctgttaaacaaggctcggcagtcgcttactccagaaagatctctgtaaacccagccttcccacccaggatcctcctccaggacacagttgtaccttatacgaacctgggtggttgctcttaatgcaacattgtcatttacttgctcatgagtatctctctcctactagacattgaatttcattgtccctataatgttgagctgtgcctagtgctggacctcgagctaatgcttcagaaatgactgaaaaatgaatggatgagctgaaagatcttgtgaggcctccgatgcacattctcctcagtttttgtggtctctgccataaggaatgactggatgtttttgtgtaaaattaaaaatgtttgtattagactcggtttcctgtgatccttacaaaaatgtgttttgagaaaaaaataaataggattgggagaaaattaagatgctttgaggatctaaatacttgtaaagtacattttattggaatgccacaaaatgctttaaaaagctccaagtaaatttaagaggagatccactggattttgactaagtgctgaaaaaaaaaaaaaaaacagtttccttaattccctatccaaatacttcaacttaaatttactggtagctgtttcagagggagatggggatgctgcaatccttagtttgttataaagaaaatgtttttatcttcaaatgtttagaggaaggattaaaggcaatttatggcttgggtgaaaagtaataaaagtggtaacaatgaagtatcttctaagttgtcatcattttctggaattgctaacaatatcaaccaggcaggcattttatatctgaaaggagttactttcatttgtcatgctttaatataaactataacatcaatcttatagctgcaatactgagttgtttgtttgattctattgtttaaaaagaggaattgatttagttgtaaaggagatgaattctgtcattagattttttgccacagggatcaagaaatatatttataattcacttctttcaggaaattaggctataaggtctatatgaaatgcattttattaagaccaagccacagcctctttggtttctccagaaataattcatttttaattcccaaggaaaagtcacagtaataaaaaataaattttacctgttagattattttccttgtcatagctcccctttttattaaaaaaaaaaaatccaatttacagatttcttactatttgtttaattaaaacaataataaattttatagccttttacaatgcataaagaactttttaaataaaattttactccgtctttgcaactctgtgcagtgataatgaagataatttaatatataatggaaacttttcactctgtgagggaatagggaggttcaggggtacaagaacattaccggtgtcaaatagcagagccagaacttcatacaggactttgctccaaatagcatcttcttttaactatacctctggtcagttcaatgttgttttccttgtcatatatgcttaacaagaaatactagaaacattaaaatgttattactgctcactctcttttttgttatcaaatgattggttcccatgctagatgaagctcagtttttagaaactgctcaagtatttattgcaagtgatttgtatgcatgagtgtgtgtggtataggaagttaatctgaaataattttaagtaagcatggcatgtaaattttcttttttttttttttgagacggagtctcgctctgtcacccaggctggagtgcagtggcacaagtgcagtggtgccatctcggctcactgcaagctcagcctcttgggttcacaccattctcctgcctcaacctccgagtacctgagactataggcacccgccaccacacccagctaattttttttgtatttttagtagagatgggatttcaccgtgttagccaggatggtctcgatctcctgaccttgtgatccacctgcctcagtctcccaaactgctgggattacaggcatgagccaccgcgcccagccggcatgtaaatttttatgtgacactttttttttggtggggggtggcaggggagagggtctcactgttgcccaggctagagtgcagaggtgctgatcacagctcactgcagggcacgcaccaccatgcccggctaagtttttgtattttttgtggagtcagggtctcactctgttgcccatgctggtctggaactcctgggctcaagcaattcacccgccttggcatcccaaagtgctgggattgcaggcatgagctactccgccctggctgtgatactctttaattattctaatgcttctaacttacgtcatggtgccaatcctatttatataatagaatcaatctcatactctcagctgacaatgaggggtatttcattttttacttgtatataagattccttttatataggatgaaatgcatacacactctgcatagaaattcttatgtgtttgtatattactccattcaatcatactatgattccaagttaagaactcctagataaattagcgtctgtagctgtaacagttgaggctttcaattcaaatgtcagataacattcttctgtgtattgtattattttctgcagtaattcaaatctttattgagttgaggtttgctcacttactataaggtagaatgaggtgatctaagtaggttttgtttaaatacatgtgtcttctccccatcagagtaaaagaagccgaagaggtgtgtagacagaagaaaggaaaatcactttataaaataaaaccaagacatgactctggaattgtaagtattactgatttttaacttgttattttctttggcttttaaatcctattttcataatatatacaaactcataatattttaattatttttctactaagtgtgaataaataaggagcttctgacttcaagaatctcctttttcttatgcctttaatcaggcccagaaggctaagagtcttgatattgattattcaaaacttaagaattgggctgggggtggtggctcatgcctgtaattccagcactttgggaggccgaggtgggcgggtcatgaggtcaggcgatcgaggccatcctgcccaacgtgatgaaaccctgtctctactaaaatacaaacaattagccgggcatggtggtgtgtgcctgtagtcccagctacttgggaagctgaggcagaggaatcgcttgaacctgggaggtggagattgcagtgagccaagattgcaacactgcactccagcctggcaacagagtgagactttgtctcaaaaaaaaaaaaaaaaaaattaagataaatctactgaatctactgagggtgtgcatttatgtggatatgtgcatgttggcaggggcagggtggggagaccatctttcactttctttgttacacacagatcacggcagaggctgtatttgagccacgagtgatcattctaattggattagatccactgggatgtaaagttggtgggaagcgccaagagcagtgtgacgctttgcccagggtgcccagaccccgtttatatccacagatggctcggcagagttggctgccggagagtggtcagtccagagacggagtttaacaagctcatttaagtttcctgcttgcccactccccgctttaaaacaaaatgccaggttatccaccctgggagggaagggcttggttaaaatgacaaggcttttccttgtgatactgaggatgttttgttgactgttttgagggattatcacttggtaccacagtgtaagtaaatgttttaaatgaaaagttgagttaggccttaggataggaccattctaaattgaattagtctaatgtagtctaaagggaaaagacattaaaataacccaaattgggatatgattaaatagccctgtttttttttaaaaagttaggaattatatcttcatttagaagcagtggtgccttcagtttctctgtatcaaaatgatcttatctaatgataactactacatgatagttcagcttatcttctgctcctgatgattcagtcttataactgtattgaatgtggaggaatagttacttattagtgaacctcaatcttgctattatgagtacagaagataattagagtacatttaccatgaagtgaagcagccacttcagttttcatatttatgtatttgcatgtaggattgaggatgagaatggagagtttgacaccctctcatattggttagaagttaaatttttaaaacttttttttttctcaaaagtatttggcgatttgtcttgataaaagtgctcaaagataacacagatcccacttatacttttttcctttatggactggtagacctttaaccttgtcccacagaatttgatccaaatgaaaaggtcttttttaggctactctaaattctttccatttttaaaagttctttctaactaaaacttttatctggtgtatttgttttcagaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcattttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaagacagctgtcatatttaacatggggtggggaataagagaaggagggaaaataagttaggcatgctgcatattcacctgcacacacacacaaaaatgtgtgtacagtttcagggacttaagaacttaaagcccatcaatgatacctaagtaagaaatcctggtaaaatatttattcctttgtggcttgaactaggatctctttcctgatctcccaaagatcttctggtcattttcaatcagatatctcaccatgccttaaaattcattatgtgtaaattcaaactcagcttgtcatcttttccctccatacctgctcattcttgtgtattatctatctcagtgaacaaagccactattcattcagaaacccaagttcatcttttgacatattacttatcacaaatgcatacatttgtctctgtcttttctattaaagtcttagttcagaaccctcattaattcctttattaacctactcattgttctcatcttccgagatttgccctgcaacatatttttaaaatttgaatccacctttttctaaaatacaaatctgctcatttgaatttcctacttaaagcattttaatggccacatacactaagatatgtggcctcaaaatgttatctaaatgtttaatatggcagacggagtcccaagcagtgcctacttacattttgagtttagtctcttgacttaacctaccttgaattccagcctccagccaaactaaaatacctctaggctaatttcctctcaactatatgtctttccgcatgtttgccctcagcttgaaacattgtcaacatttcatggattcactaataattgtatctgagtttagaaggcatttgttccaggatatctcttgacactggtctccctggctcctagcgtgtgacagagactcactacatatttgctgatgaaggcaagataggagtgttaactatgccagatgcttcaggatacaagtaggttgaaaatggaatgaagtcccttgtttgctgaaaaagggtagtggtaaaaacgaaggtagtgttaaggaagtagaaaagggaggttcaatacgctccatacttggaagacttctgtcattcaagaaacattgtgctgtgagttaagaatttggatttcccctctgtttccaagtagaaaaataacatgaaatatattttcaaaagtatagatgcagggtgggaagtgggggttgcaagagagtgcatgaacaagaggaatctctatggagtaaagacaactgatcatgccccatttgtagagggaaatcaacccaggatcactaccagagatgtgagacttacctaccagtgaggatccactgaaaacagctgcagaggatgccacaggatatggcaaacattagccagccagacacatggtagcaggagaaggcagactacactgggccagctaacttctgggccatgtctgtacctgcagtgtctctaatgtcactgacacacagcccagtgccacccagaaagccgggttctggactaggaatgggtggacgcaatggaaaatgaccagatacagagagagagaagaggaaaaagaacgtgagcactctctcaagacgtctctgcaaaacacacatccaaagcacggaaggaaaattctcaaggagaaagaataaaacaactcaataaacagcaaaatgaattcacctttaaaatgcaaacaacacggcaaaacttagataatagttatatctagaatctgtaggctaggggtggtggctcacacctgtaatcccagcactttgggaagccgaagtaggtggattatgaggtcacgagttcaagaccagcctggccaagatggtgaaaccccatctctacttaaaaaaaaataaccgggcgtggtggcaggcacctgtaatcccagctactcgggaggctgaggcaggagaattgcttgaacccaggaggtggaggttgcagtgatccgagatcatgccactgcactctagcctgggcaatagagcaagaccctgtctcaaaaagaaaaaaaaaatctgcaaaggaacttcaaatatataatcattgagacacaaaaaacagaagctgaatgagttctagatgggcacacattaagtgacaagtgatttggaaggtagcaccaagcaatttagtgagaccacacagcagagagagaaaatatttgtaaacatgtaagagaagttaagagagatacaggataaactgagagactccaattaaagaggcagtccatatggagaaattaaaggaaatagtagaaaagccaaataatggcttggaggaaaaaaatggctgagaattttccagaattgaaaaaagatatatcctctgcttaacacgtatcaagtgccagacagatatataccaatacatttgcaccaagaaaggtcaaagtgaatctccagctaggtaaagagaaaatttgaaaacctcttgaaagaaaggacacgttagccgggcatggtggctcacgcctgtaatcccagcactttgagaggccaagacgggtggattacctgaggtcacgagttcaagaccagcatggccaacatgatgaaaccttgtctctactaaaaacacaaaaattagccaggtgtggtagtgggcgcctgtaatcccagctactcgggaggctgaaactggagaatctcttgaaccggggaggcagaggttgcagtgagccgagatcgtgccattgcactacagcctgggtgactgagcgagactccgtctcaaatcaaacaaacaaacaaaacgacagaaagaaaggacacgtcacttaaaatgaaacggcagttattctgaaagtagatttgtcctcagccacaatgtatgttagaaaatagtaacgtcttggctgggcccggtggctcacgcctgtaatcccagcactttgggaggctgaggtgggcggatcacgaggtcaggagatcaagaccatcctggctaacacggtgaaaccccatctctactaaaaatacaaaaaatcagccgggtatggtggcgggtgcctgtggtcccagctactcgggaggctgaggcgggagaatggcgtgaacccgggaggcggagcttgcagtgagccgagatcgcgccactgcactccagcctgggcgacagagcgaggctccgtctcaaaaaaaaaaaggtaaaacgtctttaaattgtggaaggagagcagtgaattgagatcattagacccacttgaaacatcattcacatggaaggggagagagagattttcagacatatgaaaagcacaggaggtaactacgcccgaagcctcactgaagcgcctgctgcggggcacatttcagcaaggaaaaagatgcaaacgaagtgagggcctgggatttaagaaatcacagaagccatagaaactggtgaaacaaaatcaaccctagaatgtaaacagtaacaattacaactaatttttcatgtttacaatgggcactaaaattttagatagtaacaacttgggtgggagaagttcagggaatagttcaaacacgcgatggggcatgtgctgctctcttcattcattcaattctgcaaatgtttagagtggtcagtgtgtgccagaaactggagtaggctttgggagtcacggacaaagaatgtcccatcctcgtgtaacttatgttctaatgagggagacaagcgatgtaaaataatatcaggcaatataatatttaagaagggtgacaaataacttattcttcaaaccagaataccattgagagtaaaagtgaggctattacacctggaaaatctccataaattgataccactcccagacaaactctggtcaccctacatataagcactacgtgagctttaagtgttatgaagagacatagaaagccctatctccttaaaaaaaaaaaaaaaaaaaaaaaaaaagaatggtcaagtgtggcgtctcacagctgtaatcccagcagtttgggaggccaaggcaggaggatcccttgaacccaggagacaagcctggtcagcttagggaaaccccatctctaaaaagaaaaaaaaattttaatagccaggtgtggtagcacttgcctgtggtcctagctacttaggaggctgaggtgggaggatgagttgggcccaggaagtggaggctgcagtgagctatgatcacaccactgtactccagcctgggtgatagggtgacaccttgtccaaaaacaaaacagggagaagatggtgataatgaatatgtttggactttgttacaaaaatatgaaagtaaatataaattaaacatttagcactgttcattaaaagaacaaaaagaattaaagaaggaataagaaaaaaaaacatatcaactaaaggtcaatccaatccaactaaaagccagaaaggtaagaaaaaacaaagccaaaaaaaagtatggtaaaaagagaagtgactgtggatggtaggtgggagaactcaagggtaagtggatgggaacaaattgttacaagctctgaaaatcctgtgccattgttccttgaattacaccagctgtcattagcatttccacttcccagctaatcggtgaactcagacttttggaggttgtatttgtttcctgtgaaacacagttaaacaatcaaaagcaatacgaagaggtttgatgttctaaagtggtgtgacaaaggggacattcacccccttctctcccaaaaatcattccaaagcaacaaggaacaaatatgcatcatttttgatttatcttcaattaaaattagaggtgtcgaaaacccaaaccacaaaatatacagaagatctcccaaatgtgtgggtatggaaaaaggcagagaggatgctcatgaagacacgtctcagaaaaagcaagaaagtctccttctccaaggtgaaaccatacccttaggaggtgttatctcaaaatccttctccaaggtgaaaccatacccttgggaggtgttatctcaaactgtgtttgcaataatggacctcggtacaccaattggtattagacactcccctgaatgtctcttactattttttacatcaggaaggatgcctacatgagaaattaggctgacaaaccatatttgcaagaaggtgtctatcaataagacaaaggtgaaggaagagaccctgaattacagtagtaaatactagaacgagacatgctctccatcgtacttcataatgaaatattgtctagcttgaaacacaaccctactgtctccccacacaaactattcaatatttgcaaatagctggcaaatatcattaacactgctatcaaaccaacaaagattatttaagtgagaatactataggccagcttattgaggaatagcagtgaaaaatactaaacacgttagcaaacatcagaagggccatggagaaatgggggttattcctggaaggctaggatgatcatatgagtattgccttgcatatttcaatatatgtgtatttaaaaatcatatgcatgtgtggagaaaaaaacacatgatttcctcaaaatgctaacaaattaactaatttttgaagaaaaaactctgaataacataaatatgtccttaaagaatcaaatacctcaaggtaaagtcagcctggggcataaggggacgctttaggactatttctggccagacatggtggctcacgcctgtaatcccagcactttgggagtccgaggcgggcggatcatgaggtcaagagatcgagaccagcctggccaacatgttgaaaccccgtctctactaaaaatgcaaaaattagctgggcacggtggcttgtgcctctgtaatcccagctacttgggaggctgaggcaggagaatggcttgaacctgggaagcagaggttgcagtgggccaagattgcgccactgcaccccagcctgggtgacaagagcaagactctgcctcaaaaaataaaataaaataaaaaaattttaaaaaagaactatttcctttaaaactcagggacaagaccaggttgtctactttcacctgctatttatcactgttctggcaatgaacaaaaaaaggtatacaatggaaaaggatgaggtaaagttaatttttatttgctgtttattagattatatgctcaaaaaacagacaataacaaaacaactattaaagataataatagaatgacataaatcgactaggccaaaaattaatatacagaaatcaagaactttcatgtaaacaaacaatacccagtcagaagataaaattgtgaaatatccccacttaaaatagcaaacaaaaaatccaaataacatggaataactgtaataagaaatgtgtaaggtctatatgaaaatagttgagagactcacaaaaatggaagggcaatgacaatgccagtattccctaaacaaattataaatttaatataaatttagtgcacgccaaaacatttaatgcaatccaaataaaaatacctgcagaatgtttcatcgggggaagagggagggtgagaactaaagaagttgacttcaaagtttgaacataaaaataagcaagaacagtcaaggttttggggaggaacgagtagtggaaagagaaacttgcccaattacattttacacgttagaaagtgacagtaagtgtttgtaatagcaaaacattggaaatgtctaaataatgaagtaacgtttaggctttaaaacagaaaaaacagctgggtgcggtggctcacacctgtaatcccagcacttcaggaggccgaggtgggtggatcacctgaagtcaggagtttgagaccagcctgaccaacatggtgaaaccccgtctctactaaaaatacaaaaattagccgggcgtggtggcaggtgcctgtaatcccagctactcggcaggctgaggcaggagaatcgcttgaacccgggaggcggaagttgcagtaagccgagatggcgccactgcactccagcctgggggacagagtgagactccatcccaaaaaaaaaaaaaaaaaaaaagagagagaaaaaacaggccctttatatactgatgtagatgtacaacattttattaaggggaaaaaaatccataaaaagtttctatctttgtccttggggggggggaaatcaggaagaaaaacagtgtttatagtacagtctcatttatgaagaaatgatggcagcatgattactgaatttcaagaaattaacatacatagaatatctctggagtcattgacaagaaactgattattagttgcttctggagaagaaaaacaggtagaatttgggatagaggagagagaattttaattgttatttcttttggttcttttagattttgatgagatgaaaaaatcagtcaatagagaaatattttataattaattttgtggaatttatctcatttcaaatatcaaatgacacccagctggtcaattctgttaaatcaaggagacaatacaggttgggtggtttacgtgtttccacatcatgatagcagctctatcagatgtcctctccaaggacgatcaggacaattctcactctagaccactacagagagctatgtgtaaggctggcaagccaatcttgtttctctgttgccagaatgaaaaaaaggtcggggttgtctgtaggccactgggcacattttctcctatggtggtctgattgtgacagtaacattgggctttttctttcacaataggcccattttggttctacttgtgcaaaactccctttcacctcaattttggagttgcttcatactgccctcctggactatgtaaatgttcctaatctatagctccactcctatcggatgctctaaagttttccagagattaacatcactttctaatccaggcaatggatcataggagcaatttacactttacttgttaatcaacaatgagaattatctgttggtttcaggctttttggagtcagaaactggcaatatgcttaaaccatgtcccaacaagccctacgataatgaagttcaattaatctaaattgggccccgcaatacttgttatttcctatccacatattttaccttataaatgctgtctgtaattagtcagcatacccttaaattagggcgctcatatttttcaagcaaagagtgaaaataaaaaaaaaaaaaaaaaaagagtatttagcttacagaatttcaagatagatctagaaatagaccccatccacagagttcctcccagcacagggaaaaccagacttgcggtgccgatggtaacacaaattgtatattctttggctcctcaaataaaacaaaaattaaaatatagatataccgtggtgaaaacaaaaacagaaagcaagaaaccccagatgtaaatagttggataactctcaaacctttgtgctagagtttcaaacatcaaatttaagttttccagccttgattagacacccaattcataatttggtatccaatgtctccttcccacaaattagcagttgcatcgtgttaagtaactatggtcttgctagataaagaatgtccgggcagcagaatatgacagatgaaggtggtggtttggaagacttcatgtgtgcctagtttattaaacacaccctctttgccttcaggaatgtgagttgggaatggggctcaggccatcagtgcgtcatcaggaagatgtggcattgctcaaagagcagagcaaggagggttgccaccaggaaggtgaggaggagctggaattgtctatggcaacagatatgcatggaaggagggaggattagaagcctgtgtagagcaagaggaaggcagtgaaaggaaggatcaaaaggttccacttttacatcaggcaatgggcagacattgcctgaggaacgttactcattttctctgatgtttcttcatctccgtactcttaaaaatttgtttttttttttctctgagatggagtttcactcttgttgcccaggctggagtgcaatggcgcgatctcagctcactgcaaccttggcctccaggattcaagcgattctcctgcctcagcctcctgagtagctgggattacaggcatacaccaccacgcccgactaattttgtatttttagtagagatggtttctccatgttggtcaggcttgtctcaaactcctgacctcaggtgatccacccacctcagcctcccaaagtgctgggattacaggcatgagccagtgcacctgccaaaaagattttttaattgacaaataataattgtacatatatatggggcacatagtgatgtaacatatataatgtatagtgatcagatcagggtaattagcatatctatcatctcaaatttttattatttctttgtattgggaacattcaatatcctccttgtagctatttatatgatatatgatataacatattattgttaacttcctattcttctaaagaaggattttttaaggttacttggccctgtgttcctccactgtccctattagaagtgtcatatatgggctgggtgtagtcccagcattttgggaggctgaggtgggtgaattgcttgagcccaggagttcaaggaccagcctgggcaacatagcaaaaccccaactctacaaaaagagaaaaattagccaggcatggtggcatgcacctgtagtcccacctactcaggaggctaaggtgggagaatcgcatgagcctgggaggttgaggctgcagtgagccaagattgcaccactgtggaggacagagcgagactccatgtcaaaaaaaaaaaaaaaaagagagagagagagagagttggaggagacttgactgattgagaccagggccatgatcccgccactgcactccagcctgtgtgacagaatgaaaccctgtctcacaaacaaaacaaattaaaaaaaaagtctcatgtatgttcgtggatttagttacaatctttttgcttcaatatcagtttctccagatctagctgctcatataaatttgtcctatttcttcaaacagggaaaaagtttcatttacataaatgtttcactatcaccac

SEQ ID NO: 278 - DNA, 89272 bp, Homo sapiens
aggtttccatttggacaattgaatggtgtggtgccagtctctgagacgcttctgaggctcccctggagcctggtaggacccaaagatgttagagaggctcctgaggcagcttgagatgggaaagtgtgacacagaaaattgtatttcctccactattgattagtttctgacttcccatgctgaggaaagcgtcaggggcaagagcaagtctgaatacagaactaaagcagttgagcacttagaaaagatgagtcacattggagaggtttagctcatacccttttcttcttaggacaagatgaaggacagtttgttgttgttgttgttgttttgtctttttgagagtgtctcactctgtcacccaggctggagtgcagtggtgcagtctcagctcaatgcaacctccgcctcccaggttcaagcagttctcgtgcctcagcctccccagtagctgagactacaggcgtgtgccaccacacctggctaatttttgtatttttagtagaggtttcaccatgttggccaagctggtctcgaactccttacctcaggtgatctgcccgcttggcctcccaaagtgctgggattacaggcgtgaaccaccgcaccaggccaggaacagttttttttttttttttttggagacgaaatctcgctctgtcgcccaggctggagttggagtgcagtggcgcctcggctcactgcaaactccgcctcctgggttcacctcattctcccacctctcccgagtagctgggactaaaggtgcctgccaccacgcctggctaattttgtttttgtatttttagtagagacaggatttcaccgtgttggccaggatggcctcgatctcctgacctcatgatctgccctccttggcctcccaaagtgctgggattacaggtgtgagccaccgtgcccagccaggaacagatattttaaaggcagacatgaagggcgtttttaaatgctgagcattctcaacataggggaaattggcagcagtgaggtaccttctcttcagccagataccacctttccccgggattcctccctatcaccccctaactttcaggcaaagaggcagaagggctgggccctttagctgcatctccaagcctcggttcacttacagtgagtttgtttgtttttgaatgggcaatatagtcatatggctgcgtattcaaaagatacaaaagccatacagggaaaagtctcccctttatctctgtccctttctaccatttcttgtgtatcatcttttgtctctgacttttatacaaatgataaaagtttgctgcaccttgctttctttcccacttgttaatacatcttagagatcatatcgagacaataagcttcttcattcttgtttataactgtatagcactgcattttatgtgtatatataatttcatagctccttactggtggctatttaggctgattccaatcttctgtttttacaaataatactgaaatgaaaaccttaaacatacagcattttggccatgtagggctatacctataaaattaatttttagaagtagaaggttctatatagagatttgttctgtttgttcttcgttcgttcaatatttgctgaatacctattatgtgccagatgctggtaggtaccaggaatacagcttccaacaagtcagatatgatccctgtcttcatggaatgttattacactcttgttggggaaaacatatccaggcaaacataataattacaaaattatgtacatgaggaaactaaaaaggggatcagatagagaaataggaaggagctactttaaatacagtcaggaagttgtcttaaaataagtgatacttaagctgagaactaaaggatgggatgcagacagccattaggggtaggacagggcaacctaagctgttcaaagcctacatccacagggagatagttcaggatttgtagaggaggggatggacaccaaaaaggggatggagataaagccaaagagatgaagttggcgattggaagtggaagatgtcaaagaaagtaggtggctaaggatgaggtcagttaggggaggaagctggtcatgaagagatgagaattagggagacaagcattttaaaggactagcgactatttgtgttgagagagctttggactgaatctctgtaactgggataattaggggaactagaaaagaggcgactccctccctagatactttgggaataaaagagacctctaacttatttgagagaggcacagccttgcccacaggcaggataatggattagaagccttaggtagagccagtctgtgcctgtagtgaagcctccttcatcttttctgttgctttgacaaaatggaaactttcaaaataaagatgacattcaaggggctcagccagctggctctgagctggcacaagagagagcaaaagcacaagagagagcaaacctaccaagggctaagggcttggggtgggcaggaaatcgggcttgaagaccctcctgaattttgtgctcctttttcatcctcaccacttctgcttcccttctgcaaaaagcccatctctgtgcccatcctgggtcctatgacttttctctccctcaacagtcggttcccgattctggtccccggcccccagcagcgcctgcccccttcccaccggggccccccatgatgccaccacccttcgtaagttttatgtctttccctgggcttggcttttccagcctgcacccccaactccccagcccctagccactgctgcatcaccagcacagttttcctgtaatgccccttttgctgaccttggaagagggatggttttacttgagcattgggttggggagagctgttgtgaagccctcagtacataacattgacaattccccctttgtctttttgaccttaggacacactggggctagaggtaggagaagtggaagggaaaagaccccattaatgtgagggcagggtgggactatctatctctttcactactccttacctatgctctttaaatatgccacagaattcgggctggaatggcattggtggtcatgagttggagagaaagggatgggaggcaggggactggggtacttgggtacctggatacctgccttctgccccttcatctgagaggcctctttgggggagaattgctgaagaggtggagccttccagtctcagtctggtgctgttaaacctcccttattcctttcctttcccgttacaattaagaagctgtgtgcttgcctgttagaccccagttgtcagtctttctcagtggtgaggagggaggcagtttcatgccttgtgcttctcaaactaaagccttggaattgcctcagagcagggtggagggttggggagggaggtggtggatatttcctgacaggtcctctctacctctgacaaggcgatgtcttccctgctcagtatctcttcctttactcatttccagatgccccctccagggatccccccaccctttcctccgatggggctaccccccatgagtcagagaccaccagctatcccccccatgccacctggcatcctgcccccaatgcttccaccaatgggggcgccaccaccactcacacaggtaattgtctctcctcccctggggcctcagaaaaccctgtcagtttagctgggggtggagataagagcgggcatgtaggcctcagaaactggggaaggaagggagctttgggccaaacccatgtggatttgtctgctgaatgactgagacaactctcaggcaaggtgagaggccagaatctggggattgcctgaggaagtgcccaagtgagggtcatggctccagtgagatgtctcaggaccctttgaggtaccctgtccctcctgttccagcccttaccttggtggttggtttctgtcttctttgtatccatagataccaggaatggtacctccgatgatgccaggaatgctgatgccagcggtgcctgtcaccgcagcggtaagcactaggggccagcaggtagcaggctctgccctgcagtcccgtgagtctgacttggaatgcaggactatgacctccattctttccctcttctcatcgcatccacccaggtccccggcagcactccccacactcaaatccttctcgccagccatgtactcagctcttctagtttcccactcatccccaaaggcatatacattctcttgttactcacgtgccttgtccagctcccttaaggagcacacttatcctcacagagccacacactgtggacacatgaatatagttcttcacatcctctttgtccccagaagagtcagtagcacctggggatcttgctgtgccttcttatgctatcgctcagtgtagcagagtctgggtaggatatagaatttggcatccactgtgaaggaatgagcctcgggagttgtctcaacaaaatactctcacttgaggagaacgaagaatggagctgctatgcgattctcccttgggatcccagagctatggccctgaagggtgggggaagcctgttagggagcagagatctctaggagcaggacacatggattctggcctggcctgcttctccatcccccatggcctgggtcctgggggccactgggcttggccccaacccttccccctcctctttcttcggcagacggctccgggtgcggacaccgccagctgtgagtcttctgggggcctgctccccccaggctcggaggttggggggcataggggagaggggaccgtggactggagcccaccctggatcatgcctgttgggatgccaaggagtctgggatattgatgggaccaggggactatttactggggctggaatacgggaggcataggtgggaataagatggaggtcggagcaaggacttagtatgtatcctttggcttttttctagctgctgtggctgggacaggccctccggtgagttcttccagctcaggggtctctgggtagaaagcctgagagtgggggactgatagttaaatctttggggtgaggagaggctttggaaaaggggccttgaccaccattctgtgcccccccccccacccagagggccctatggagtgagcatgtggccccagatgggcgcatctactactacaatgctgacgacaagcagtccgtgtgggagaagcccagcgtgctcaagtccaaggcagaggtcctgagctgggctttctggcccttcctttcagctgccctgacccttccaagtccttggccttcccttagtctctaaccatattcatgatggttcctctgatcccaaggtccctgaccattcctcaccctccctggaaatgcctccataggatctcaagaagtccaccttccccagtttgaaccaggccaggtggtagctaaaggttcctgtgtcctctactcactaggtccccttagctcccctgactggctggagaacttgcccatcccactgatggctcctatcccatccacttgcagctgctcctgtcccaatgtccctggaaagagtacaagtcggacacaggcaaaccttattactataacaaccagagtaaagagtcccgctggacccggcccaaggatctggatgacctagagggtgagatgtcctacgggtgggccaggtcaggagctctgggggctccctattgcccctgtgactgactgtgttatcttttcccatcacagttctagtcaaacaagaggctgcagggtgagtgacttgcccacctatccatttatagttggggcacctggagtgtggaagtagactctgtcgccatgatctctacactgtgggaggaagagccagctctgtctccttgtggagtcatcccctctggccccagtccttcccaggatagagaaaccagccagcccctgaagtcctccattcttgctctcctcctggacaccgcccttctggctcatctgcaggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcaggtgagggctgccccccatggcattcccaatgttggcctcagactcccagcctggttcaacccttgtcctctgctgggcctctctctcaggaggggtttgaagatctgggtgtgacctctgaagggcagaaaaaggctgccctggggaacaaggagggggtgatatgttgccaggagttcagggcactgaaagctgtgagagctgggggaccctgtggctgagtcccctgtgccctccagttctggacagcatcagccacagcaggaggaggaggaatcaaagccagaaccagagaggtctggcctcagttggagcaaccgggagaaggcaaagcaggcattcaaggaactgctgagggacaaggtgctggagtggggctcccagggaaggtttggagggggctggagcggggcaggccccatgactcccacctgcttcattccaggctgtcccctccaatgcctcatgggaacaggccatgaagatggtggtcaccgacccccgttacaggtaggcctgggcagagggagccaggccctgttcatgagagcagctgtgctagggactccctaaaaaaccccagctcaacactcagccctaagggaaccagagtcaggacagtgatagattgggttggggtgcaaggggaagaaaagctggagggcctccaggagaaggaaaggaaaggtatctgacacaacacgttcaataaatgcttcctgaattgaatcaaacggaattgaattaattggggaatgagggtgctggatagggtgacttgagaaccccaaaggaaaagggcccagtatttgcagtgtcttggagctgcatctcttcccctcacttcctgtcacccctacttctccatgaatggtgttcagatcccagacatctgtgcccttggagcccctgcagcctgcagtgtctcatgaccctccagtgtgggctgtgcagagtggttcgggtgacttctctatccccaccccactcctaccctctatcccagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggtcagggggccaggctgggctgggacttgggaaccctgagaacacaaaggtccagggtctctgttctctgtctacctactcacagcttatatgctccacaggcgggcagaacagacctttggggagctggaggtctgggctgtggtccctgagagggatcgaaaagaggtttatgatgatgtcctcttcttcctggccaagaaggagaaggtaatggtccctgggcagaatccttcagcccatctcatcctggactttccttgtctttgctttgttatggaccctcgccatttacttctctacttccccagtgtcccagcttctgacttggaagctggtatgggacttgcacatctcatttctgctctgggcctatagtcctgggtgtagcagggaggaggagtctctgagagatgggtctgtaacctgtactccctccccttccctgagacatgaaagtcttgagtatggccttcttcctagggttccctagctacctttccccaggtcctcctctgcccaggcctacttgggtagctctggcctgccctgcctcaccctgatcctgtggctccctaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagagtaagcctgggcctccaatcccagctatccctttccctttctttactggacctgggaccccagagtctgcctcaccccactcccctgtacctcctgccctcccggacaccctaggagtactcaacactcacccagtccttgtacctctttggactccggggataccagaatgtttcaggacacccctccctctggggtccactcttggcctagacattttgtgtccttggaggaagagctctgggataggaatcttaagtcctagagatgtcaatgatgattttagctcatgtgaatatggtcttaaagcatcatagaactacaggccttaattggtcacgttacaatagactgttgttggcctgtaattactgatgatactcaaattcactttctgaaattgcatcaaagcctgattgattcccagttccctaaggtgtgaaacctcagatcccaagacaaccggtttcatgttatggcttctaataactgaattcacaagagctgaatacttgcttatttattcttatacaattaatgatcccctcttaagaactaccattgcagtggctgctcccacagagccccctccaggcccttcccccaccaccctgggtatccctagcacctgtaggacagcatcgttgaaacattaggggtgctggggtctgagagggtatcctgctgggacaatgcccgcggaacctcctgcctgtctttagacatggacaaggaagatgcactgatctgttttgaggagcacatccgagctttggagagggaagaggaggaggaacgggagcgggcccggcttcgggagcgacgccaacaacgcaagaatcgggaggccttccaggtatctttgctgtcctttctagatcagagctcagctctgccctagagcacaacctcttcacccattccctgcccccttctggatacgctgcctgttctttctgtgcctagccctgtccaagctctatgagacctctctctgcctgcagtctgtttctgctgtacctcctcaattctggactgtgctcttctagggagactagatgtatgcaccacccagaaactgccagtagagagcaccctacaggcatgacttggcagctaggccatgtttatttcccttggtggggcacccgacaggcagagtttattccctcagcttgggggtggcagtggtggtggtagtgctaggggttactgcaggcaggtttctgtttctttgcatcccgggactggcttgttctcacctttttgttctgtccctctctgtgtatttactttctctctttttgcattgttctcagccttccatctgcatctcttcatctctgcctctcttgcctgcatttcctcaatcttgattgtccctgcctcttcctctgccattccctctcttccccctcagtctgtggctctgcctccctgtctcactctccctataactggcctctccctgctcagaccttcctggacgagctgcatgagacagggcagctgcactctatgtccacctggatggagctatatccagcagtcagcactgatgtccgctttgccaacatgctgggccagccgggtaaggcagccaggctcccccttctctggcctggcttcctgccctgccagcctctctgcaccccctactaccggctcctgtcctcggcccagcccccaggccttgggaagctgccgcccgccaggcccccctccctccctccttacaggctccacccctctggacttattcaagttctatgtggaggagttgaaggcacgattccatgatgaaaagaagatcattaaggacatccttaaggtgagggaggctggggttatggatggatacaggatggatgcagggcacactccctgcagaggactccctgataagtcctgttttgcagaagcattacagcttggttcagcagatatctactgtgatcctttactgcacactagggatacagtaatgaatacacaatttctaccacaggagctcatggtctaataggaagatatacatgagaactgttatacaaaggggcaagtgttattacagagacaggaatctgaagaactaacatttgaactgtgcatttagaaatttgtaggtggaagaggttggagtgtacacggggtactaagagcaaaggcaagggggtggaaagggcatgccaggtctgaggaggaagaagcatagctaattgtaaactggtagcacacagattgttctttctggcctgtacagtgttctgtaaaaatttggaatttgttgctaacattttaaaaccaggaaacttcacatagaaaatctgaatctttagcttctcttgtcaatatggattatctagcagtactgagctggatttgcaaggcattctgcagactcaagctgagatgccactttagaaagggcaagtcatccttctcaccattccttagtgccttcttgatactgtcgcaagtgtcagctgccatttaccatcacacatggcctgttgctcttcttctactggagaagagaaatagttctcaatatttacatcttatcaaaagtggaaaagtgagtgagtgatggactaaaccttgtgttccaaaagaaaaaaacaaagagcatatttctttatggaagtgaagattctaatgcatttgaggagataatacagtacagtggttaggagcgggactggaggcagactgcctacagtaaaagtctagcttaactgcttgctagttgtgtgaccttggataggtcacttgacctttctgaccctgtttcctcatctaaaaaatggtgagtgttccaccagagtacacctaattacagagattaaatggtacctgggttgaaagggatctggaaataaagctagaaatgtctcactgcatatacatttctttgaagtactgttttgccttacaaattcacgtaggtgttgcattttaacaccatattacctatttaatataaatttaatattttaaattacttaccattaggtaagatgtatcatactgtcctgaggtatcctctctttctctggaaccacatgccccagcttggaagtagagccctgcatgtaaagtgccttgaatgctaaaataagaaatttggatttttctctcgtaagtaatgaggaaccggggaatgatcagattagatggtgtatagtagaacctttcagtctagagtacgtacttatgtccttagggaaggtggtggtgctaggtagagcagttcttgaagcctcaagatactaaaactgatagtggtaattcaaatagtcatattcatttcacttatccccagacctctctcctactgttggggctacttggtacaaaagtccaagaagcactagatgctaggagctgggttagagggatggaagagggtgagcagggagaaaagtcagtaggctgtgcaggaatcttgtaggaggtgatcctagccgggggcagtggggacagcagaagagagcaggctgtagcgctccagctgttcttctgagacactctgggtttctatgtaggtgccttgagacaagcaagggttggagttgagtatggggggatttggtgctgcttcctgttttcaagtgaagcagcttgaatcttttttatgcataaaggttctacataagatttctattttaataaactgtttctgctgtttaaaaaaaaaagggagaattcaacaccagtgggatagagtcactaagtagaattgatagattttgtgaaatggagggaaaggaaggaatcagaggtgtcagggcagtggatgatggcactattgataaggataaaacaagaagagcaaggctgtagaaaataggaattctatttggggaattactctcaaagcaaatatattttaaaacagaataatcgtataaagtagaaatgccttatcctgggatagctaaattttattggacaattaacttttagccacagagtggctggttgataggcctgtaggggcctatcctcactgagtcctgtctctccacacaacctgagaaagcaacttttttagacagttcccttcctctttccccatttgggttcctgcctatggagggcagatgagcccaggagtccctcttgctttccacagccaggcagaccatgatggtgcctttcatcccataggataatgcaaagagccctggacttagaacaggcagacagatccgggtcagggagatccatggaggatgctcatgagaaatatattctcttgagatctgttgaattttaagtgtctgaaatatccagtctaggatgtttgaaaatcaggagagatgaaggatgagattgcgagggagtacagattgggtagtgaaagaggactaagtgctgttctcaggaacatgcatatgcaagagaataaaaggtcagagagggtgtgacctggagaggggagtgttgaagaagtaagtggtagaggcactgaggaccagatgagtgaggacaaagaaggcggccttggatttggctagtagacacaagcaacctttgggagagtagagtcatggaggtggcatgggggcagcacatgttttagagtcagattactcctggttgcttattggctctgagacctccgtaagttccgtgtctctgagcctgtttgctcacctgtaaatcagggataattcataggtaaggttgtgagaattaaataacatctgtaaagtgtctaataggttctcaataaatgtttattccttttcctttctgctgcatttcaagaggttttgaaacaatggaaaagagcagaggtagttagcttgatgaaggggagagcatggtggaaaggatgttccaggttaggtgaggtgtctgcttgatggaaggagccagtaacaagggtgacttggagctttcaattccctgagaatgaatgctgtgttgataaggactgtagcagggttgaggaagtacccttggaaagaagaaagaggagcacacctctgccatcagcaaaaaggccagaggaggtgagagctatgtggagggagagaaagggaatctggcctgtgcttaactgacgtgagagccagactttgaactccagtggcttcatttaccactcatgtcatcttgggccaactgagatcacttttctaagcctctgcttcactggaatgttgtgaggcctaaatgagaagcatagagcctggcctgtggacatgtttttagtattggtggggagctgcacacctggtggcctccgtttctcccatggactaagtcatctgggtgggtgtggtgcttgaaagcagacactttggggatagagagcccccccagggtagggttcttgcccagccgtatatcagctgtgagaccttgggcaagtgctctagtttctctgaaccttggtttctccttctgtgtaaaattaggatactaggacctattcttaaatgtagaaccaagaggattaaatgagataatgtgtgaaacactcatcatggtacctggtacatagtaagcactcaataaatagacccaaagggtaggggccagcaaatgttgattgagaatgcatggaagcactgctgagcagcaggagggcccagctggggccagagctttaagccaaaggaacaaaagttaattttgagaaactcagcattaatcagcagttgggagacatctcccaaccccttcagctctgtgtgacatccaaaccaagggtaggcatgggggcttaattgtcaagtgatgaggacttggataacttggtttctaatgcagaccacagtcctgtggatctcttccagaggcaagggccttcttgaccatctgtaatgtgaccactctgcctgccagctttggcctcaggcacgtggtgcccctgcttcatgcactgctgtacccacaggaccggggcttctgcgtggaggtgaacacggcctttgaggacttcgcccacgtcataagctttgacaagagggctgccgcactggacgcaggcaacatcaagctgaccttcaatagtgtgaggggctgggcggggcgtgggaagttctctaattcatctgtgtcttgctccattccttctcactcactgtcccactgactatattcccaattcaggggatggtggtagaagcccagaccctaactttccacctcctaaggtatgcctgagtgggacctggcatccaccctcctgggtgaccctgttccgtgtcccttctttcctcagctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtcaggagcgtagcctggccccaagcacccctcaagcctgagggcagcggtgcttcaccactgagggcccaccccagtcacgtcacagccctgggccagctccagttcccttcctttctctgccccagccctgccctgtgctcatggcggtgtccaggccaggctgagtggggcctagtctgatcagcagtgctctcctcgttcaaggtccgtgagcgttttgtgtgtgactcagcctttgagcagatcaccctggagtcggagcggatccggctcttccgggagttcctacaggtgctggaggtgaggcaggcttgtcctctggatctgcctcaggcccttgaactcattagaccagttcaacagagacctcagtggcctccctcttacccttagggcactcctggccagctaaggaaggggaggcctgaggatccctgggataggcagaaggctctagtctgagaaagggaggcaaagccagattttaggaagtaggatccttcctggggctaagtctggtgctgtcctcacccttcttcctctgcctctagcagactgaatgccagcacctccacaccaaaggccgaaagcatggcaggaaaggcaagaagcaccatcacaagcgttcccactcaccctcagtgagtaagcgtgtagaagggacatggggtgaagctgggttgttttggggaaataaacactttgttttccccttacaatatctcccttggagggaagtttgaggattcctttggccctgggtcctcctcctctctcgaattcccagacgagggcttctggagggcagagaacctctgcactgacatgtatctgctgatctgcccagggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcaggtaagcagttgctgtgagcgtagaagctggagaactgttgtcccagactgagaggatgccctccacaagccccagctcctttgagggtagactggattgggagggctgcacctgtggaagtagaaagaacttcctctacctgcccaagcaagaagctggagaaggaaaactggacttagacttcctcagagcatgaggttcctgcctgtgaagaatgaacagaggggctagaacaaagaaaaagagcctgtctttctcctgttgggacttagtagggatttttctatctctagatcatggccttcggaaagccaagaaaccaaaaaagaaaactaagaagagaagacacaagtcggtgagtgaaggaacttctacctaagcccctgctattttgtgagttctgttctacctgcctcccaggctatccacaggaactgaggaggtgggctctggactcttacagaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaaggtgaggggcaggggccctaggccagtcagcacgctggtcaagcttccacggcccttagtgcaggctaagggtgaactgtgcctttgctccaacagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaaaaaaaaaaaaaaaaaaccgtagctgaggaaagaaggtgaagagttggcacaccctttctccagccatctgcagagagtggttggtgcagagaagacctctgctcttctgcccaccttgacaaggacagtgtgagcctagaatgaaatgggcagagaaataagggcagtgagcctgacatctctcctcttacccttatcactagggcacagctggcacggcccatgcttcagagggccttgctcctggtaagagatgaactgagactggcagggtcccagggctccctaagcctagatacatctagaccagagctgaccatgggcctgcaaaaaggaagggaaaaaaaaagaaagaacagttgctctctcctctcatccctctgggctctagtgggagagatctatgtgccctgtttaggctaaggctggaaatggtttttcctagccctgagctgacccttggtgacccttcaggaaatgaagtcaaagaccttgggggcaaagtgcagtactggaagcaccagggacctacagacctagtgcccatagtggcacaagtagaaagatccagcctcaagagctggggcggacatggttgagagagcaacacagccctctcctgagcccttggccaattccaggtccactggttggacttgtaggactctgaggggtgaagtgcttctgcctccgagagggtctcagtgggggcctggagcccgagggggaccactgggcggtgcagcactcctggcttggtggcgaacaaccataggctggcagtggaggcctgtgggggaagagagagacctgtgaacaggatgggagggtgagccaggacagtgccctcaagagcagccccacaggtagggccagggaggagccagcagtgaggcagataaacaggaggcttagataaggcttgaggggtacccagttggggaaattgctggttggggagattgctgggctttgcatttcagaggatcaggttggggtgactagaggccactgggcagtggagagagacaaggtagatgcattcagaaagagccagaaactaggaaaagaccccaggctgactggacgtcaggaaacagatcaagggacatctgatacctcctggtcagaagctactaccagagctcttatgagaagagaaccgtagggaaaggttccttaggcctgggaatggaccctcaacctcagcctcaaagatcagaactgtaggtctggtcctgcctgctctggcctgttctcaacactggcctggtgactccctacccacttggtcttagtagaagccaggacagcattagtgggagagagaccacttccctaaggacacatgcaggggatatgccacacttctcagagcatggggcatgcaagaagtatgtgtccccattgctgggaggctgccagagggtgattgcaagtcatgcaggaaagaaggtgcctgtggtctcccagcaggaatcctgggagacgggcatgcagagggggcagctgcggtgcccagtacctgtcgggccccaaccttgggggctaacagtttgactcatcatggtgggctgcatcacagaagaagcgtgagccccgcttggcagtacgggccgtgaaagggacactcttcagcactgtggcccaggagagagacacagtggtcaggcctcatggggggtggggtgggaggagagcccaaaggggttaggttgagctttgggagctgggtgcaatggccaggccccagggagtgaaaagggccccacctgtgatgatgtcctcgatggtaccatccttcccctcataaacaggccggtgttccttggcctggcgccgcctcaactctgctattaactcctgctgttgccacttgttccgctgggatggggtctagggccaagaatgtggaggggaaggaagtcatcactaacctaatgtgggactggttcctgccccaaggtgcagtctgaggatgccactgcttgtgcactgctaggaatccccaaaggccctccctccatccctctggatgccagcccactggccctctgggtggtctgtccactccaagttttcatctcctctagccttctgacccccagcccccactcttttgccttgtcgtcctccaggccccagctcttggtcccacccaccttggcatccagtttcttggcttcctgagccagctgcttctcccgcattacctcctcctgcttcttgcgggcttcattctcttgttctgcttcctaagagccatggaagatggggggtggggagtgaggctcataggctgtgaggggaggggctgacactgaggtggagagtgggtggcagtgggacccgctaactccaggtggccaccctctggaggggcacttcctgccccaaacaatgacaggaaggtcctgggccccaccctgcccaccagttcacagctaagaggcctgtcaccagcttgcatcgctcccttcccaggactcggaggaggagtcggaaaaggcccatactttaagcccaggcttctctcccccagccagttttctcgcaaccaaacttcttaaaaagctctctgcagcttaccttgtaagaacgaatgaatcggacaaatactgggaagaatacagaaggaggtgtagtcttgggactctcgccaaagtagcgcacaactgcattgtaggcctcctggggaaggggtgggcagaatgggtcaccctggcaggaagatcagcccagctcccacaccacggatgagaggcctgcagaaagcagagcccagggccaaagggaggaaaaccaagcacccaggcccctgtgagctggagggaacctggggctcccaaagctcctgagtatgagtctccagaggcagctgcctggcactcccaaagcgctctctctcccctacatgtctccagaggcagctgcctggcactcccaaagcgctctctctcccctacatgtagccagccagctgcttgatttaaaaaaaaaaaaaaatagaactagggccacctagaggggcctggtgccttggccctggttgctcccaccgcctgcaccccgtgcttgcctcagccgtcttggcgtcccgctggagcttgtctagtttgccttcattggtactgaggaagttccggaggacgctgttgtcatggatgctgcactcacgccgaatcagctccatgccccggcccagctccttcacgtccagcagcacgttctccagggacactggtcaccaaaagcctggctgaggaatgcctagggcctggcatgctcacctcccagcccagagctatatcaaactctggccctccccctcagcatgggctcactcaggttcacatacctgtatggacataaggaagtacacaccaagctagctgatccctcacagggggagggaatggaatggaaactgagcttgtgaccccaaagaacacagtagcaaaggcaggcaagccacagagactgctggtctccaaaatgaaactgcctcaggcctgccctagggttcatgggtggggcagaaataacagctacctcatgtctatagagagctttatgatttttttctaagcacttcacatacatcatacacaaaacacaagacctctggggccagcttgagggagttgggagtaaagagcgactgctccccttcttgttcctgctcccactgtacctagctgggaagggctgggctgggccaggcctggcgcctggaggaaggctccctctggagtggcccctgcttaaggctccagcggaaagctttgaagtggtcagaaagaagataacaaaagccagaaacaaatggacccaagtgttctctctcctcatagcttcctgggattgtcctgggctggatgtgagggcaggcccacccagccaggctctcctcacctgctgcagccttctcaacaaagtgcagctcatgccagaagttagccaggtctgggtatttctccttcactgtcaaggcgatgaaatgaagcagtgtcatcttccggtcagtggacttggtatccagcagctaggagagggggtgagggcggtgcacaagagctaagcactctggctccacaactgctgccccccaggcttcctggcccacgctgccctcaccatcttaccagatccaggctctggagcttgaagccatacacagctccccgcttgctgctgttcatgtagttccccagtgcaagtatgatctgtccaaagaatgtgtgggaggcaggtcaggctcaggtcctgaaggctccttcttcctctctgtatagccccaggcccccacctaggacctgaaaacccccagcacccctgttcacaacctcttcccacctccaacatctgcttcagcttctgtgaagacttgacggaagcggacgccgcaatgatggcattgagttgctgtaggacaatatgaacactgaagtaaccccaggctgagatggggtaaagacagggaggggtcagaaggactggaagggcaggggaggtgactagcagatggagggtggagggacagctgtccagagccatgagttgggtgggggctgtaccggtgtgagcatctgcaggttatcctggaagttccccaggaaggccatgccagccattcgctgggtcaaccgttccaccttgctgaagagcagcatgaagcggtcctcagctgccaactcctccaggggctgccgctcccgctcatattgccgcagcagctttacctcagcctctgtgggcaggaagcgcatcaggcactccacgaagtccacaggtagtgtctgcaagtcaaacctgtggaggagggagggaccacctcagttctcacatctctccacgttttccctcatcccttttattctccaagctcctagaagaactggacaggggactgtacacggaacacagccaaaggcaaaggacccattgcatcatctgtcacagcaccagcaatgatcccgggggaacactccatgctcctgtttaataagccctttgatgtactcccactgtacctagggtgaagtccaaacacctgagcatggcttacgaggtccagcctgcaagacttctgcccaactctctaccttctcctgctcctctccctacactaaagccagattcaatttttagtacccaaggcactatgcttctccctccaggccctgaactggactaactcatatcttttcttcaggtcccagttgagacattacctcctctgggaaggcttccctcattcatcaccaagctcagctacatgaacctccctattctcccaaagctgcctgtatacttctaccatcctggtggtatcactcagtgttactgcactgttcccaatagactgagagctccttgggtgaaggtctgggctgaactgccagcacagatgcagtaaattctagccaagccagtggatgactagggggatgtgagggagttctgtcagatgacctggaatctagggaaacccaggctcctgggtggagaactgggttgccaacagactagggaccagagccaggtcagtgggagcctcacgtatgaatggccctgcagatctcctcagccgagcggccagccttgcgtagggtgatggccaggttcttggcacgattggcttccaacagagtcaccttgctggcagctttttgcgctgtcttgtttttggagcagatgaggtcaagggcagggccctgcgcttttgtcttgaataattcttcaaacttatcaagatccaggtcctggcaggaataggtgagcaaggaaaacgctgtagcctcatactagtggaggacctcatgacagcccacccagcattggcccagagctctgtcactctggaatatttcctgaatacaaacacaaagtgttgacacaactagaaatatacgtacactcaagaatgaagggttggtggagctaagcctggcctcaccctgtctgatggcttttctaagaccagaatctcctcaaaaggcaaccaggtccctagccctcaaccttagccctctggaccccaggccctgttacctccaagatcttctcatcatcaagttcgctgaagacagtgccactgatctggttgggtttcagtgctgtccagttgaagacaggcagccggaacttggtcttgataggtttcttaattcgaatggctaatttggaaggaggatcagtgacacaggggccaaggacacacacccctggtcccaccagccctgcccagagccctggggatactcacctgacaggcccactgtcaacaccacagagggtgcagcaccagggagaggtggggctgggggacacttgtctgggggaagaagaaatgacacagtgacccaggcgtcaagagactcttcataggcttccctcccctctgcctgtcccaccttctctgagagttaaaaaaaaaaaaaactctcagagaaggagcctacatgaactctgctcaagctgctcccagaaatctaactctgacagggcagttgttgctggtctctgacccagtttctatggctacagtctaagcctctccttggctgtcttcaaaggaattgggagcaacatctttatgatccttaaaacaggtccacatctgcctttgggcatccctgtgctgataacttgagcttccctcagattccaggcctccctcaccctgattttatatccctccaagtcctcagataatgccattttcccagcttctccctgaggaagacactgctgactacagttttggtccccacaaagaggctgcccctgttggctcccaggggtcgtcgtggttacctggtaatgggggaggtggagggggcaagggcggagctggtggtggaggaagaggcaggacctcctcagggggtggggctggagccagaaggtccaggtcggagggtggcatgccctcactcagctctgcagggcctactctggccagggcctcactgtccacagactccaggccccggacatttggctccaaatgacatcgacgctgaaaggcctcctccttctctttaatgagcctccgcagggtgtgcacctggtggcttgtgttctcatatgtctcctggcaggcagacagcaccattaagggaaaagtgggctgaaggcatagtcattgccccaagagtgagaattcctacccagggttctcttaacgagggtctctgtcagggtactcagaggctcagagtggcagaaacccaggtgggggaatgaggaagctggaaggcagcaaaacaaaagaggcaagcagaagctgcctccctccgctggcaccctgaagtgtcctctctgctccagccaattctcactgcatgggcccctcaaagcccaggaaaaaaggttgcccctgtgaaactctccttaatctaccaccggtctgacatagcggctctctccataaccctttgggcctcattttgctttaatttcacttggccttgtataatggctcaattggaagccccctataaacaagaccctgtcttaaccatctctgtatcctccatagctcccaatacaatgctcagcagaagctgggcagatacatattgagctcaacagagccagcatatattcttctgaaagagaaagtaggatgggggcatgactttataatgaacaaaaagtcaggagaaaatacagaagagaatgaaatatgaagagtacctgccctgccaatttaggatacctggtggacatcctaatacacagagcacttggtcactctgcccctgctcattaaacatggctgggggaggaacacgggggtagaggggagaaaaatcaatgggatgggctggtaggaggaggcctgggttggaactccagaatgcttgtgggtgccccagctgttcccaccctcttatgtgtgtgtctggctcacactggccccacctttcctctccaactaaaaaaatggggtgaaatcatcagcccacccacacctgagtacctcaagggtgaatcaagatctaaatcctagagaacttgatatgactcagggaaaaaaagcagaaccccaaggcgctggagcccaggatcagtcagggactgccttccccagagtacttgtaccttgatgctctctagttccttctcccgctgtagcagctgcttctctagttctgccacccgcatcatgttttcattctctaggtccagaagcttctctgtgagctgcacaacaggaagggcaggttctgtgctggccctaaagcctgggcactcagcacagcctgaaccctagtcaagacctgagtcggacccctcaacacaaggccacaaaggcagcttagtcaggtggttcccttatattccaataacagatacaagacaaaggccacattctgactgtctcaagaccaatgccacctcatgcccagccctggaggtcgatgtgtattccaactggtggatgatccagtggctcaggcctgagtatgctcttgagagccctggtgggttctaaagcctccctgggactcaatctggaggcaaatgggtcagctcaggattcctggttacttgagcttccatcaacagtggctctggcaggcaaaggaagaccacctacatgggacacatgctcctccaactcctccaccttctccagggctacattcttggtctcagcatcctccaacaaacccccgacatcaaacacgttgtccagatatgcctgaatctgcacctgcagcttctcgctctctgtgtgccttgacttctgggggaagagcagagagtaggagtagttgtaggagcaggcagatcatcaggggaactttctgagaaagtcttagtcctcatcccccttcgccaccacttcccaaagagttcctgctgcaggccatgtcagattctcgcccccatggagctgcctgactggggagttagctgcagaggtcctgagtcccaggctacagaagacaggcagggtcccaggagcatcaaggattaggcacttataaaagaaaaatcatttgtgatacggctaaactgatcccaaagcacctcaccttacaaggaccccagccagctcacctgcaggaactcctctagccccagcttggtaaactcatactgcaggtggacccggaagttcatgtcctccaccgagtgcaccacgatgttgatgaactgcatgcaggccacctgaagaagaggaggcccagagaagcagcaacaggaagggcagaggaaaggcaagagaccaggaggataggcggctgttagaatatcatcatcatgtggataattacagggagtcaattaaagagttaagtctttatgggggcaataagagtattttaattttaaaaatgtcatttaatattcagtgtataaagacaagtaaattacatgaaaaacagatgtaagtgaagatatagctatctgatttcctttgtacatcaacaggtattcctcgagacaaccttacctagccaaagaccctgcagtgaggggaagagaagctagaggaagagcttaggaaagggagggcagctcaaaaaggatccaattcaaggacaaaaaggccacagaaaagaggaaaaggaggtagatctgatatacacaaatgatatcctgaagtttctaagagctctctggggtaggcaggtggacaagaagcatttgctgaatagaatcattctgggctctacgtggaatatcaagatacgctgttggcctcacccctgttgtcaaggaacacacacacagccctggtgggtatgtgctggacccaggcccagttcctcaccatgaagtcaatattgctgtcctcattccggaaatactccatcagcttctcaaagcggtgcagctccttgcatacctgaatgagcaaactttctcagtgaaaggatctgctccatgcagaacccaagcccctgcgctctggctcctaggaacatcatggcaaaggactggttcagaccaagcttaaccacagctctatatatgaaataggccattctggacactataaaagaaaacctggggccaggcgcggtggctcacacctataatcccagcactttgggaggccgagatgggcacatcacctgaggttaggagttcaagaacagcctgggcaacatggtgaaaccccatctctactcaaaatacaaaaattagccgggcatggtggcacatgcctgtagtcccagctacttgggaggcagaggcagaagaatcgcttgaacctgggaggtggaagttgcagtgagctgagattgtgccactgcactccagcctggccacagagtgagactccatctcaaaaaagaaaataaagaaaactgggacctgcaatctggctctgggtctgtggtcccccaccaaattgctgagggaattcagtaaagcctgtgcccttaagctgggctttaggtgcctctggggataggccaagaagaaacataggggtctgatgctgccaagttactaaaggaaggagggaaagaaggaggaagggaggaaggccatgcctgagacaggaggctgcagtcctagtggggatgcaggggaagggccagtgtacaggaaagccctctctgagaggggtctagaggctcctctgagcctctgggcttcaaggaggaagagccatttcctggcttgaacaatggatgctagggaagaggtccaaagaagaggaaggggtgggaccaccagctgtggctggatgtcgaagaatcctatgttcaagtagataggggtttcagaggcaggcccaggggctgggggaaattccacacaggagttccttctcccctcaccaataacagccaacaaatcaggagacatccttgcttaccttctcctcccatttcaaaacacatgtgctttgggttctaccaatgggttcaccgcatcagactcccatctggggagtcacttaagtacatatactcaggcctccagtgggtctgaactagagcacagggatctgtacttttaacaagctccttaggtgatttggatgcagggcccaactaggaccattggactatagccctcagctagctgagggtatctttagctggccaatcaggaggtttcctggcctgaagatctagtaagactaaagttctggttttaaaaatactgggagttcaggagagaggctgcttggccaagcattgggatgttaaaaatcattgcagatcacaggaaatggtgcttaccaacctagctccctgccttctcccccgcaaacacacacacacacacgcgaagcgaaaagactgacctctttgaaattgtcaaaggcagcaaggatgatttcgtgacctcctcgcaccaaacacacagctgccagaagctctaagacaagggctttggtcctaaggggtgaagaaggaagattaacaccctaactccccatcctgacaaccacacagctcatttccctgactgggtaagtccttttggagagtggagaaagcctcagtggtgaggagagagggtgggagaaagagggcttgctcccttactaagctgtgtagaccagaggagagccagggacacttctcttccagcagaggagggggccaaaccaaggctcttgacaggactccaaggccaggcagaacttgtcaggaatacatggagtacagatctccagagccctggacagagtggggaggaaaggggagggaaggaactcaccttggattcttgttattgaggctaagtgcaatctcattgacagcatgggggtgggacatgaccaggttgaatccgtactgcaagggaaaggacagaaggaggggaccttgatggtggggaagggggagcccagccaatctccttgaccgtaggcccaccagcaaacctgtcttttataagctgatgccctcctagctctcctggttttgcagatgaggcagaagaagtagagcacctatggctagtgcttcccccttacctgatagttcatgatggctctgagacaaaggatacagacgtggacgtcatccttctggctcactaggcgggagttcttcagggccctgcgcccagggagagtgctatacctggggagatgggccaggcagtcaggtgggagctgaggctgccagtgaagcatctagggacactcaccatcacccggacagcaggctgccccttagcagtggcaaaaaatagggaatagcacctcgtaccaacagccaagagggacagggtgcaggaggcagggtggtcagcctgttttcacctccttaaacaggcctttgtcagcaactattcaggatcccggttttataaccagtgccccaaccctagagatccttcaaaatacaaatagtagttgtgtaggccttcctagtccctgagatggctccagagacacagtcatttgagcattccctccacccacttccagttgctgcaccttctgcacaatctgtgggacaagagcgtcatggctcccatcccacttctgtatcacagaaaaggcagagctgacccctaaaggcttcagctgggccacagggctatgtctggctttgcaccacccctccaccctctcagtgatgtttcatggaaaagggaggagacacatacagtatctgctcatccatgacaagaataatcaacagtgtccaagggacacaacccaaaggagactaggaggaaagcatggccacaagagagacagaaaccaaggaaagggccatgggacccaaaggaaagcctcccagagtaggaaggggctctgagaagtcatccagtccatccgcctacctccaggcagggcggctcttaagacaccgcagacaaatgagcatgtggcagcctcagagagaaaggcctgaaggaagaggtgaagggaatgcaaggggcagccaggttgggtgggagctggtctccaagcagctaaaggggcagagtgaagaactagagggaaacagaatgagagtaggagctggatcacccagtgaaggccatggacctgtatgagatgtgccctgctcaagagacccaggaggaatggcagagtgagaggaatgaagggctcccccagagaggggtgaggaatggggagagctggaaccccacgttgggtaagtgcagctgagaccatgtacttacccaggacagaccgctgggcagagtcaaggagacagagaagacagaccagagacagactggcaggcagagggcaagagagctgagcctggaagcaagagtggagggaggagcatgagcactcactgctgaacccgagacctgcactgaagggtagggtgggaggcaggtgggcagagcaaaagcacacataccggagcacagactggcgcgcagagcgagcgaggctgttggtgaagggggccgacagggcgctgggtggctgcaggtcctcgattgacctgctccaggaccggagtttgtcaaatgcaccatcgtcaccactttccagaccctcaaagtcaaacctggagcatgaaaggacacacatgcgcatacacaggcacatacacaggagaaattcagtgccaaggccccccgtgagcccacccccacccttcaggcctctagggcaacaagcagcaggggtagcaaggagagaaagcagaactggggagcagagacctgatcctagctggaagagccactaacacagaacagcggcagaagcagcacaggcagcaacaaggagggcagtctaaggagatgggaagctgatggaggccaactcctctgctccccactagccaggaaattccagaaggagtgtcctccccatgggccactcgggagctggcagtctttctgcactcccagcttagttgggacatctccgggaagctgtggctccccatgaagaatctgccccatagagggaatggtggggaatgagccaactgcaggtcttgctagctggcaaatgccagcaaccaaagggcccttcagtgctttgaaggagtccagttgattctggatggcaggactaaatggaagggaaagggggttctggcaaacccagagtgggacagtcctttattgtttggaggagcaccactgccccatcttagcactgggttttaatgaccaggttctctatggttctggctacttgaggtttctaggtttttcaggtatacaggctccctgggcttcagtttccctgggggaagaaattacaagttgagattgtagaccagggtcctgtagtatagcctctgcaggagttgaatggtttgtcactttctgctcctggaacagatgtcttccaccatcagcaattattattattattattttttaaagagacagggtctcactctgtggcccaggctggaatacagtggcacagtcatggctcactgtaacctctaactcctgggcttaagcaatcctccagcctcagcctcccgagtagctgggactacaggtgcgtgccaccatgcctggctaattttttaaaattttcttgtagagatggagtcttgctatgttacccagtctggtcttaaaactcctgggctcaagcaatctctcatcttggcctcccaaagctctgggattacatgtgtgagccactgcacccagcgaccgtcagcagtttgtcaatgtggccaggacaaggaagatggccaagatcacaaactcacagggactcctctcttatcatcctcacttcaggatatacccctctgagaaacagtccctctcctccttcttgtcctcttcctccatgtaggtcattaaagactaagggagcatctcttacaggttcttctcccccaagaagcattctgctcagacatggggtcaaaggcacagaggttgaggctttctggaataggaagggatatttacagacgtcagaatgttccaaaggaagtgggagcaggctttagtgtcctcatgatcaggaggtgtttaatggggctctcaagtagacatcagaggaacctcctgacagggaaacagcttgctgattccatcagtaacactgtatcctcttgtactggtatatgcagtttacaaacaattatcttcactccaactctatttagcctcaccctttccctctcaatccttcctaaaacacacattctctcccccacacaaagtccttcttttttaaaaacagagtcaaaggtattgccatggacactacaatactgaggttccagggtactcttggtttagggtggctggaatttgtttgcttttcaagtaagagagagaggcttatttggaaaaatgagctacattttttactataaaagctctgaattttttaagaaaaattatttcaccaaatgtttttcatttctttctataaaaagaattttttttaggagataagagaatcacacgaggtatgacttctgctgagacaagaatgcagtgggccactcttggttttaacaggataacctggaaaaggtgagaggcgccgaacatagaagaagcatcaaattcctaaggggatgacactgaagacctgctggacaaagaagaatggccaagggggcaaggacagtagttagaaaagtggaagctggttgggagcagcggctcacgcctgcaatcccagcactttggaaggccaaagcagggtggatcgcttgagcccaggagttcgaggccagcctgggcagcatggtgaaaccccgtccctactaaaaacacacaaaaagttagctaagcatggtggtatacacctgtggtcccagctactcagcaaggctgaggcaggactgaggcaggaagactgcttgagcccaggaagtcaagcctgtggtgagccaagatcgtgccactgcactccagcctgggcaactgagcaagaccctgtctcaaaaaaatgtcagggctaagtcctaggatggaggagtttcctgggacgctggggaaaactagggaaagttatgggcaaactgggaagattggtctccctaaggctgacctgtcttaggtgtaagtctaaatgtgttggtcattatgtttattatgtaatttcatatattcaggtaattgtggtagggtatgccactttaaataataataatgaaattaacaatagatctgctaccacaatacagacccggtatgttccaaataatactaagtgctttaacacacgttatcatctaattttcacaacaaccctggaatgtggatctcctttcatagaagaagacacaaacttgctttgaagtcacacagatagtaaataacagaactgaaacccaaacccagctttgtctgactcaagagctctcattccttccactataccaggccgccttttctgtgctaactcacttctggctgcctccaagcccccctgcctgctagaaaaagactcctgaatacttcatttttctatccaggtcaaaaggaactcactgttcctgggttcttcaacaatgacctggagtaaccttctcacatctggaaacccaaagttgcttctggaagactcaactctgcaaagatgaatggatcccaccaaggcatctctaccagaagccaggacatttccctggattgctcacagcttggcatttggatgccttgggttctgattccaagctccctttccatctctctgtcctgttctccaaaatgcatcttatcttctactccagccaagtgccattcttcactgatccccagacatctccgggcttgcctgcctacttccacaccactgcttgggctactccttcctgtccaggattcccatttccatcttcattgttgaactctcacccttccttatcaaagtagaatggaactatgtcctcccccaactggtccccaacttcagccccggggtggtactcacatgacagaacactgggcaaaggacaggtaatccaccagtacatccaggcctttgttttcatcattcagaaattcccgcacccacctgcagataaaggaaacacagtggaaggggtctgctaaaagtgggtcaaggatgaggggggtgacatgcctctgacccaacacctcctcctcctggaacccagcaccaggctaagaaaattctgaagatcaaaacccatgacagacccatccacggtcatggacttcccctaggcagggaagtcagggatggggaaagttcaggcccttctaatgccacttgctttatcgtgaaggtgcttcagacaaacaagctctcaggtactccctccttaagggccagaccctggctcaattattttctgcatccctccacatgtccttgctcagtgtttgttggaagaatttaggaagcatcaagagcatttactacaggcccgtgtgcagagttgtgcttgaccgaagccagcaagtctccaacttgactgaagcctcagtcaagaccccagcaggaagggtcaaggagagctctggaacagaggcatcctggggcaaagcactctctactaagtttaaggagaggagttttagaaagcagtgagcagagatgtatagaagttctgtatttagtcatgttgagtttggcagaaccagaaaaagcatgggagatgaacaggaactcaaggaactccaggatgtctatgaccactcagagtcaacctgagtacgtgggtccccctcagccaggaaggtagacaacaaagcacctaaggaccatatcccagggcattattttcccttctgctttcagttcttttgggctgagatattcctggaatgaaagtcaagggcaaatctagggaactgttatatgacaggttcattccatagcagaaacataaaacgctcaggatgaaaccctaatctagagtgctctactccttcagaatttctgggggtctttataggaaagctcctcccaaactgccctgcggggcctttctccccaacagctggaaaaccagtgccatgttggccagccacaccccaaactacagagagactctggagctacaacaccaggcccagctgagattaggcagcaggctctggctgaagctgactgacaccggagctgcctgaagttagcttcctctctgggggccaacaggcctcccgtttcctgtctgtctgctctccagctccccacccccttctcatttcctgtctgagtctatactgctatttcgggatcttgacactttgaggagaggttaaagggtgcttaggcaaggcacagaaaccaatacaaaccagggaaagaggagctggagaggctctggaatcccacttcccagcctatccctctccagaacctgagttcccatctgctgctcctgcacacccaacttctgcaagccctggggctgatcaggctgtgaccaaagcaggatcctcctctccccaccttgccctgggttcctgccaccctgaagcacccacaatctgacaaactcttcctgcccagaaatccaggaaggatcttggtccttccacataactctacccagagaagccgcagttcagatggcaggcatgcctaaaatgccaggcactgagctattccctgggaacaaaggaccaggtccaggacctctaacttgtgtgccaactgccaagaggccccaggcctgggaaccacgctgctttggacatagctcctggccagcagccagaggggcaggcaccaggtagagggggcaggcagcagggactatcataaactgctctgtggccttctcccaataaaagcacacccctatcctcagatgactacagcaagacttaatcaagaaaacaaggctaggtactagtggctccactttgggatcctcaaggaggatcacttgagcctaggagttcaagaccagcctaggcaactatctctactaaatttttttttttaagtggccaggcaggccaggcacggtggctcacatctgtaatcccagcactttgaaaggccaagacaggcagatcacttgagcccatgagtttgagaccgcctgaccaacatggtgaaacctcatctctactaaaaatacaaaaattagctgggcgtggtggtacacgcctgtagtcccagctattcggaaggcagaggcagaatggcttgagcctgggaggcagaggttgcagtgagccaagatggcgcctgggcgacagagctagactccatctcaaaatataaataaataaataaaataaaatggccaggcatgggtgtgtgcctgtgctcccagctacttgggaggctgggataggaggatcacttgagccctggaagttgaggctgcagtgagtcatgatcatgtcactgtactttatcctgggcaacagagcaagaccctgtcttaaaaaacaaataaacaaaaagaagacagaagggctgagagggacagaagggacctatggaggaatgcggagtggtagggggctcagggtggcaggtagcactcagggttgccatcggtgtccttcttgccctcacacacaggggtactaagcagcccctgccactttgtccttcagtcagtgaagtcagtgaaggactgaccaaacaaaggaagaggcttggccacacctttctcagcagcttgactttcaatgtctgattcacagatgaggtacagaagccatactctggccaccagagcacagttactgaggccaggaaccatccctttcctgttctctcctgtgctgtttcccttgtgattgctgctacagctggctacacacaggtgtcccctccctctaaagaatcctgggaaggcttgccctgggggcggatgagggctgctgctacaacaggaggggaaaggctaatgatgtcatttggctgtctctaaccccctgtcaggaagcctgggcaccccacccccacctgggcctccactgctcactcataagcactggacatttgtgccaggccctcccatcaggtctatacccctgcctgcagttctacatcacgtgtccctcactgtccttttgcataagcacacatacgcacacatatacacactttctctctctctctctcactttcatatacctttgcatatacctttgctgattacagtttcgtaacactgaggccaataccctctttcactgtaccttacacattagctctttgcttgttcagcaattcctggtttcccactcagggactggaaaaaaaaaaaaaagactcacacagttcctaagggccctatcaatgtgttggggacaccagggtctgtgaatatagaaaacattcagctcctgcccccagtgccttacatctttcctggtgcttaaggaagcttctgctcatgaactaagattatcttctcccaaacaagcaaataaacttccaggcaccaaaaagtccaaatagtcaccgaatgggaactaggtctcagctacccaatatagtatgttctccccaccctcagccttctctgagcctcgcttggcccagcaccaggccacaggcagactccagtctcaactgctgtgggaatgtcttccactcaaagccacaggcagaggaccccaggagaggcctcaagcttgccagaaacatctagtcagcagctggcagagctgagggggtagaaaagccagtaaagaaccagtccaaagctctggggagccagaagccattcaaggggcaactctgccccatggcagggaagatgaacaggaacaccatcctcagaggacaccagaccctgtgtgcccagccagcagcctggggccagatgaagaggctatacggccaatccaactcacccaatgtggttggtgcgaagagagatctccagctcccttagtactttggttgactcctgcaccctcctcctgaacttctgtaaaaagggtaggaaaggaagggaatacaagagggcagttatagactttccctccattactggccagccattccaggcccttggccacagaaccctgaaatccaactcccaatgctcagaaacagatgtccaatatccaagtcaaagggtttgcccccaaaccccacaggactataaagggtggcaagacggggactctctgcctcatacttcaccttccgagttacactggggtccaagaagctctggagtttctgaatgtaagtgtggggaggattcttcacctggaatcgttcctgtaagggaaacatgcatatgcgtatccacaaagacaaccagagacctgaggagggcactgaggaagaagagcattcatagtgttcagtgtgagggggactcagcctctccaagttgtcacctggctctagatatcacctaaacttgaggttcccttccttgacttatccccaggtgttaccacctgttgccatctcctcctcctccaattagtgctccctgagcctaaaatgtttttctatgtcaaaaagtattttaaaagtgtgctgcttgctacaaagatgttggggattacagagttgtgaacagcacccaaaataaagatataattgattgcgcttgggaggtcgaggcagggggactgcttgaggccaggagtttgagaatagtctggataacataggaagactctgtctctacaaaaaaaactttaaaaaattagccaggcatggtggctaccacatgcctgtagccctggctacttaggctgaggtgggaggatcccttgagccccggagtttgaggctacagtaagatatgatcatgccattgcactccagcctgggcaacagagtgtgatccctctctaaaaaaaaaattaaaaaaagatatgattgggaaatgctgttcactgcctggccaactaatggatatgggttaggaaggccaaggggagaggagcttggctttgtagaatccaactttctcagcaatgaactctgcagttgggactggaatggttttgctgagctgacacagctcagggctgcaaacactgctccttgcccagactcccaacaatccaaagcaacctcaaatactgaaggctgcattcagcaaggtcatccctcgattcccttctacctaggacctgggaccacgtcctactttaggccaaccccttcatctgacccaaaaagaaactcagggagtaccccttagcattctggtcctattagagctgccaccaccaagatatctgaagagctggtgggtggaggggctgaaaaatgtccaggagaatgatataatgttagagagtaggacctaaaaacaaatcaaagaaaaaaacgaaaggtgtgagaaacagctgaaattatctgacctaggaaagactgagagatcaattaaagaccctcaatatcaaagggttactgttctccaaaccccaagcaggtgctaaccaactcctcttaatgcagaacacaaggatatggacctttgttggagaagggacttggactaagatctctgaagcatactactagcttacgtcaagcagcatgacctggggaggcagtggaacagaacagttaacacagacttggcatctgcttgcctgagctcagccctggcttcatcacctactagcattaggcaagttactgagccttgggttcttcatctataaaatgccaacactgccttcctcagagggttctgtgatgattaaatgagatacttcagtgtgttgagtacttggtccataacaagcactcaataaatgttacctattattatttcacccagagcctgaaaagaaataataaaattgtacatggcaaagtgctgggtaaacacactacccacactgccagatacttccatctctaccaagatgtaaaaaggtaaaagccaactctcccagccctgcatacagtcctgtctcatttcacagactcgtgactcatgatcttcaaatgcatgcaagggaaagagccaggtcatatgtgttagaagactctcaactctgagcaaagtaatgatttctattctcttccagctctcaacactgttcatgcagagagagtttccagaccttgactcttctgagatttgggaacaaaagactagagtctggggcttctcattcctagaggccctgagataatgagaaagaccctgctatttgccagggctaagacagagtgagagatcaacagtcctttgagcaccctaccgggcatagccctgaacctgcacagccaatcctatacccctgatctacacaaatccccttatactattgcccattggaagaaatcaagacagctctttgtgggagctagaggggaacttggcctgccagctctgtctctgttatgagaatcctcttggaaaagaaagtgaacacagatgaggccaagcttaggccagggttcctcaaggaacccaaggctgcactcaatgcctttggccccacagccttagccagcccaagacacaactccctacctccctcctctttcccaaaccccatacctggtcacagatcagatcccatttcttctcattgtcatactgccgcaggagccgggccttgtctggaggcaggttcatggagctctgaggagagaacctgagtcaacaaggctgaaacctcccctcatctggaaaagagaaagactagactgcccacacctttctgctactgggccctcagacttcaccctgacactccatcgctgataaggcaggcttggaaaggtagaacagtcctccagcctccccttcatgtttggttgagcaatgttttccaaaccactggtagtagaatcaatttaatcagtcaaaattaactctattttaaatgaaaacgagctgattaaaataggatagaagataccagaattcggaagtataaataatgttttgtgaagctttagtttcttttctattttatgtatataaacaaatatgtcatatacatacatcataccataaaatgtgacgggaacatgagatgggtcaaaaaatttgaaaacccaccaggttaaagcagcaatttttttcagtttgcttttcccccataacctgagagatgggcaacttgcctacaacatccattcccatgggcaaatcctgagccacccacaacctatgtagatgctataactgtgaccctcttgcccatatcagcacacaagtgaatgagaagaacattagcatgaagataactgcttaaatttttttggaaaagaatttttaggcaaaaattcacaaaagtaccagactttaattgttagtagcaaatttcttatgaaacacctcccaattaattaagacacagcaaagcaccctaaccccttggcaagccactctaatacaggctatttgaaggacagaccaggaatcattttatcttgttcaccactgtttggtgactgaataaggtacgagagaatgagtgagtgaagcctaaggacttcatccatggactagccctacccatgctaggaggctacgttccctacctttatccccattcagtcaaacctttcttctcatcagtctggctgtctttgttccaggtcacagcccttacctctaaaggcagtctgggccagatgcagtagctcacacctgtaatcccagcactttgggaggccgaggtgggcggatcacttgaggccaggtgttcaagaccaacctggccaacattgcaaaatcccatctctaccaaaaatacaaaaattagatgggtgcagtagcgcacacctgtaatcccagctactcaggttgccaaggcacaagaattgcttgaacctgggaggtggaggttgcagtgagccaagatcacgccactgcactccagcctgggcaacagagaaagattctatctcaacaaaacaaaacaaaacaaaacaaaacaaaacaaaacaaaacacacaaacaaaaaagaataaaggcagtctgacactttaatcagaccactgtacctgctccctcgtaatcttgaatcaaatatgatcgcctacccaaagtgtcgcagctgcgtgatcacccatgtgacttcccacaaattcagcttcttcttaagcatagtgccagccacctagaaggctgcctctcatctttctctcctttaactactgtccaggttcagctctaactccctggtaacccaagcatgaccacttcatttacctctgcccaattcttggcatcctcatccctggggacatgaactgtgtgcatccagggtccctgaggagtcacataggccctgcattattccagaagaggcaaacaaatcctagaaggaggtcctctaactttcgatggaaccaaaagaaaatcccaaacatttattctgtcatattatctatttattataaacataactcagatatactcctaaaccagctgtatactcatctagcccctaaagtgctgtgtctattttcaccatctccagctcccaatatgcatctagtgggggcagtaaggtgataataaacttatgtggaagaggtcccaggtctgagctacaagcccagctactggctggaaacgaggtcactatagctcaaaaaggaagtagggttgaagtcttcagttggaatttatacatggaagaatttaggaccaaagaagtggggcaggtgagagaaacaaagaaggggaagaaagccccacatcatacctctccccatggttcctgctgcactatgcatctgcctgaacttccacaggaaagtgaggctgagtcctcctcacagtctatgtaggatggatggcaagatggtcaaacacaagcctggaatgttctctctgaaactactttgttaaggccaatctcagcatacccgtgtggacagcaggacaggagcaagaggcctcaacaaaacaaggactcaaggtcaacccagagtagatctcctaactcagcctaactgtggccaggctgctgccagatgaactcaagacagaactgagcagaaatagtcctcaggactggccctggctctgtgcatatcctaaacacatcgctgccatctgaccatttctcctaagtctgtgccatgaaaatagttttctgttgtctcccctggaagaaagctgctggaatggaggagggggcagcctgtcactgctgtggcagacatcacatcctgtctatgccaacttcctccctcagccacccactgtcagcagctgtggctcatacttctccaccaggtgaactgatgaggaaacacttggtcccctcggtttgaaaaactgggcaaagtcacccccttggggagtcctggcctaagagcatggaagaggcacagcagggacctggtcaaactctagatccccaggaaggaatgatcccaaagtatggaaacgggtggtagaggcatgaagtaggtctgaccatagccatatcctcctgtcttgagctttgggtggcactttcttgacagtggtctcagacttctctgcttcttctgggctgaagtgtgatagggaaggaggtgggtaaggggaattcccccaagctccagcattctcagaagaaacgggtcactggctgccagtgggagccacctgccaagggggcataaaccagagcctggcctggacagttctcttcctgctagacaagggcatcagggcttttgcctctacctgataatgtgtgtgagtctggcagggctccaatgtcctaaggaagcctctctgcccttaggaatgacaacttcctgagttccggggacagcaaagtagcaaatttgacacagttccggtctcagtcaaaagtttgtttccttgacattttttcttcagtggttccacagacactgtaggctcccagaaggcagaagctgagctaagttcttgctaactcctcattgagacccttgctgagcagaaaggaggcagtggctgtcttggaaaggagagggcactaaatgtgggtgaagtcagagggcccaagatcaactttgggctcttcagagttatggagccttggtgaacgcatccataaacgagataatctcactacttcacagggttttagctgaggattaaaagataaatattttatgtctgtatgtgtctggaacactgtgggtgttcaacacagtccccctcaccgcctgcttcctcccgaaaatcttgtgtcatgttctgatgtccgagggacctgccctcttgcttctaggctgtctctctctctctgcctccatcccaccttcagcaattgcttcgcaacactctgactacagagcaatccattatcccttcactgatcctgctctggcttcctctaagactaggcgccaattttggtatcattatcttgaggggtgggggacatggcaggagactccaaggaagaagtaagggaggtaagtcacagccaaaacagtcacaataggagatgtgaggaaaaggggaagatgaactcaaactgaaagcaactctgggaccgattcctaaatcacagggaaccagcaaaacatctaataataaaaatctataatgggaagaagccgaaaggcatggagctggtgcttctccagcaaggctgctctgtttgccagtttgaggccaggcaaatctccctgcacaatggggtgcatgtgagcaaggcctggtccctccagcaaggtttcctaactctccacctgacccctgacagccccagtcaagccaaggagggaggcagctctggtggcagaggttcccttccctttcccactctgcacccccagcccagtgagcccctcctcatttccttcccactgcaggggaagggaaatgccggtagggtttggagtttccttcaaagctgtgagctctgctctgggacttgcccctactctgacagtcttcttgagccaggcctggggaaaacccaaaaaacagaaataggaaccaccaaaaattcccaactgtttttgttggtccctatcatgataaatcttaggaacagagaccaaaatggcatagcttcgagagacagggagagagacgtttgtaatgttcctgggaaagaaactggaggctttagggaagctccagcaggggctgtttgttttgagcaaatacagaaagtgagaggtagttttattaatgttttccctcttgaaccacctcccaccaggtttcctatggctgtcttctcccaagtgtggtagcctcagcccccacactcagcccatggggacagggagtcctgagaaactgaatctagaactgccccacagattaaatgagtgctgtcctgggcaccacacacttctcaacgtgctgctgagcccctgaccgcaggtccaagtcctccgtggcatccacagatcagctcattgagcagatgagcaaagatggaaagtggcaagtggacacaaaatttgggagtccagaagactgctgaaggaggagctgtaacacagtgttcccaccccatgttcccatgttcccactaggattcccctcacaaaccaacagatctgccccaagccagtggcaaagcaggcaacacaaggcacaaaggcccattactagctgccaaaaggacagagtgtaaggaacggcctccacatgtctctactggtgggcagtaggcacagctgtggccagttgggccctgctcccaaagggcaagagcccaaggaggtgggaggtaccagctcctgctgccttggccccttggcggccacagccagtcctgccgcagtagcagctcctagacaatgagagttattttcagccagcactttaacacaagccagctggccagtgagcagggcgggagtcctcctccacccagcccgcccagacggcaggccagccggcccagcccattgcctacactgctgctgccgccgcctccacgtcactgtttgtttatctcattgttccagcacagctccttctaactcccctcaaaactgcaatcctttgtaaaagggaatcaaaaaaaatcagagagtttgatcaaaggtccaagagctaaaattttaaaaggtccagacatgggaagtacggcagcccctccaaacacccacacttttccccagccttgtgactggctggggtagcacaggggaggaaatggaacagatggatggtcagatctcactgcagctctcacagaccaaggccaagcctggcttcgctgccaacctggggagacaaagctcaagactgctctccttgctttgactccctcccatcctcctctccagagctcgggtttggagaagataacttgaaacagacagcctgaaatgggctgagtcaactatgaaaggttctgggcaaagatctatatcctgtggcagaaaggaaatcacagaacagtcaataacacttggccagaaggacaggcaaccccctgccctgcctcgatagagtaggggcaaacacttcagctgtaccaccccaccaccacaccaaagcactcaagaatataaaggatgaaaggcagcagttacctccctggactctaggcctccagccctggtcctgccaaactctacagcctccccagggcagctccccattactactcatctccttccttatgtgaccccacacacagaagcatgtgagtacaagtctagctacacagctttctctaggccccagctgccctcttagacatctgaacaaattgcttaggtaccacatgacaaaaggcataagaaaaatgggtgctccttaagtgtctgtagtatcttagatctgccttgcaggttttgttcaattgaagctaccactctggtgatgagctgccagggaaaagccagctctcacaggctcggaaccatgtctggagaacgtgcttttgtggtcactgaggactctgtaaccagaaatgacttgctgagcagttacgggccaagtccctgagcagcctggaagaaaaagaaatggattcaccagatgtctctggttgagctctgcagttcacaccagggaagtcagatgaaggagaggtcctaaaaggccagcatcattcaaacaaagagatggctttttctaaatacaattatacccccggggcctcttcttcatcctagagaattcctccaccggatcctgagaaggcaaaggatattggccatgtccccaaagttggtaaagcctcaaactctttcctctgccacactgttggcctcatacctgacatgagataacctctgcaggtaaccctgaggtccccaaaccctgattaaggccaccctttctggcctgcccagtcaaaaaatatacaatctccgataggagcttctgtcagcgcttcccaactgagcacccaggccctagtaaaaagctactgccacagcaacttgatctgtctattggctcctcggcccctcctcgtggttagccagacccacacactccccagttacgcagaatggaaagtattctgctgggggcagcttattttccaaagccaaggagtcttggggcagagcctcgcattctccctgcagccaaccaacgacctccctctcttcatgaggttctgtcctcccacctggggagcccaatgggcagtgctacctctcagaggacacaatatttctggggtcacaactccctttctcctcataccaacaggcccagtgagtctccctcccaaggtctctcatctatatttgcccttccattcccactgtcatcacctgggtgggccgttactgttcacttgccgccctctgggataagcttctagctggcatccctacttccaatactttcctccctgccatcctgcacatgaatgaaactttcaaacttccaagcacataagataaatcatgtttctccttggttcagaaatcttttttgactccttatcatttatatgagaaaacctgagctccttggcctattgttcttagcatcttacagtaagagcttctgaggtaagattctctccaggctggccccagcttctctgaccagcctcatcctctcccactctatggaatctctctctcctgggacagccactcttcccattccttaaccctaggatttgcttgtgattgatgtttccccaatctgctgactccctacctactacctactacctgacttaaaatccagtagctctatgactacccaacctaaaataatcagcccctctcttgagctccaagcataatcacatttaaagaataaaatggcagagacctgcctgttatcccccaacctcttctcctcctcctccttagtagtgaacctccaacgctgagttggacacttgacagcctagaattaatatgtttgtcagcttcccttgcatttaggtatggctatgtgatcatgtgggatgtaaacagaagtcgtgtgcacaacttctgagaaatgtcattaaagggagggaatataaccttcttttctcctttctgcttctagctagttggaatatagacagtggacgaaccttcaacaactattttagaccatgaagtgaccttggaaatgaaatccacatggatgaaataacaagagagaaaataccaggacactgataccatggacctttagcacaaattgaatgtttcatagtgggttttttttttttttttttttttttgcatatgctttctctattcacaactagaaagaacataaactccttaagggtaggggccgtcttatccttctttgaatcatgtgcaggtgcttaataaataagtgattgatcctgctcctaccactcctaccaccaagtcccttatttggtctcctggttaactggggaaagggaggatcctttaactttttaccactgtccttactatttctgagttctcttatctataatctgtcttatgtcctatagcacaaatcactttatatattgctttcccctcagcaaactcctacttttcattctgagtttcaacttcagtttatgccataatctaagccacttccctgctcttctctttaaccagactcatcttcttataacctgctagaacacaggcttctgagaacaggaatcaccatcagcttgtttagcactttaataggtgagcaataaagattgggcaaatcgaatttctccattcgtatattccttctgtccctaagttttctactccattgtaccccagagagattacctcctttcgaattgccagccatgctcctcctccaattcacaacaggtgaaatctaccatctctagcaaatccttcataaatgacagtagtaacatccactcccctaacagtgtctctgcacatttactaattacttttaaatgtgttcatggaattgtgacttatggttaatgtttcttcaccttttcttggacaatcaatatatatgtttatcataaatctcagtgaccctcctagaggcacacatacaatgtagtggttaaagcactaactgtgaagccacactacctgggtttgaatcctagctccaccacttactagctgtgtggctttgggagagttatttaatctctgcaagcctcagtttcctcacctgtaaaatggaggcaggaataatagtacttaccccatagtgttgctatgatgattaaataagttaatatatgtaaagcatttaaatcagaacctatatagtaaatattacacataatgctacctatgttttttcagtttggttttttattcaacatttagctgggaaacaactctatgtcaagcacaagctagaatttggcgatatcaaaataaatagggtatggtcactacattcagaaagttcatatcctgaggaaaggtatacatgcaaatcaggggtcagtatagacagcattgctgtgaaagaggcacatacactactgtgggatcccaaggaggtaacatctaattagactgtggagtcaagtaaggtgtaagacttcctgaaagaaatgtcacaggatttattttattattattatttttgagatggagtctcgctctgttgcctaggctggagtgcagtggcacgatcttggctctccgcaagctctgcgtcccaggttcacaccattctcctgcctcagcctcccaagtagctgggactacacacatccgccaccatacccggctaattttttgtatttttagtagagaaggggtttcactgtgttagccaggatggtctcgatctcctgacttcatgatctgcctgactcggcctcccaaagtgctgggattacaggcgtgagccaccgtgcccggcctattttattttttttgagacggagtctcactctttgcccaggctggagtgcagtggtgtgatctcggctcaccacaacctctgcctcccgggttcaagtgattctcctgcctcagcctcccagggagctgggactacaggcgcgcaccaccatgcccagctaatttttgtatttttagtagagacagggtttcactatgttggccaggctggtctcaaactcctgacctcgtgatccacctacctcagcctcccaaagtgctgggattacaggcatgagccaccacactcggcattatttttattattatttttattttgagacagggtctcactttgtcatccaggctgaagtgcagtggcacaatcttggctcactgcagcctcgacctcccaggttcaagtgatcctcctgcctcagcccctcaagtagctaggactacaggtactcatcaccacacctggttaatttttgtatttttagtagagacagggttttgccacgttggctaggctggtctcgaactcctggactcaagcgatccacccaccttggcctcccaaaattttaagactacaggcatgagccacagtgccccaccttgaattagtcttaaacatcaagcgggaaggaatcaggcaaaggcaagagcagaagggaagatggtgatattctaggcaaggagacagtatttgcaaatactggcaacacaaaacaccattacaaatccaggagtctgtaagtgatttactacaaaggcatgaaagtatgtataaggaaattacagcaggcagaaaagtcgggtgataaaggatatgatgagctaagtaagtaggtggcataagtaggataataacaataataacactactaaaatgaaaacagtaataatgaaaaaagctaacatttattgacagaactgcgataagcactctatatgaattatctcatctaattctcaaaacaatgatataaagtcctatgaagtagggactatcattatccctattttacaagcaaggaaacgaaggcttggaaaggccatggaacttgccccgcatcacaaagcaagcatacggtggatctgggatttgaacccaagtctgaccccaaagtctaagcttttaactcctcacaatgtctcctctgagacaatgaatcgtattagcccttctttgcacctttccaaattgtatgcatccttcaggaccaatcagtaccatctcaaccttcctcatggaacctctcccaaacaacccagatctctgtgcattccttcctctgaatttctgtgggttttctgccctaacctcccattagcactcatattcaatcattcttggaacagcatttgtgtctttttttttttttttttttttttttgagacagggtctcactccatcacacaggctggagtgcagtggcaagatctcggctcactgcagcctcgacctcttgggctcaggtgatcttcccacctcagcttccccagtagctaggactgcaggcacacaccatcatgcctgggtaaatttttttggtagagacaggtttcaccacgttgtccaggctggtctcgagctcccaggctcacgcaatccacccactttgacttcccaaagtgttgggattacaggcgtaagccaccacacccagtgacattcatgtcttctatgtaccatgcactgcgccaactgggggacctgttttgccttgcgataactcttgtatttacaaacaagggggaacctgaagcttataaacatctactctgggccaggatgatgctagacccttcaattgcaagatttcatggaaaagtcacttctctctcatattgttattcatttttcacattttatattatttcctgaactagaatataagctccttgaggactttgccttgaatacacttgttcctagcaagtatgcctggcacacagaaaaagcttaatagatagatactctgggctgcccaaagagacagcagaggccattttggggggcagcacccagtacactggcctagggcccagctctggctttccaggagtctcatgacacatctaagagcttattataaagccataaaacttaatgaatcccttcctacttccagacacatgtgggagggcatgacccctgctttatagaaagataaactgaggtctggcacaggcacacatctgtcacaagttgtatcagctagggagaggctctacaagtcctgcctttccttgctttcaaatggaggtacatcctcagcgcctcagtgcttctatcctcttttgggaggaatcataataacctcagtctgctctagatccatgagctgtcctcccaatgttgtcccctctcacgctttgaaggctagaacttgacatagaggtctaggctacccacagcccaatgctatttttgagttgttccagcttttttacatctcgtttgattgtacagctaggaaaaaacacctctttagacttaaccttttgagagttccctccccacgacccaaatcttctctgcttcttgaaatgtctgatgtcctaagtgttatattcactcaagaacacggatgaaaaacattactactcatcttttatatgccaggcacttttctcacattctctcacttactattctcaataaccactgagggaattaagaatctgagaccaactggctcaaggttacacagaaagtagcaggacccaaattcaaacccagacgtgtggcctccaacatacaaggttttctaccatgttcgcccatctccttacaaagaaaacaaatctctttttctaacttgagaaggtccaacttgatttatctgactggctttggttgatcattacacaatgcttccctattctgcacaactgagtgaaaccagctgaaccaagtatgagtatgtgtgctgaacatctgaagttcaaggcttcacagagtaagagagagactgtgcacagtacagatgcaaggaaacttgtcctcttggacacaacctagtgacaaattcttacatctgagtagcattttattttattttttgagacggagtctcgctctgtcgcccaggctggagcgcagtggcgcgatttcagctcactgcaagctccgcctcccgggttcacgccattctcctgcctcagcctctctgagtagctgggactacagatgcctgccaccactcccagctaagtttttgtatttttagtagagacaaggtttcacggtggtcttgatctcctgtcctcatgatccacccgccttggcctcccaaagtgctgggattacaagcgtgagccactgcgccctgcctgagtagcattttaaactttccagtacagcacaggctttggaatcagggatgactggatttgaatcctgttacttttcacgagacagtcagaaagttctcactctgctgcccaggctggagtgcagcggtgcgatcatagctccctgcagccccaaactcatgggctcaagtgatcctcccaccttagcctccaagtagctaggactacaggcatgtgccaccacgcttggctaatttttttttttttttgtagagacagggcctcgctatgttgcccaggctgaacttgaactcctgacctcaagcaatcttcccaccttggcctcccaaagtgctagaattacaagtgtgacccaccgtgcccaaccagggaaagttatgaaacttctttgaacttcagtgtcttcatttacaaaatatggataatatctgcctcttaaaaatgaataaaagggattttgcacagtgcctggcgcaggagaaagaccctgtaagtggtaactggaatgacctactccaggagtcacatttgactcaagttagcttctaagtacatacgcaaaatacaaatacaatttcaaccttttttttttttttttgagacagagtctcactctgtcgcccaggctggagtgcagtggctagatcttggctcactgcaagctctgccttccaggttcacgccattctcctgcctcagcctcccaagtagctggaactacaggcggccaccaccacacccagctaagtttttgtatttttagtagagacggggtttcactgtgttagccagaatggtcttgatctcctgacctcgtgatccacctgcctcggcctcccaaagtgctgggattacaggcgtgagccaccgtgcctggccctcatactattttttttgagacagagtacagcagcataaccacaactcactgtaaccttgaactcctggactgttacaatcctcccacatcagcttcccaagtagctgagactacaggtgtgtgccatcatggctgcctattttaattttttattttggttgagacaaggtcttgctatgttgcccaggctagtcttgaactcctggtcccaattgatcctcccgccttggcctcccaaaacattgaaatcacaggtatgagccactctgcccagcctaatttcatagtactttaaaatatataaaagagtataaatgtatagttgaatagtataggttaaacatacgtaaagtatgattccctcatctcatgtgatctaataattctgtaggttagagcagttgtacccttgccccttcaaaagataaaatcaagaaaccaacagccacccaggggattcacaggaaaactgagaccagaacttagtgaaatgaagtcgactcactaagctgctctgctatttgagcagctgagtgatctgggacaattctaaccttttggggccagggttttgttatctgtggagagatatgggagagattttgccaggttatctctagtgttcccgcctcatctcagattcctcacttcccctactgtctcctaacttcctcgggtccacttctgccacaaatctgtttttggccccctcaactaactactcttctcaacaactgtgcttctctccttgtgaccttacataagtcctaggagttgtccctccccatcactgaagggctgtgctgtgagactggagaaaagctcacatttttattgacagtaggcatagatgactctcaaatatgtatttctatcccagacttctcctttgagattcagctttaaatactcaacccccattagacattccacccagacttccacaggctttgcaacctcatgtgtctcaaagtggcctcatcacttttccttctaaggtatttcttctactgtgttcccttgttagagtagttaactctaatctagcaagctagaaatctgggtgccatcctcaatgcctcccttctccctcacctctatcctcacaatgtaaaatctaatcagccatcaaaaattgaaataaaatctaatcagtcatgaaaatttaactatttattaatagttaacatttatttgactgtcccatcatctccattgtgcaaactggtcccagtttaggctcccatcatcaccaccacagagccaaggccttccactcagctgcctacctccaattctggttccttcccatggttgccagactgacctacccacaactcacaatctgactatgaaacacataaagcacagtctcttccacatggcattcaaagccctccttaccacttgagccctgcctcccacgagtctctgccttacactttacacttcaacggcactgagcagctctgagagggttctctgaacacatcatgctgtctcaatttaatgcctctgctcatgctgtcctctctacctggaatgctttcttttccaaacttctgtcctattcctaaatacccttttagccagcagagatttccttctctgggcaatattccccaagccccacctctctactgtgctctcccgatgcttcctgcatctctacagaactgcacttagacagctttatgttataattacatgtttaatgtgtttgtctccccctctagactgaactcctgggggcaggatgactgtcttagtcacctttctccagctcttaacacaattctaagcacttgctgagtgcatgagtactaggctacacttgctgagtctttgagggctgctatcttgccccctctctgtttctaggcagggaaaatgacaccttaaccattctcagttcaccacctcagaggccctcctgagtgctgatgtgattctttagccgccctgccacaaaataaggctctctctgccctcttgcctccaagacaatcagaagcagctggtagtgcttttgtactgttatgacaccaacttgacatttccctggatctgtgggcaacaagtactagatgctttctttacaattcttggaaagaatcaactgagaagccaaattctactggacattgtctagctggttatcctctagcttctgagatgatgctcaaaacttttaacaaggacattctagagaaatgacagataaatgctttgggacgccaccgcgacctgttgccccataaatgcacaagagattcttaattctttagtcagccaccatgccagcaataattaaacaagcccaaagggagcaattcatagctgctattggaccatcaatctggaactcatgacagatgccatcagaaaataatctgcagacgtgagcacttcatgagggagcagattcaccaagtgtcctgcctgccaagggcctgaggataatgagtgcttatatgaggttgattctgctgagtggcaagtaaaaacaaaataaccacaaccacaaacgagaagtctgtccaaagtaaggggcccaagcatactctggacacagaaggggtccaaacaaagatgctctttcctggtcagatatctctggcccatccattctagaacattgtctgggcctcacttcagggctggcattgaaatgagaggagtatgtgatctcaagtctacgaaatgagcccatataacagcaactctaccaccccagagttcaataaaatcccaggagcacaggtctcaacctcagctggtgtatgatggttttacccttggtaaacgcccccagttttaaaataaggtccaggccggaagcagtggctcacgcctgtaatcccaacactttgggaggctgaggcaggcagatcacttgagcccaggagttcgagaccagcctaagctgcatggcgatatccctagctgggcatggtggcacgcgcctgtagtcccagctactcaggaggctgaggcaggagaatcacctgaacccaggaggtggaggttgcagtgagccaagatggtgccaccggactccagcctgggagacagagagagactctgtctcaaaataataataataataatgtccctccatggctacacaagagacaaaatgtgctaaagggcaggccaacaaaagccaagaattaccccagtacctggaggtccctaaagcctgtggaaaggtcatgactaggccaacattattgagtataaaagaaaggtgactagtacgtgctgttcagtgactttacaacttcaaggtacagaaaaacagtctctacccttcaacaataattcttatttcttaaatatttttgttaggctcctcaataccagatctctgattcaagaagttaatggccttcaaataatatttctatttaaggctgggtgcggtggctcacaactgtaatcccagcactttgggaggccaaggcagggggatcacttgaggtcaggaatttaagaccagcgtggccaacacggtgaaaccccgtctctactaaaaatacaaaaattagccaggcttggtggcgggcgcctgtaatcccagctactcgggaggctgaggcacgagaatcacttgaacctgggaggcagaggttgcagtgagctgagattgtgccactgtactccaccctgggcgacagagcgagactcggtctcaaaaataaataaataaaaattctatttaaaatgttttggtttttggaaggggagggtttgagacagggtctcactttgtcacccaggctggagtgcagtggcatgatcatagcgtactgcagcctcaatctcccaggcccaagcaatccttctgcctcagcctcccaaagtgctgggattacaggcatgagccactgtgtccagccttctacttaaaatgtactgagcatcctggctggacgtggtggctcacacctgtaatcccagcactttgggaggccgacgcaggcggatcacgaggttaggagaccaataccatcctagctaacacagtgaaaccctgtctctactaaaaatacaaaaaaattaggcgtggtggcgggcgcctgtagtcccagctacttgggaggctgaggcaggagaatggcatgaactcgggaggcggagcttgcagtgagcagagattccgccactgcactccagcctgggcgacagagcgagacttcatctccaaaaaaaaaaaaaaaaaaaaaagtattgagcacctttatgtcagtcactgagccccaaaactcttaaaaaaggcttggctgagcatccatccctacactccttgcagctgcttcccagaccagacttcatatttctcttcaagaccagaacacacagagtgacttcaggaaatcttgagagaatcagacttgagaagcctaggaaagacaagtatctatttacagttaatcagcaccctacccggccctgcagacagttctgacaactggagccaggaagaatcaaccacaggctctgactggggcccacctgaggctaggagccagttggacccccagatgagtactgactctgatccccacccagactggctgcactgccatagggagccccttcctcggagacacactcaggcactgggatccaaagttcatggaaagtttcactttctcttatagctcaacccccaaaactgcctgataatcttatcatcttatctaaatatcttccccattccttttttttttttttttgagacggagtctcattctgtctccaggctggagtgcagtggcgcgatctcggctcactgcaccctccgcctcctgggttcaagtgattctgctgcctcagcctcccaagtagctgggactacaggtgcccgccaccacgcccggctaatttttgtatttttagtagagacaaggtttcaccatgttggccaggatggtcttgatctcttgacctcgtgatctgcccacctttacctcccaaagtgctgggattacaggcatgagccaccgcgcctggcccctctctcttattttttaagagacggggttgtccaggctggactcaacctccgaaagtcaggggatcctcctgcctcagcctcccatgcagctgggactacaggcacatgccaccacacctggctataacccccaatgaccatctatctctttatcttaccttctttttcttcatggtacttcttgctacttaacactatattatatacctgtagatttgtttattgttctccccaacaacaatgtgaatgctatgagactggcttgtcttttttgttcactgtggtatcactgatgtctaaaatacagagtaaacactcaataaatagttgttgaatgaataaacgagtgatcatgcaaagatttttaaactctgcttccatcctagtggggctacatgagaagcaagactgaataatgcctactttccagaaagccctataaacctgttgctgaaccctaacattccctccaaatatctccctaaagtcctccacatctcactcccaggcccacaaaccctaacccaccccagagcaagtattaaagacagaaaatggaacagcacccagggaggagacacatttttcctccagttaagtacagtccagaacctctgcaaattaaaagctccctcttcactgaatccactcagctatagttataggtcacactttttatttttataaccagccaacccatcaaattataggctcaggccactgggaggcacgccaaacactggggccagcctagcctagcagaggcactgccccttctggcctgagagggggtacaggagtgaggactgagcaccagtcaaacctgaaagggcagaagccaccatcaccctgcaggggacagtctagcgagaagcctggatctcactcaggccaaactgctgcccataagggagacagattccaggattctccacacagcagacaagagaactcttaaccttataaagcatacctagaagtttccctacaattaatttccaaactccttaccaaggccaacaaggtcccacataatctgggccctgctcacctttcctataccttctcggactctcctcagcatccttgtagaccagtctggccttcttgcagttcctcaaatgtgcaaagttcttttccaccccagggctttgcaaaagttgttctcttcctagaaaactcatcccccagatctttatatatagctatgatgatggcttgtggtaagtgggtctgcaagaatgaaccaaagaaactgctaagaagtccattacaacagaccaggcaagagctgaagatcaactacagtagtggtagtacagatagaaaggtgagagggacagcagcccagactaactccaagtgcttggcctggataattagctggaagagtgccattccccccaaaatacaatgtataagaaaacactagcaggtataaagtggctcacaaacattggacactgttactatgaaatgagatatatttattgagcatctactatgaacaaggcattgttaataataaaaattatttagtacaagacaacattttaccctaaagaaaggcaaaaatgggctgggcatggtggctcatgcctgtaatctcagcactttgggaggctaaggtgcaaggatcacttgagcccaggaattcaaggctgcagtgagctatgatcacactactgcactccagcctgggcaagaaagaaagatcctaactcaaaaaataattttttttaaaggaaagcaagacagatttggcaatggaaagaattagttcaaaacttgctgactagaaatggaagcttctacatttgaagacttctgcagttcaagggtaacacatgggatcattttctatccagtttcacttaaatcaaattattctgattctctaacctatgaggattgagcatttatctctcatatatatcaatcattcaactttaaatgagaaaactcatgaatggccagagaccagttaccaactattctctattccctgttgaaaccctgggcaggaaagtcccttttctaacaatcaagaaatgttcaggctaggcacgatggctcatgtctacaatgccagcactttgagaagctgaggtgggcagatatggcttgagcccaggagttcaagaccagcttgggcaacacagcaagataccatctctacaaaaaagtaagaagcacaactgtagtcccagctactaaggaggctgaaatggaggacggcttgagcctaggagttggaggctacagtaagccatgatcacactattgcacttcaacctgggtgacagagcaagcccatttcaaaaaaataagaaatgttcagacaaaactcagtgtgtactggccatctgtcctgatccaagctcacatctgtctataactaaactcctctattccagcagcagggctcctggctgcccctcatatagctgcttcattcctcctccttaattccctcccatacagctctggcctggaacaatctcctctctcctgatctacagctgattaaagacctgactaaatcccctgtcctccttaaagcactgcctatttagcactcctataccacactgatcctcccctagctctccaatctttctgtgtttatagctgtgtggcaccctatcacctcatgatctcacttggtcttcacaaaagcatgtgattgggcaagacaaacagtattcccacattacagataaaatacagcacagagtctcacagacaacctgaggacatgcacttgctttaattctctagttcaaaatatagttttaagtacatacacattttgtctctccaactcagatagcaagcattatcttctatttattttgtatacccccaagtacaagggaaagtgctgtgtatacagcaggcacctatgacgtattaacttaataaatcatgaaagaaaagaaaatggaatgaacatttagaatagacccaagacttcccaacctaaagccttctttgttacactctctcttaacaacctgttctttgccttccaagaatatatcataattaaatatttatttaatatctgtattttcctctaaactctatgagggcaaaggaattcttagatttttcaccactatatacctagtgatatcaagagcacgtagtaaatttaaaacaaaaaacaagaaaacaaaacttctcgaatagcagatgtcctagtaggatagctaagatccaaacccaaatctggctgactctaaagcccaaatctttccaccacacctcttagcaaaggagaacttgttcggtaaactttcccctatattctgccacaatccactcaatccactccaaagcagtagtaagagcaaaggagagtcaaccccgcaaaaaggaaactatagttaagaaagtggagctgggcgcagtgccagcactttgggaggccaaggcaggagtgcgagaccagcctgggtaacatggtgaaaccttgtctctacaaaaaatacaagaattagccaggcgtggtggtgcacctgtggtcccagctacctgggagggtgaggtgggaggatcacttgagcccaggaggctgaggctacagtgagccaagattgcgccactgcactccagcctgtgtgacagtaagaccctgtctgaaaagcaacaacaaaaaaaactgggctttggcatcaggctgcttggactcaaatcccaactttgccacctactagtgtgtgatcctaggtgagctatttaacctacctggacctcagtttcctcttctataaaatggagataacaagtacttcacagagttgtgatgattaaatgagataatgtgtgtaaagtgttttgcatggtgcctggtataccattatcacacaataaatgttagctattaaaattattagctatccttattcctagaaggcaagaacctagagaaaatgattgtcacggtggtcacagctgctgaaccgacttgactttgagaagctgagatgcagcacagcctagagctcaggtttattctctttgtggacttctagggctatggctgtgccaaggctggagatgcagctttcactggcctggaaatgacagagactaaaaatacatagcctgcctgtatctgggggaccaggatcatgcctacattaaataatttaaaatacagcttcagcgcaaaagagcatctcttaggattctttttactgtggaaacagtgccaagctcagcacagggcacagggcagtggccagttgctgaccccactggtgccctttctctctctcgcacttttcttttggcttagtgcgaaaagtaagagaggagccttttttttccccccattaaaagttgggtctggccaggtgcggtggctcacgcctataatcccagcactttggtaggccaagacgggtggatcatttgaggtcagtagtttgagaccagcctggccaacatggtgaaacccccatctctactaaaaatacaaaaattagctgggcgtggtcttgcacgtctgtagtcctagctactcggaaggctgaggcaggagaattgtttgaacccgggaggtggaggttgcagtgaaccaagatcacgccactgcactccagcctggctgacgtagcaagactccatctcaaaaaaaaaaaaaaaaaaaaaaaaaaagttgggtctggctgggcacagtggttcatgcctgtaatctcaacactttcagaggccaaggcaggcagattgcttgagcccatgagttcaagaacagcctgggcaacatagcaagaccctgtctattcaaaaaatacaaaaattagccaggcatggtggtgcacgcctgtagtcccagctacttgggaggactgattgagcctgagaagttgagactgtgatcacactactgcactctgagctaggcaaaagagaccttgtctccaaaaaaaaaaacttcagtctaccccctccctacccaatttttattcctccttttctcttaaaggaggaatacacaagtagataatgtaaaagaaaaaaattcaaccaactcaaagcttatagaataaaaaatcagtcactattcagccctcaaccccactcaatcccctccacagttcaccacagttaataggttggtgtttatttttctaggccttttttctatgtatttatatacaaccatatatggtttttataaagcattatatatacagtcttctaattgcctttttagattatatttacacgtacatatatatcttggagattcccatttgccacagccatttattgagtgcctaccctgtgccaggtatttggctgtacagtgataagcaaacataatgtccccaccctcactgaatcaacaatctgggagatgcataataaacaagtaatcaaataattgtacaagggaaaaagaatgaataggatgctaactaagaaaaagaatagtaagtggggaagatctgagaggtggcatttttaaaaattgagacctaaagtataaactagaaagagtcgttttaacatccaggcaaagggtatcccaggagaggaaacagcttatgcaaagatcctgagatagaaaggagcttgtcctgaacgaaagagggctaatgtggaacttcgtaaacaggagggcaataaggttaaaaaggtcagcaggtgtcaaatgatgcaatcttaagggtccattgtcaggagtttgcatttttccttttagtataatacaaagggaagccattaaaggtttttaggccagggaatgatgctatttaatttatattttaaatttgggtgctttgtggagaatgggtgggaagatggagatagggataagagaggaaaatggaaagccagatggttggctgcaatacaagcaagagctgatcttgacttagaccagggcggtggcagtagagaaaagggacaggcagattacatatacatatagagagagacagtttttgtgtttgtttgttttttcactttttgttgttttttttttgagatagtctcgctctgtcacccaggctggagtacagtggtgccatcttggctcactgcagcctctacctcccaggttcaagtgattctcgtgcctcagcctctccagtagctgggactataagcacgcaccactacacccagctaattttttagcagaaacagttttgtcatgttggccaggctggtcttgaactcctgggctgaagtgatccacccgcctcagcctcccaatcttggtttttttttttttttttttttttttttttgagacagagtttcgctcttgttgcccaggctggagtgcaatggtgcaatctcggctcactgcaacctctgcctcctgggttcaagcaattctcctgcatcggcctcctgactagctgggattacaggcacgcaccaccacacctggctaattttgtatttttagtagaggcggggtttctctatgttggtcaggctggtctcaaactcccgacctcaggtgatctgcccatttcggcctcctcaagtgctgggattacaggcatgagccaccaacaatcttattttttttaaagacagggtctcattcagaggcccggaccggagtgcagtggcacaatcacggctcactgcaacctcaaactcttgggctcaggtaatcctcagggattggactacaggcacatgctaccacacccagctaatttttatttttgtagagacaggggtctcactatgttgcccaggctagtctcgaactcctggcctcaagtgatcctccagcttcagcctcccaaagtgctggaattacaggcatgagccaccacgcccagcctatttttggagatgaaatcagcaagacttactcatacagtgggtatggagaaaggacaagaaaaaattaaaaataactcccaggatttgccctgagtagatgaatgggagagcagtaaatttaagcaaggagtggacaatcaggctcttccccattcctttttttacgttaaacaatgtagccccgattattccttacatgcaccttccgtcacatgtgtaaactgttctgcagaatggtttcctaaaggtgaggtgggggagttagagaacacgcacattttaaatggataaaccctgtaaaatgccttccaaaatgtctgtaccgaattactctgccattaatattgaccacggacatagtcagtcttcaaaatttcacccagataattagtataataagtatatcaggacgagtgcggtggctcacgcctgctatctcagcactttgggaggccgaggcaggtggatcacgaggtcaggagttccaggaccagcctggccaagatggtgaaaccccgcctctactaaaaactaccaaaaattagccgggtatagtggcaggcacctgtaatcccagctactcaggaggctgaggcaggagaattgcttgaacccaggcagcagaggttgcagagagccgagattgcgccactgcactccagcctgggcaacaagagcgaaactccgtctcaaaaaaaaaaagtatatcctctaaattttcatctccttgatttctagtgaagttaaaaaactttttctattatttaacttttaattacataactaatacataaatgaattatccttgtaaaaaaaaaaaagtaaacattatagctaggcatggtggtacactcctgcagtcccagctactccaaaggatgaggtgggagggcccaagagttcgactccagtttagggaacaaaacattgtctctaaaaaatatataaataaaaatttcagatgtaaacattatagataaagctaaattcctcttgaatctgttcttcccatcatggttcctcccctaaccctgaatcccagaggtaactaactagtgttatcggttttatttgtacccttacagatacttttttattaatttaaaatctatatataaaaaataaaagattaagcatcttttagaagttgtttttccaacagtccttttagcatgaataaaaaatctaaccaaaaatagtttccttaaggcctaagttagtgacatttaagctgagaccatccccgcttagttaacccctctgagccctagcttcatattgcctgtaaaaaaacactgcagtgaaatactgcctcatagagttgttgttaagttaaatgagataaaacatgtcaaagtacgcggcatacatccaacaaatgttaactgtctttccttaacctttacaagttaaatccaggcagtcggtaaggaccagacactgagccattcctaaaaggatgagatgagggactctactcagaaaaaaacagagtgttgtcttaaagattttttttcataagtcccccaaaagatgtaaattttcctacaaaaattctgttatgaaatatccgagcagtcaaaaaaggtacaggtcattttttttttttgtaaggtagaagagaggatttaagcattgctagagaaacaaacgttccatccatccttctcccaggcagatgctgggaagctcactacccagatattcccccaaggacctcaggcctgcaggaaagagttgctgctttaggcaggtagtacctccaaacacaggatattatctaacctttggccgtcactgcaagaggccactgggttcctgggatttgtgaaaatatagctgtctcttggtatttgaaggggattggttctaggacctctctagaataccaaaatccccagatgctcaagtctctgatataaaattatatagtaattgcatacaacctacacacatcctcctgtatactttaaatcacctctaaactgtttataatacataatacaattaagtgctatgtaaatacagttgtccctcagtatatgtggggaattggttccaggaccagaccaaatggctccaagcctggtcctggaaccaaaacctgagcatactcaaactccacaggccccatggaacccatgtgtatgaaaaagtctgccctccttgtaaggttttcaattcttactactcaattctcgtttgattgaaaaatctgcgtataagctcacccacacaattcaaggccttgttgtttaagactcacctacagttgttatactgttttgtttacagaataattacaaggaaaaaaacgctacatgatcagtacatgcacaattttttcaaatattttatatctgaagttggttgaatccacagatacagaacccacagataaggagggccagctgtacatcctattatctccacctggatcttcccaaaggttgagggctagggccctagttcaaagaggtagaccccatcacaaaggatccttaatcaaagttaaactgtccaggggcctgaatatcttcctctgaatgggaatcacccaagtttcaacaagctctttttgttggaaccactaacagcagcattattttatctgaaccaataaccagggctccttcttaccaaggatcaagagtactaaaactgtatcaaggagttcctgcagtagagtttcctcacccagctatcacttcccattcctccaggctggcagccagggcttcctcagcaaatccaaaaatggtctttaaaactcccaaaatactacatgtgttcatacatagatgggagggggagaggggaaatagggaccacaggtttaactggatttccaaaggaatctgttacccaaaagattgagaactactgttgacagatctctcaaacatattcccaacttataaaaacttttactctggcttgagtaactgaccagggggtgagtgtagtatgtacatcccaaactgccacttgatgagttttagggtagagcccacagtacagaggaatcaggtattaaaccaacaggcagaggtaataaaaagaggtccacctctttcctaaaggtgtgctaggaaatgggaaaaccaagaaagcaccacacaccatggctctgtcttcccttttactgctcttgaagcttcatcctcaattggtacacaggacaaaggaggtacagataagtggaaggcaaatctcagtaggggtgccaatcacattttgggcaggatccttcttcattgtgtgggactcaccaaaacatgacccaaacacagagggatgtttaacagccttggctctcagctagaaagcctagcactcccagtcagtatgataatcaaaacatcctcaagtgcttccaaaaactccctcctgggacaatacctccctcagttgaaagctactttaaattatggaattctgagacgagataaagtgggtaatgtatatacaataaatatttatttttagcacctttataggttacaaagtgttttcactatgttgtctcctgtaagcatcctcaaaaacctgtaggataggtattatcctcacacgtgtcataaaggatgaaattgactcagaaaagttacaggatttgcctaaagtcgtgcagctgaaaaaaaaaaagactataaagctggatcagaacctaagtcttctgattccaaaaccaatggtctactgcttcctcccagaacaaaattttttttaagatttcatgggaaacactaggaggatctattgactggctccccagcttctgtgtaaaaacaagaacagaaactgctctaagctataggtagtttttaaaaccaaatatccatctcctaaagtacccaacgaccaggctcatgtcaactttcttagagaggcaccgtacaattaaaagaggattatgatattctccattctgaatttgagtagaaatgagcaaacaggggagaaacaaagtacgtatcttccctgttggtgtgtataagggacccagaggtaagatcaccagccccaactccagttttggccataactctgggtgaggggggataaggtggtaaaagagatggacgtgggggataaggataagaattaaaccatcactaatatacaagagcctaaacttgtcctctactggcaaaatctgccatgtaaataattctgctagcccctcgtggttctggacattattgagaacacctttcaaggacctaaaaatactttataaactaagaagagtatgcataatagtaaagctgcaggaggggagatactgctccccacccccaaaaaaaaaaaacaccctatccatgtcctcccctacccaacacacaaaccccaacccacaactttgttgtgaggtgatggaagacagaaagcgtaagagaacctggaaagaggaagattctaaaagaggaaaagagaagtagagaggaaagtgggaggcaaagacaacaagagtatctccaggacacagagggagcttgacatttctacacctttcctgggggactgactcactctccatgtgaaaggaaaacaagatacaaagacataactttgcccagagaggcaaaagagagagactggaaatggaatgcaggaattctagctgcccagctcagttctattctggaatccacttcacttctctatgaatgacaatcttaaatccctgaagttctcacctgctgctattcagaagtacccagcaagaagcaggagaggaggagcctgtgtgctgacaggaccgtcccctcctctatcttcaaagaaaaaggtcctccccttctttaaagtcatttccgaaccgcgatgaacccctagcctttccctggctctgctattgctcagctcagacgtgggagaaatgtttccccagaatggaagagactggtctggagacgtgggagaaatgtttccccagaatggaagtgactggtctggcagaccagatgacacgctgacttcaggcagccaacactgctgtcccatgggcttactacagtcacttctggggcacatactttggtgttgaccacagaaccaggaccccggctctgcccagcctccccaagcaacctcaggggcaggggaggatctgtggtctcatttcctctccactttggcttcttttttcacttcactgaagattagttatttccaccaagaccagttcctgttctcaccagctgtagcagttgtttccccacagacagaattaggaagcactggtgtggctgccacctggactgtcccagctgcagaacacagacccaatgagtcctgagaaagggctttttcatcccagataaagtagcaggaagaaagtaacgggcaggaagcaattccaagaactccacagtggatacaatggcatccattttattattttaaccttacataacagttacatatgcttttatacgtgaaaaatattttataatgaaaaactatacgaaatgtatacatttattacatagacatatgtatataataaatccccaacagagagcaaagaacgcaaataaaagatggccaaaacacttaaaatgaaatgttcagagaactgcaaagtaaaacaagataccatgtctaattaatcaaactggcaaaggctttaaaaacattaattcactcagtaacggttagcttacagagaaaggtagacacatatactatcagtggaaaaggtaactgataaaactttttcagaagatatatgtctcaaacgcctttaaaaaccatataccctttggcccaataattccacttctagcaatttatcctaaggaaataatcagagatggacacaaatatttatgcacaggatgttcaacacagtgttatttgtaacagcaaaaaaaagattttaggctgggcgtggtgctcacgcctgtaatcccagcactttgggaggccgaggcaggtggatcacgaggtcaggagattgagaccatcctggctaacatggtgaaaccccatctctactaaaaacacaaaaaattagccaggcgtggtggcgggcgcctgtagtcccagctactcgggaagctaaggcagaagaatggtgtgaacccgggaggcagagcttgtagtgagccgagatcgagccactgcactccagcctgggcgacagagtgagaatccgtctcaaaaaaaaaaaaaaaaaaagagattttaaaagggtaagatacgctggacgcagtggctcatgcctataatcccaaaactttgggaggccgaggcaggtgggtcgcgtgaggtcaggagtttgagatcagcctggccaacgtggcaaaaacccatctctaatgaaactacaaaaattagccaggcatggtggcatgcacctgtaatcccagttactcaggaggttgaggcagaagaattgcttgaacccaggaagcagaggttacagtgagccgagatcgcaccattgcactccaacctgggcgacacagcaagactccacctcaaaaaaaaaaaaaaaaaaaaaggcaacataaggcagtgataaaatattatagagtactatgcagtaatgaaatcatgatactgggccgggcgcagtggctcacacctgtaatcccagcactttgggaggccgaggtgggtagatctaaggtcagaagtttgagaccagcctggccaacatggtgaaaccccatctctactaaaaatacaaaaaaattagccaggcgtggtggtgggcgtctgtaatcccagctacttgggaggctgaggcaggagaattgcttgaacccaggagatggaggttgcagtgagccgagatcgggccattgcactccagcccgggcaacagagtgagactccatctcaaaaaaaaaaaaaaaaagaaataatgatactgaataatatataagcaaatgagaaaatgcttaaaatagtaaatgaacaaatcagtttacaaaacaatatacacagtatgatcccaattgttaaaaaatatatatacacgtacatcaaagtgttaatagtagatggtgagattataggttttattatcttctttacacttttcagtaagttccaaatttacctaataaatatttattattttcataatcaggagaaaagaagctattctcaatcctcttccatccttttaaaaaccttctcatacattattccctcttttaaaaaccatttggaaacaaaaacagttatatcctacaatctagcaagttctattttgagtttctatcccaaggaaaactctaaatattgaaaatactttgtacaccaagatgttcatcacagcattgtttatgatgacaaacagaagcaaaaaacctaaatatctaagaaaaggtgtatgggtaagcaaacaaaggtaccttcacttgatggaccatcgtacaagcatttaaatgtttacaggccaggcttggtggctcttgcctgtaatcccagcactttgggaggccgaggtgggcagatcacttgaggccaggggttcgagaccagcctggccaacacatggtgaaaccccgtctctactaaaaacacaaaaattagccaggcgtggtggcaggcgcctgtcatcccagctatttgggaggcgaggcaggagaatcgcttgaacccaggaggcagaggttgcagtgagcagagattgtaccactgcattccagcctgggtgacagagtaagactgtctcaaaaacaaaaacaaaccacttacaattactagcctgggaaaactaatgaaataacaaaagcaaaaaacaaacaaaaaaactggataaaaaacatatatactggcagggcatggtggctcatgcctaaaatcccaatactttgggtgactgaggtgggagaatcacttgagcctaggagtttgaaaccaatgtgggcaacaaagcaagaccccatctctacaaaaaatgaaaaaattagccaggcatggtggcgcacgcctgtggtctagctactcaggaggctgaggcaggaggatcactcaagcctgggagttcaaagctgcagtgaggtgcagtgagccatgatcatgtcactgcactccaccatgggtgacagagcgagactctgtcttaaataaataaatcaaatatcaaaacattgtataaaactctatgcagagaaaaaaatataaaggttttaaagcacatcagctgcatttggtaaaggaactaagaaaatatttgcatttggtaaagaaactagagaaaatatggatgtttttctttaacctaaatctttagtcttttcttctttctgaattgtcccatactttctttagagaataagtattactttaagaggaaaacaaaacaaaacaaaacaaaaaaacgctgaatctccctctgggcaatgaaaacattcccaaatgacagagtccactccatcagtcccttccccaccacacacaggcttcccccagactaaggcagggtcatatcagaaggtcaagggaataagactcctctctgtggtctagggtcttctctgtggggtctctgaacaagaagaaggttcctctgaccagctgctgtgaaaggccctttccctgccccctcccaagttctattctagcctgaactaattcaccacaatcctgagggctgggaaaaaaatttccaccatggtgatttggaacctgatatttagtccaagtttttcccagcccatttctgtgtcaaaggaggcccctcaaagcctcttagacaactagcacccaggccagcttagctcccacatcaatgctacacttacagaaaaacccccaagttgtcagtcatcaccagggaaatgtgagaggagaaactgcagcagggatagctcctgtcacacaaccctacccttatgccctgaaagcctcctcctaagggatatacagggctttttctggcatcagaacttttagactccatgtcaagtctgtagtaaatcaacaaagagaaaaatcagagtacaatcacaacaaagacagacagctatcctttcaaagaccttagagccctctgcctcccctctctatggaaagtccagtactggccagaatactagcttctgagcaactgagtttgggtagtaatctagtttggaccaaaacacactgggactgtatcagaccagagattggctctcattctggtattcataaagaggagctccattaattgccccaaccccaaacttctcaatacccaacagaatgggaagtgctactcagatagggggtaaggaaggatgccaagaagcagtgtaacacagcagcttcacaacctttttcccatcgaggcacacctagaaaatattactgtttctacagtacatggggtagaagctgatcccatccagaggggactgactgggaactttagctgcccctaggaataaggggatcagtattccagcacatctgtgatccatctgcagcacactagtagggaagccctgaattaaggcactgggctgggttaggattcttggaatcaatgttctcatcaaatcttctcatagccctcatctcaagctcttcaactttggctgacagatcatgtgtctagaacagaaggctgggagcctgtggtcttgactcagcactgatacaacttccccagcgaggatactcttcagggggttttccacagacacacttggggctaaggaagccctccagcttacagcagcagccatattccgagactggatatacacaacagggtaattggttttatcagatttctaaactttaaaacccctttttcggaacacaagtgatctcagatctgagtcactgctgagaggtacaaacttaaaagctaccatttactaagcatatagtagatgccagactctgctaagtatttgacttccaatttcattaaatccacacaacaacctcatgtggcaaatgctattattatccccatgtataagagaagactgggaatcagattaagtaacttgcttgaggtcaaacactcttctaaccaaagactatggatgaaacagttgaatccactctgacttcaaagtccataagcttaaccaggacaccactatgtcacctcaacaaacctcccaaatagctttttcaaaaaacctaaccaattataatgaagctgacaatctaggaaagaaaaaggtgagaaaggaacagtttatctgactgtttcacaccatcaacaaaaataagctaatctggccaggcacagtggctcatgcctgtaatcccagcactttgggaggccaaggcgggtggatcacctgaggtcaggagttcgagaccagcctggccaacatggcgaaaccccatctctactaaaaacacaaaaattagccaggcttagtggcacgcgcctgtaatcccagctactggggaggctgaagcaggagaactgcttgaacccgggaggctgagtttgcagtgagctgagatcgtgctgccgcactccagcctggatgacagagccaaactccatctcaaaaaaaaaaaaaaaaaaaaaaaaaagaagctaatctataatctatattgagtacttactgggtgccaagcaccttatatacaggggctcacctaattctcacaatctcaccagaacaggattacctccattttacagatgaggaagaagtctaggctcagagaagttaagatacttgctaagccagagtccttgatttttctactacactatgcttctcctgactgttcaggaaatacccctaagcctgtacctgggtcaaacacctgactcagtcagtactgttcccaaagcatggtagaaagggtacctttcagaacagtggacacagggacacttaagagcccccagagaagaactcaaatccccaagaagggatgatttccctgtattggaaaactgaggtgaaatcccgtctcctgagacaactaactagctctggcctgccctgttccaacccttcatcagcagcagctcaggcacacagaaacaagaccaaaacaaaaggcatgaggaaacaaatcaaaattttatacagaaaggaaggcatgcaagtgggtggtccagtcccccatttgacctgggttctcctggtgctctggtgtcctggttaactaggacatcacgtgcattttgtgaatattaagccattagtttgctaactaaacgaaatggtcaaccaagggccaatgagaacatgatggattctggttctgagctctcacaaaaaatggcctggcagctcccacctaaggcagcctcccacccaatccacctcaccccatccctttctccccagtttctatagctaacttgtgtcagcttgctggggattttcacacccccaccagagtgcagatcccctcccactcttttccccaacagttgggctcttgttctcaaggccactaagtcccagtctctcctcctcagcctgtgagatggtcacagcacattggtaatcactgactcacccgatcccccgaggaggctgggggaaatgcagagggccacaggatgtatggcccacatccctttggcccttcgcagagctggcgggcagagaggtgccagcgacaccacttccccttggaacactgtggaccctctttgagccagctctggtgccagtgggctgatgtcagattctctaccatcggagaggccaagatctctagacagctccactgttgccaacagatctaatctccttattccaaggcagatgaaatccaataaggctgctaagtccacaacttatccctcctgatgggcagaggcaaaggcagagtcggccataccaacaataacgccagaattattactgcttcttagaaaactctttggggaagtgagaactatttccccaaatttctcaaagattaaccccggtttaccaatgttttcgctctgcaaaacttcattttcagcgcaaacatattttctggctccttcccggtgataccagctcagaacctctcgcttcatagagccactgacatcaatgtccaattcccacaccaaagaagaatcccaaagtcagctctaaaaacccatttatacagaccgtttgaaacccacagaaagactaaaaagcacaggctaaacaacacaaaccagtcactatggcttaacgtgaaaagggggggaggaggcgggatggtttgtgtattgtttcacttggagaaataccccagtgaaatggtttatccacatgttcagcctttcaggcaaatccactctaacttagcaggatgcctgcaggccgttctgaaaataagcagaatggcatactctttattccacccccttcaggagctgccagccgcctccccatccccctctccccccaaacatctggtctgggctgggagtgggacccactccctgggaagcctccatgttcgcaggagaggcggtgtccccactcagggaagcctgctgaggagcgagccggccgcgcttctgaattccccccacccgcgagaggctccgggctgagaatgctagggacggggagcctggcgaagaagcggggaaacgggaaaagggcagcagaagggggaggaagaaggagggagaagcctggttcctaggacggtcccgaactggggacttctcctaagggtccagcggtggaggcgtcggtcccgagatccccgacggggctgtccgggccggccagcggctgctcagaggttcctgggaagacactggaggccgggatccgttcgggaccccgactgaaagggtgggcgggacgggggcccagcacaaagtcccagcccgggcgtcgggacctgaggggcggtacgcgggggaaggggctgggctcagctctcaccagcaccagggcgaacctttcctccagctcacagggctcaggcatcggcatcttgccgggcggcagcaacaacgggacagaggggggctctcccgggaccccctcggcgctctccaggttgcccatcgcggcggggccccctcaggggcctcggccccccacctccacgctccggagctttcggctccgcggctccgaccaggctcctccctcagcgccggctccccgagtcccgactcctcggccccgtcgagggcgccgggggttccctggagtcccgctggcgggggcgcgcggcgagggcggaggcagcgtagcggacagccgcaccgaagcaaggcggacggaggcggccggctcttgctcacacccgccgcctcgccgcgctcggcgcgccgcccgggcgctgcccctccccgccccccgcgctctttcccttcccccgccaacctcgcttcctcccacccacacccggccgagactcgggcttcccccgcgagcgccgactgcagcccgcgcgacgcgcgccccattcatgcaggccccgcctcccgcccagaggcctcacaggcggcccggcccgccccacctgcgcccgattgacggccgcgtctgccaatcacagcgcctcccgcccttgacggcctcgtgccgggcgccgagcgctccctggcggcctcagccggcatcgaatcaccgcggttcccagagggcgtgaggggctggcgtggacacaccgggaatggaccgtaccctttttcaaaaggaactcatgatgtatacaagtaagtaaaatattatacaaggcatggcgtacaaaactaactacaagagaagtagaaacaagcaggatactcagaagagggagagagatagtacctgttaagagtcggggtgagggagatcatagttggaccaggcattgagggatgaggaagcccttacccgacagaggcaggggaaaaaacgtttgggaggagagaagcttaaccatctggctgcgtgtgaaaatggagaggcgggagaagaacgctgttctgggctcagtcggcggctgggtcgttgacatttgcggtggaaatttgttgtctagccgccatcttcttccagtgagagcacccccttttcttttaggaaaccacctctcccctcttctcagtctaaatggagctgaattttatccccagttccaaaggaccgcatgacccaggcccagtcagtcacaacattttcctcctctacccatggacactgttttagggattgtcacttgacccaagcccagacaatatgatatatccaaggctttctctgaaacaatcaggaaagaggcactcactctctctccatttaggctgcaaaattattagaatgtaaacctgcagccgctggtggccgtcttatcatcacctgtaacacatcaagcctgcttgagaatgaagccagcgcagaggagagaaaagctatgagacaggacaaaattctaatgacatgccaagaacctggatctaaccatgcctgaagttatcacctagatttttaattcatttattcaacaaatatttattttagaaagtttattctatgccagatactattctgggcattgaaggtacatctgcgaacaaacaggatatacattgtgtcctcttggaattcacaatctgtgtagaaggaaaggtagacaataaactagacgagtaaaatgtatagatgttagtgatcagtgttaataaaaataaaactgaaaggtgatagagatggaagaggcattaagattttaaatagagttgcttacttgggaggctgaggcaggaggatcaattgaaactaggaggttgaggctgtagtgagccatgttcatggcactccactctagcctgggtgacagggtgaggctctgtctcaataaataaataaacacagctgttgcttgtcacaggcatgatggcttcaaggttaattttcagagctggagcgctagccgcataggcctgagggcttacagtcccaatggggtggttgcagtgtgcttcatggcatctggaggtggcgttcctactgatgacaagcagatgactgggctggagagggagttcatgacagccatgtatgagattggacccatacaatatattacccccaaaggcagcttcaggcaccagggaagaccctaacagctccctccatcaccaagataatagtgagctgcatcggtgaagaggacaacagtgctgtcaactggttctggctgcacaaaggcgagacccagtgatgctctaactatgaacccattacaagctgatgtcccacaagttggcccagtgagccctggcactaattgctcaaaatgtgctgtaaagtatcttctctccaataaagactagtcattgcattggctccttcttcccctccctcataataaatattttaaataggatgatcaaggaaggactcactaataagatagcatttggataaagatctgaaggatgcaaggaaataagctatgtggctatctagggaagaattatccagacaaagggaatggcaagtgcatactatctctgatgtattagaagaacagcaaagatgccagtgtagctggagtgcaatgagcaaggaaaagggtagtgaaagatgaagtcagaaaggtaaccagaagccatatattgtgtaggatattgtaggctattgtgtgaggacttcggttttctctaagtaggataggtagccattggaggattttgagtagaggagtggtatgatctaacatgttttgtaacagggatcactctggctcttgcattgaaaacaaaccaatagaagtatggacagggagactagttagcaggctagtgcaatcatttgggtgagagatggtttgaaccagggtggtaactgtaccggtggaaagaaatggtcagattccttattaaagacttgaaagtaaagctgatggaatttcctgatagtttgaatgtggagggtgaatgaaagataactgcaaagtatttgacttgagcaacaaagatggtggagttttcactaattgaaatgggggaagtgataggaggagtaggtttggtgagggggaactggaaagggaaggtcaggaacaagtttgggccatgttgagtttgatttgccctttggacatccaagtaaagatatccactaagcaattggatataaatgagtttgctcttcagactcatatatgtcttattgcgattgcaccccgctgggactgcaagccctcaaagccttcatggccagcgttccagctgtgcaaagtaaccttgaagccatcatgcctgcgacaagcagcagctctacttattaatttatgcaatttggcaatgtaaatttggaaatcatcgtcatatagatgctattaaagctagtaaattctttttcttttttattttatttttttattttatttatttattttttttgagacgaagtctcactctgtcgcccaggctggagtacagtggtgtgatctcagctcactgcaagctccgcctcccaggttcacgccattctcctgcctcagcttcctgagtagctgggactacaggcgcctgctaccacgcctggctaatttttttgtattttgagtagagatggggtttcactgtgttagccaggatggtctcgatctcctgacctcgtgatctgcccgcctcagcctcccaaagtgctgggattacagtcgtgagccaccgcgcctagccaaaagctagtaaattctttttctaactcactatgcattgggttcctgttgtttacaaccaagaggtagagtccctgtctttccaaaccattgaaaccctttcctgtgaagctcagcctcttctaatcagtgaacaaattaatcagttcacatcttatcccctttcttcatctccacttcttaccctaaatacgtgccttcccaactgctgtggcagactcttctaagcagaggggttataacaagactgtagacttccactagacaaaagttgagaattcaagaagggaaataattcaccatttatcatggatgcacaaggaacatctagcaaaaagaagaaactcgataggacagtgaacagcagtgtattcaccttttgtgtggtttcttagtccctaaccttttaattctgtttttgcttgcctcaagcataaccaccagatttatatactctagggtctttggggatctgctagattacttctttcattgttaactgcctgctcacccacctttaaatgcttactttctgtaggataaaactaaaactccttattctgatattcgagggtctatctctaaacgctaatgtcttctaatcaaatcaaccctttgcttcagctggaaaggtccatctccaaacattagttgctcattcttatgtctggctttgctctttgtggtagacagaataatggctcccaaagtatccatgtcctaatccccagaacccgtgtatatgttatcttacatggcaaaagggactttgcagatgtgattaagttacagatctagagatgagaagactctccaggtgatctcaatgtgatgacaacggtccttataagaggaaaggccaaaatgagggagggagatgtgatgacagaagcaggagtcagggtgaggtggagccatgagccaaggaatgcagtagcttctagaaactgaaaaaagtcaaggaaacagattctcccctcaatcctctataaggaacatggccctgtcaacactttaatttgagctctgttagacctaatttcagacttctgatctctagaactataaaatcataaatctgtgttgttcttagccaccgtttgtgataatttgttagagaaccaacaggaaactaacacattcctgctgcgtccctgatctggatttcttcttccttctactccatctatccaaatcccacccaggcttaatacaatctttaggtttattgggtgcttatgtgcaaaacatctgactagatgccggtagataaagaaagaatgcaagatgaaaaggtgaacaagagacctgctgccaacttcaaaagagctccaagtctggtgcaggagaggcaaggtagagcggaggagtgtggacccagtttgaaggaaccgtgtaagatcattggtattatattggtgggtaccaagtttcatatcccatcctggagttttctcaaattcaaatgatcatgactcttgttttctctacttttcatttggaacttgtagatatgtaactcttggttcctttactgccttgtgctgtttaatttttttttttttttgacagagtctcactctgttgcccaggctggagtacagtggtgcaatcttggctcactgcaacctccacctctgggttcaagtgattctccatcctcagcctcccgagtagctgggattacaggtgtgcaccaccacatccagctaatttttgtatttttagtagagactggatttcaccatgttggccaggctgatctccaactcctgaccttcggtgatccacctgcataggcctcccaaagctgtttaattttttgtctatgtcttgtctggtctgtggagcttatttgtttatttaaaagtatatatatccagtcctcttttatttcaggtactaaggaagatccagatatgaataggtgtctttcttccctgtgctcacaatagggctagtaggaatctaaaagcctctcaaactaatgtttacaaaacagtatggtaagtgttgtcatagagggtcatgccaagtgctattgagagaactggggagtggatgacactggagccagcgcttaagggcgaatagatgtgccaaatggaaaagagagaacagtgtgattagaaggtgatggaaggatgatcaggaaggagaaaaggcattccagaagggggaacaatacaggtgaaaatggattgtttgagcaatagtaagaaattcagtgaggctgaagagtagggtgtatagcaggaagagaggagataaatctagaaagacaggtcaaatcaagttcaaaaagagccttgtgctaagctaagaagtttgtcccttttttttttttttttttttttttgagacagggtcttactctgtcacccaggctggagtgcagtggtgcgatctctgctcactgcaacctcaacctcctagctcaagtgatcctctcatctcagctttcctagtacctgtggctacaggtgtgtgccatcatgcccagctaatttttgtatttttttgtagagatggggttttgccatgttgcccaagctggtctcaagctcctgggctcagatgatcttcctgcctcagcctcccaaagtgttgggattataggcacaagccaccatgcccggttgagtttgtcctttattatgtagatagtagcatgtcctagacaatttttaagtaagctctatggaaaaattcctttaggagcatttgaaaatatagagggtctacagaaacgacatagggaagatagaagcctgaaccaaatcagagcagggggatgaacagaagtaaatttggcgaaggagatatacctgagatacaatcaaccagacttcattgcttattacataataatactgactggtggggctgggtacggtggctcacgcctgtaatcccagcactttgagaggccgaggcaggcagattgcttgaggccaggagttcaagaccagactggccaacatgctgaaactccgtctttactaaaaataaaaaaattagccaggtatggtggcgcacacctgtaatcccagctacttgggaggctgtggcaaaagactcgcttgaacccaagaggggaaggttgcagtgagctgggattgcaccattgcactccagcctgcgcaacaggctgtggcaggagactcgcttgaacccaagaggggaaggttgcagtgagctgcgattgcgccattgcattccagcctgtgcaacagagtgtctactataaagacacatgcacatgtatgtttattgtgtgcacactgatcatttgcaatagcaaagacttggaaccaacccaaatgcccatcaatgataaactgtataaggaaaatgtggcacatatacaccatggaatactatacagccataaaaaagatgagttcatgtcctttgcagggacatggatgaagctggaaaccatcattctcagcaaactagtacaagaacagaaaaccaaacaccacatgttctcactcataagtgggagttgaacaatgagaacacctggacacagggaggggaacatcacacaccggggcctgttggtgggtggggggctaggggagggatagccttaggagaaatacctaatgtagatgacaagttgatggatgcagccaaccaccatggcacgtgcacttgtgtgacaaacctgcacattctgcacacgtaccccagaacttaaagtataattttaaaaaaatagtgactggtattattatagtgttttacaattttcaatattttttcacatccattacctacttagatctttacaacactatacgagggagatattatcattatccttgtcttatagatgagaaggcagattttaaaaagtgaagtcgtatgaacaagaccacctaatgagtaagtggtatccctggctctgaacccaggccttgtttcagaattccatgccatctgattctctaatgagaagtgaggaagtaaagaagactgaagagtttaggccagcttaaggatgccctacctttatcctctagggaagctcttaggtcaactgcttccccctccttactgacagcactttcaaactccagcttccacccctgtcctacccatcgaagaagcttctacattctccctacctcctagtctagcgcctagtctttagaaacacacatctcctcaccccatctctttcctaggaaggtgtgggagaagtgtcaacacagatatttaagagttttacttaataatttgccctggcaaattattacaggcggtggctcacacctgtaatctcagcactttgggaggctgaggaggaaggatgacttgagcataggagtttgagaccaccgtgggcaacatggtgaaatcccgtctctacaaaaaaataacaaaaatgagctgggcgtggtggcatgcgcctgtggtcccagctacttgagaggctgaggtgggaggatcacttgagcctgggaggtctaggctgcagtgagccatgactgcactactgcactccagcgtgggggacagcgtgagatcctgtctcgaaaaatagtaatgaaatagttttccctgttgcagatagaatgctcttccccttctttgctggccaattcctactcatctgttaaaaccaagcttagagattacctctttgatgacatctctaccaagtctgattgagaacatctctgtgagcacatagtattctaacatctctatcatcataccatgaaatcatcaggtaatgtaaactccttcagggaaggtaggtattcctgatgtctagctatagacccactccatgtctgttacatgcttgttgaacaaatgaatgcctttccacagtcccatttttcccacatgatagaagatgttttttgttttgttttgtttttgtttgtttgcttttttgagacagagtcactctgtggtgcaggctgtagtgcagtggcatgatctcggctcactgcaacctccacttccggggttcaagcgattctcatgcctcagcctcctgagtagctggaattacaggcacgcgccaccatgcctggctaatttttgtatttgtttttagtagagatggggtttcgcgatgttggccaggctggtctgaaactcctggcctcaagtgaaccgcccgccttggcctcccaaagtgctgggattataggaatgagctactgtgcccagctgaacatgttggattctttatcattcctcccagatacatcctgactgcctgtatcactcaggatagttggaggggattcggtgcagaaaacagaaacccctgcaactatcttagggatacaaagagttaagtgcttacgaaatccttcagaaagtctagaggaatggccgggtgtggtggctcacgcctgtaatcccagcacttttgggatgccgaagcaagtggatcacgaggtcaagagatggagaccgtcctgaccaacatgatgaaaccctgtctctactaaaaatacaaaaattagctgggtgtggtgatgcacacctgtagtcctagctacttgggaggctgaggcaggagaaccgcttgaagccgagaggcggaggtttcagtgagccgagatcgcgccactgcactccagcctggtgacagagcaagacacagtctcaaaaaaaataaaataaaataaaataaagtctagaggaactagctctgggttgaaactccaagaataaccaccagaacaaggtaagagtgctccaacagggaagctgttacctctaccacagtcagggagggtgaagcacctgaaagtctccactaactgggtttaagagtaagtggctgcagctatgatccagcgagctggcagctgtatcaggacattgccactgctacactctgatgcagccacctctcaatatttgcaaagctagagacctcacagtatcactgctatagaaacatgacacatctctacaaccttgcttggccaggagaaatagtcaaagtagcagggtgattggcctttttctcacttctgcattctactatatatattttttgagacagagtctcactcactctgtcatccaggctggagtgcagtggcacaatcacagcttactacagcttcgaactcctgggctcaagggatcctcccatctcagcctcctaagaagctgggactacagacatgtaccaccactctggctaattaaaaaaaaaaaaaaaaaaggtttgtagatacagggtcccactgtattgctcaggctggtttcaaactcctgggctcaagcaaccatcctgcctcagcctcccaatgtactagaattacaggtatgagcccagcctcacttctgcattcgaaatctcacccaagtacatgtgattggatgtaaggaattctgagacatataatccttagctttttagcctc

SEQ ID NO: 279 - DNA, 707172 bp, Homo sapiens
taatggattgtgcctcctccttcccccagtatactcccatgaagcccctaaagaataagtttatcccatagcaatctatggtatggtgtcatattgggagtcttgagctgaaaagtactttctcacggtatattgacgcaagagcttccagctgtccagagcgcaagagccagcgccagtccccagagggttgctatgggaacactgttatggcaactggttttcatcacagactctgcagttccattggctgaactataaccacacgctagtcctttaatggttaacagtaactttaaaatcatttgaaatttaaaaataatttctggtggtgtggaatagctagggagggcagtgtggccagccgcgcagctatggtgtgagctgaccccattcagaatattgaaaaacatgctcatttaaaaaaagaatgtatttttacgttgatcagaacaatttatcatgaaagcattgattatttatttttcccccattgtaaactttatacaacttgcttaaatgaatccttgtgttgcctctgctggtcactctcactaggccacttccttctgttgagtctcttcttccctctctgtaagcaccaacttcctcaactttttctcacagtgttcaagcttaacacataattttaccaatgagagcagctgagaagtttcgagctgccttttggtgatctcagactctttcactgagcttcaggccgggacagtcaagagtcactcctgcaatccgctgtcctggccttccttaactcacagttttacaacttgccaaaactaaattgcctttgcggtcaactgcttttcctttcagacttaggagatgttaggaaccatgagcgttgcagtctgtgcagtctgcgcctgcctttctaagtttggccatcctgggaagtagaagtgtaaaagctgtagaatttgaaacttttggaccacaactcaaaacaagtgtatggagacccagtattacatgtacacaggcacgtctacctgaaacaaagtcactggccgtaccatgtgcaaggcacattcttatgttttctaatctgttgtgtttctttttaaaaatatgctggtggttatcctcaaaattggttgacaactcattaatgtatggtggtcagcagtttgaaaaccactgattttttttttgaatttcaaacttttatgttaatttcaggggtatatgtgcaggatgtgcaggtttgttgcataggtgaacatgtgtcatggtggtttgctgcacacatcatcctatcacccggatattaagcccggcatccactagctattcttcctgatcctctccctcctcccacccgccatcctccaacaggccccagtgtgtgttgttacccctgtgtgtccatgtgttctcattgttcagctcctacttacaagtgagaacgtggtatttgctttgctgtttctgtgtaagtttgataaggataatggcctccagctccatccatgtccctgcagaggacatgatctcattcctttgtatggctgtgtggtattccatagtgtatatgtaccacattttctttatccaggctatcattggtgggcatttgggttgattccatgtctttgctattgtgaattgtgtcgcagtgaacatacatgtgagtgtgtctttataatagaatgatttatattcctttggttatatacccaggaatgggattgttggattgaatggtattactgtctctaggtctttgaaaaattgccacactgtcttcaacaatggttgaactaatttacactcccaccaatagtataaaagcgttccttttttctctacaacctcaccagcatctgttattttttaattttttgataatagccattctgactggtgtgggatggtagcttattgaggttttgatttgcatttctctaatgatcagtgatgttgagcttttcttcttgtgtttgttggctgcatgtatgtcttcttttgtgaagtgtctgttcgtgtcctttgcccactttttaatggagttgtttggaaaaccaccgattaaagcaattatcagtagaattaaagaaggaaatgacctgttagatgaatctaggacaaaaggactataattcttttttgattttttttaatatggagataacacttggctctcattgttagtgtgaaatttagcagattatagaacctacagtacttcaaaatgctaaatacttctgccgtaatatgtaattcttaagtttaaaatgaggagacgtccatagaagaaccgagaacagaaacttgtaagccatctgttagaaaattggcagtatgtatagctgatcaccttgggctggttgcacattgttggataaagcaagattaaacaaggtattacaaaataaatgggaggtcagttaaagtacgagataggtttggctgggtgtggtggctcacgcctgtaatgccagcactctgcgaagccaaggcgggcagatcacttgagctcaggagtttgaggccagcctgggcaacatggtgagacctcatctctacaaaaaatacaaaaattagccaggtgtggtggcgcgcacgtgtagtcccagctacttgggttgaggtggaaggattgtgtgagcccaggaggtcgaggctgtagtgagcagtgatcacactgctgcgttccagcctgggtgacagagtgagaccgtgtctcaaaaataagtaataaattaattaagtataagataggtttggggcaagaatagttgcaaggagtctagtgttacgcgtcaagtgtctgttgagaggacagtggcttggccctttgaaaattatttcctaagactcagtgctaaattacatttcttttaatgtaaattttcttattggcagtataacatacatacagaaaaattactagagtatcacatcatgataggtttttcacaaagtaaacatttcacacagtaaacaaagtaactagcgccccaatcagaaaaggtaattgttattaactccccagaaatctcttcatgtcctcttctagtcatagccatggtcctaatttctaacatcataatttttaaaaaatatcggcgtgtaattcacataccatcagttgtacccatttaaagtgtacaaaggttgtcagcatattcacagttacacaaccatcaccacagtcttagaacactttcgtcattccaaaaaagaaccccgtttgcctgtgtttaacaatttgcctgtttataaatggaatcaaacagtatgtgcttgacttctttggctcagcttaggggttctgatacttactcatccccaatgtgtgtagttgtggtttttcagtcttgatgctgtgtctcacaatttattctactgatgatggacatgtgagttgtttctggtttttgcatggatgttttatatgtgtttcttggtgaatatacatctctctatttatattcacaagaatatataccaaggtatgaaatttctgggacatagggtatgtataaacttggctattagagttattgtcaaagagttttccaaaggaaaaccttataccagttaacacattcccacagcaggagttgagagttccagttactctgcctccttgccacacttgatatatcctctgtcattttcattttagcccttctggtagtcataatggtatcacgttgtggctttaatttgcatttctctaatggctaatatagttgagtaccttttttcatatgtttaatggccatttggatgttatcttttgtgaagctcctgttcaatgcttacttttgtccatttttcccctactgaattgcctgcttttttctgactgatttatagtactttctgtattctggctagatatctgtattgcaaataagcctcccacttggtggccaccctttgtgccaggttaccttttatgcattggagaaataatcttatgactgactcagatattgacataacctttgccaactatctttgcccaatagattttataaaaatcaaatcatatgtcaagcttaaataacaattcttcctcttgtttaatgatgtcatcatagtggcatgtttaagagtgtaagatttgtgagaagaggaaattatgtgaatgtttgcacttttttgttaactgttgtattggattatttcatttcagatatggctgtttttgttttgcttcttttgatgtgcaagttcatgtgccataaatgtgtggtgtagacactactagttacttacgcaatgttcattctctctccttctctactaacagagccctaatttgtttagaactgtaatatgcacagttaaaacaacttgtcctctcaggaccttttgcagttagggttggtcgtatgacatggtcctgcgaagaagatacggatagaagtctgtgggtgagtgggactgcctggaaacctgttgctttactaagagaaagagacagacttagctgacatacatactttgtcctttgcctgtgatcatgatgcgtagatgcttggtggccatcctgcaatcttgacaatgaagatgtgctaaagatggcagagcagaagataaagcttggcttttctttttttttttttttttttatggcatcatgaaatcattttgtataaaacatgaactgcttttttaaggttctacagaaaaacagaagagataggagatagggagaaagagaaagttgttgcgggggagggagagagatttattataaggaattggttgaaacagttatggaggctaagtccagtgatctgtaccccgcaagctggagacccaggaaagttggtggtgtagctcccgtctgaatccaaaggcctgagaaccaagagagtcaatggtgtaaattctagtctaagtccaaaggcctgagaaccaggagagctgatggtgtaattccagtctgcaggtggactggagcgtagagagagctaattctcctttaccccatctttttgatctattcaggccaccagtggattgaatgatgcccgtatgcactgagaagggccatgtgtttactcggtctaccaattcaaatgttaatctcatccaaaaacaccctcacagatacctttggaatgatgtttaaccaaatatttgggtaccgtcttccccagtgaagttgacacaaaattaaccatcacagctgccttcctgtgggcctcatgttatatgagaacagtattgggtaagttgggtttccattatattctgctgaactcagtccccaagcaatgtatgcattactcaaacttcttgaccttcaaaatcatcaagtgacttgtggcaagtgtgccatggtgctgaggtctttgttcatttcgactggaataaaatcggactttgccacatcctcctaagataaaatagatgtgagagcatttacttgaagtggttctgtggatgttggtacattgtgatttcagttacagaaaagccacagatggaactgatgttaaaagcacctcaaggacaaccaggtactggagcagatgccaaaaggagttcttctgccctgtcatcaagattctgaatcactcaatttattggacaaaagcatttagctctgattcctcttgtgttctctccaaatctccatcagagtaagaagagactttgagagaattagtctctcttctgagtatctgttatagatgtgaaagatacttcagaaaatacatggctctggtttcatcattttgggaaaagcagcttgatatgctttgacttgttattactacagttccgtctgagatggcaactcacgttacactaacgtgggccaaaaaaaaaagtgcttgtgtttttgtcctttatagagttttttaaaaattaaaaagctaaaaattagtttgtcttaaatattatagcatagattttagaggtctctttgagattttagaacctgttagttcatcctttgattaggaatttctagccaggactcaggataaaggtccaatttctggtcagtaggggcgctggttgtgaggctgttgtctcagctccagacacatcttcatactctgctttgtcatgagactctgcaaaccacatctttcctttgctggagagctttttgttagggtataccaggattggacacgagagactggaacctggaggcgggaagaagggagctccccccttctatttgctttctgtttctaacaacgatggcacagccgtggttttccagaagctgagcagtggctgttcactcctgaaggaatagtgggttccagggtgcggttttccacacttgtagaaccagcttcatctctccactcaaagatcaccgcaccgtcagccggtggcgcctcttcagaggtttgaatccgagctctgtggagtccccacatttctgaggtaccagttaccaggagagtggtgtccacgcctgagaggtttcactcccagctcctggaaaagcttccacattttaatgatcccagccttgcctctggttcccagccctaagcgtggcggcttcctattgcagttatctctgtgatacctgagagtcccctttttgcctcctacctcttcactatctgttgacagttgtttgttcaatcatctctcttagaataattgctatggtcttggtccgagatataataggcaaccaggttttcagctcctggaaaagagccatgagacccaggtcctcttctacgcaatcccaagctcaggtggatttttcactagctttcctcaatacaacatagggatccctccctagatgatgtgattcacccccgtggggatagctgcgagattaggggaaactgatgttttacctacaccctggtcatgaagaccttgctttgctccctccttcattcctaccctgctgttcctcagtctcctcaagacctatgtccaatcagtctgttttctcctacttaatagcaccttctcagcttcccttttctttttagtcagtctggatcccattaccatcatttcagtcaccttccagtcccttttactctcacatgtttttgttgtcctgccacacctgctgacaaccccaagccagagtcattccaacctctctcctcccatgctctgacatgatagtagctgccctggaggaaattcacaatctaagcatccaatgtcagctggatcctccctgccatagctctcctgatgcctctgctctatcctgatcctaccctgctgcctcctttttatctcacttggagggtggcctaacctacccttctcatacagcttgaatatggaggcaatcttaaggcctctttctacctccaaatctaccagcatcttgtcttacttgatttggagaaaaagctgttcctctttctgtcataggctaaatcttccactatcctgctttcttatctattatgttatctaatttactttctattggccccctctacttccagtgtaattaagtcttataagggcagggaatttgcatctgttttgtttgtgcagatgtgaggtgtgaggaaaggaaagctgatgaaaaagaaagcttggatgattcccagatttttggcctgaacactggaaggcctggagttgcctgtaactgagctggggagggccattcattggtgaggtttggaggggacagtcaagagtttagttcaggacatgttagcacattagacatccacgtggggatattgggtaggcagtggaatgtacaacttttagagaggaggtctaggatatagggataaatatcagtctcatcagcataaagatggcatttaaagccatgagagtagatgggaactttaaggaataattgtcaataataaagggaaggagtctaaggactgagcccggggacaccaatgccaagaagccagggaagaaaaactaccaaggagattgaaaaggagagccctggactacgataccaggtggaaaaccaggacaatgtggcatcctgacatcccagtgaagaaagtgtttcaatgaagtgtcccacttcttcacactccaaagtgtggctggcaagtgatattagatgagaacagagaattaaccattggatttggcattgcagggagtcatcgttgaccttggcaagagtgggtttagtagagtggggaggggtgaaagcataattggagtgggtttgagagaaaatggataaatgaaggagaaaacaattagctcgtggggataaaaatttatgaagatagaaatgggtttctgatttaaaaaatcaatcttggtgccattataatcctatgggctcttgaaattactctccacactgtgttattcttctgaatgcagtgcaggttcttcagctttgctggagtacgtatcgactttgctgggagcatgactttgtgcaaggcataaaggttatacctctgcagctcttctactttgtctctgccatctctgaccactcaactcaggtaaccaatgagagatgccctgttgatctcttatccttgggaataattttaatctcttcctcctgtttaatgctagtgtcctcctttccccataaatgtggttgtgtgcctgtttgtctcgtccatgagagtaagcttttaagaactggaactctgcaccaaatgtgcagtgaaatgactttgttggagacccattgtctgcctgctggccctcatcagtggtgacttcatattcctctttttagagagttttacatagagcctttttgaaatggtatcctgggaaaataaagagctggctgtttgtaatactttctaccaggagtggggtgttcactttgtgttctctaataattaaatgttcggaatcaccttttttggcacaatgaaagggcagataaacagattgatagatgaagaggtgaaaagtaggaagcagtgggaaagaaatgggaagaggatcttcctatctaccagttgctttcatgtggtagagcttaatgagaagatgatacgctaatttcctgagctgtgacatatttacatgtagaagacttacgtgagggccctttgtcttttttcaagtgtagatgattttgagatggcctggttgcttccccaaggagaggaggcttcaggctctcccacgggcagtttttagggtgtaggaagtagagaacactctcttgatgggctcacttccagatgtgattctcagtggattgttttccttttcggcagcatcaactagctctagtggccaaggcttctgtaaggcttcccatccaggagtttttcatgcagggatgctattggaggccagacttccagttttgctaggaggagatgcctattaagttagggggccagggattcgattgcagcagtcactactcaagtcagtcagtcaccatttcatctgtaagtcagggactctttgtacttgcagtccccataggcgcttggctctcgtgatgtgatttagagagtcagtggcagggtttgagctgcagtgtgagcacagaggattaacggtagtcacagagagcctgagcagcctgtgtgagtgaccctctgcatcctacatggaatgagggacaacatggagagactaaagacgatccctcaaagcctagcttccttcattgctcctgccgtggactgtcttgcagggacagtacacatgctggcacatattacacacagggagccgtttgcagtgaatagtgatgcaaaggctgagatagtatcctcataaagattgacctctaatctcaagtccttttttgtagtagcaggaatacataatttagacaatattatcttgcacagttaacagaaggaaactagaataagagggaattcacctcagctgaacaaaccaagcttctctgtatcatctagcaagctcataaaaatgccatctatagattgactttaataaaggagcccactgaggacacaagcacctgaattacagattcccagtgcacacgcaagcatttatcgctgacagacaaaggaacaaaatctccaggaggcagctgggatcttttcattttgaaaatgctttaataagtgttgacaacactgttttgcaaaatgtaaaggtactatacaaattcttaatacaaaaagaataaattaaaagcagatttctttttttaattctgcaactttgtctacaacgtacatctttttcattgattacagttgaacagaatccagtaaaatcattttacatgctctacagtcagtttcaggagcaacctaatcttttttcccccattattaaactagagtccattttacacaacttgtaataaactattgacattaatgtatatgtaaaactttacacctagttaactaagcagtaactggtcatctgatagcacctggatggggtttgctatatttagaactaaactaatactgaatgaaaacaaattggaattttaacagtttcaacactcacctgcatataataaaataaaaaatcaacctggctcacaacatagtctgatgtatgtgttttcaccagtcttctggctgaaacaggcaatttcttttacgcatccgaagaatccaataggggctttatatcagaccaaggacttcgtatttcaccttattttgttttaaagaaatagggataaagagtttgcaagtgcttgtgtacaataactacatcatttcccaccacactgatcattaatcatgtcagtctcaaaggactaacgttttatgtacattttgtattaactgaactcagctaaacagtaaaacctgttttacttaatctctgtcttgactaccagactatcatgatgtttgttggaactgtaattcctgctctccatttctctctgtcccccaagttgaaaatataacccaaatctttagaatttttgcctctcattccttgcaactccagtgggctagaatcttgatccagttttctccagactagatttcaagctactatgcatgatgtagaacatgtaaccatgtaacctcatcagctaccttttcccttttgacttttcctgttgcacacagttcagtctgactatccatgaatcttctttgggagaaagaaaaatggcccaatgtataatgtttctgaatggggaagggagaaaaaaaaaaaatcactgttctttgtagctctaaccatgaaagtaaaagcaacaaaaatatcccccagtgaatccctagaatcatttaataatgtaaccggtatctctttatcctgcaggtgtacacttaaagcgttctgggaatatgaatcccttctgcaccctggaatcaccagtccagccatgcatggagctggggaaagcaggccctgaattgtctagagagacttggtggaggaggccacggcccgccttgtccctgccgggtcccggccaggtgtgtgtgtgccccagctcgactctcggtggtctccaggctgcagcagaaggaataccttggtatttgtttcattttagtgtccatccttacccttctggtctggtagagcctatggttattcttggattccacatacatgaaaagcgaagatttttctttgtttttatgcttaagctaacttcagttctgctttcccacaaaactacccccaccctggctcctgtccctggctgtcaatgcctttccaataggaagtcattagagtgagaaaaaaattccacccccaccccatccccccaccacttgcgccaaaagcacagcataccacctctgcggaaacctttttgtgccatcttgaataacccaactaaagtcgtgcacttgttactataaaagtatttttgaggcctttgaagattgatggctttccagttgtgtttgaagcatagctcaaaacatgtaaacgtgcagctcccacacattaatttttttcttctttcctcctcttttggtatctgcacacaaatgtggtgcatgacagtaactgatgatgtagacacatgggccctttgggagctgatatttttttcaaccctgctctgcctgttggctagtagacacacgagtcaaatctttctacctaagggcatagttgggttcttggaataagtgacacataggagaagtcggatctgagctcttttgtcacacaagtgctaacgaacagaaaatgagccacgacagttaaacactgaatggatcgcaatgtgcttttcccttggtttcccataaaaacgaaaatgaaacaccttgtgcaaaaaaataggatacgcttttactggttggtttaatgagagagaaccacttttggccattatcaccttacgttactacaaatcctgaaaggaaagcagctttgagtcttgggctcggctgaaccccctgcatggaccggggctaacagtaccctctacgactcccacaggtctctctttgtgtccagatggatggcgactgtgagtcagcaacgccagccaagacttcctcgcctttaccgtggcattggggcagtttttcaggctctctacggagagagaagtgggccagtaagggagagggctagagagaggacaccagtttacatagggttgactttcacttgtgtgtagtagcagttcagaatttaaaagaaatttccttgcagaaagaatgtcttcctcttggcccctcttaattttttatgtttttatttatttttaatctttggcagcatagaactgattgtggtcctccgatgcatttctggtgtcgagaacttcctttctcaacctccccttcccccatagccatccccacaagctgtcccatcaaggaatatttcaggtgtaaactgaatatgccacgaggcctcctcttcatgaagtgcttggttggcctacgtatgggtggcaggctggacacagctgaatcgtctttctgggtcaccctgtaactcaagtcccctttcccgttctctcccaacgctacttatccgcaggaattggatgccggctggcccccctgatggttcctggcctaggggctgtcatggcagagggaagccaccaaggtgccattgaggattggtgtctggctctctatgggcaagagcgccaggggacacacagtgggaccggaaccttccagaatgtctcctcagtcaggttttcaagggggagggaatgcggagacaggagaaaaaaagtgctgagggccaaagctggtgcagggtgacggtgcgtctgggtaaggcaaatgagaggcagtgaggtgatctcagaatggcgttgaggcggtcagattaggccgggctggctcacacgagggtcccgggcttggctttttcctgcccgtaccactggacatcagctagttctggatagagggaggaatccaggaaacagctatcattgtagctcctgtgggaggcccaagaaaggagatgagacagttagttagtggaggaggatgggttcagccaggcctgcactgagaaggatatgttcaccttgacagggccctgtgctaatcacgagtctttcctgttcggagcagtgaggcctgagaccctcaacagtgctgtgtgtacagaaggcccccagaatccacacaaaggggccgcctgaaacctagagcatttgtgaaggaggaaaatggaaggtaacttactcagtgcggtggttcttcagcgtggctgcatccggggagcacctgggaactcccagaaatactcatgcctgggcccaattgatttggggtgtgtttgagcgctgagaactgtcaaagctccccaccaggtgattctcagatgcagccaaagccagaacctctgggctttcctcaggggacttttcccacacgacagctgcccgggttgtcctccgtgagaccccagggctaacagatgtcactaggaaatttttattctgtcctggaagaacattcaaaatgtgagttttccctatagtgaaactgcggtggtattttgaattgtgttttaaaagtttaaaaaaaatcaatgatgactttgctttattctaaataacatgcattgttttgtgattataaaagtgtgttcatttaaaataggaaagtctatagaagaaaataaaaggcttttttttttttttttaagtattttagggaggtatcaccatttaggttgggtagaagtaattcttaaatcttaagaagcaatcatagatatgtggaagccaatagtcattactagggatcatgattcggaaaaacagcctctcttcaatgatcctgaatgagccctttgaattcctctcctgcaactgatctccccatggggagtggtgagggatgggtgacaggaagggaccctaacccaaagtagttcagagcgggtgagttttaggagcatttcggtaccaaacacagcttcacgattgagaatcatcagtcatccccagctttctatttcatttgctaacctctctaggaacaactggatgttgtaaatgtttctcatctggccttaaaatccatgaaagctggaaaatcacaaggcatctgtgcatatactggtggattttaatgagagtcctgtgtttggagcaccagaaataaaccagcttcagaagcaaagtaagaaaaggcccttgattatgacactggccatgggtattactatatgtaggtggtatgtggatgattctgggacacctgtcctgcaaactttgtctccaccctaagctgacttttgacattgtgcctgactgaaaaacttctaatgggagaggtggttgggccttgcaggggtcctatgtttttcttagggggacagtctctccctaactccacgtggtcctggtggtgctctccaccatggcgccatcctcactcccgtgggggccaggggacaaggaacccaacggggccgggccaatgagagtcccccgatcaaaatccctggttcaaaggtggccacgtgcctgagcagctttgaaaccacaaggatgtcatttcctcctgagaactaggttaacaggaggaggaagcagagctagagatggaaggagacccagccagcccgggctccagtgacatcggctggtacacgcttttgtttgcttacgcttgttgaactgagtttttcatatgtaactaacgaatactggcacatgtaagtagtttcttaaactgttgatgaaatttttgtttctaacacaaacatgatctgggtctgtttgggataaaacttccctaaggggtttcatgagatcttaggaacacttagccagtgtttcccaaagtagtcctgtgagttgctctgaggggaaaaaaagcttccatggataaataaatttgaggattctgcctttcagaggcctgaaatgtaaatgtatatgaaacatatattaaaggttctgagaagtcctggattagtttgccacagaacttctggaacagtatcacctattaacatccacagaacacactttgaaaaatactcttaaatgggctaatattatgaaatgtagttgactctcttgtatgttggatcctaaacagtttctggttgaaactattaaagttgagtcataattgtgacaacataatctgcttcagagggactaaaagtgcactatgtattgatcataaaggctcaagaaagaccattgagttcaaagcagtgatgtttggatcaggcagtagatgaggttaagggttcctgtggtggtttatttggtatgtgaagagcctaactgttggctggcccatggtgttctcctgtggttcattatggaggcttctgggtcacagaacccacatatgagagggcatcgggaggatctggatgatggggtgggagatgctggattggtggtttggttctcaggtggctcctagaggagccgcagtatggaaaccactggcctgctcctgcctctgagaaaatgaagctggaggaaaagatgtaaagatgtattttttccaaacttgcgatgttttatacagaatctttcttagtgcttccacatagttattgaagtacgtaaggtatttttaaagctataaatgttgcttcatgtattggtcttttattctcaagtctggggaagagacccttgttctggctgctcagctaagcctttgcctttcagtacaaattcaattttccggtagtagtcaaggaatgccatgtgctacgaaagagacccttaggaagcatttattcttcacaaataatacaaatggggccactaaatagttgccctagtaaaaacctaaaaacctaagtcagtcattcactggaacatgagctggggcaggatgaagatctaggtgtgctctctcaactgtgacccagaagagcagcttagccctgggcagtctgggtcacagcaagtggtgacttcagaatctgtgggggctttccactgcaagaatgccctttcccagggctatgctcagagatgtgtggcctgcaaagggtactggctaagccagggccgtctgataccagacagatggcaaattcacccacatctcacagggttttgtggtttataactgcttggcatagggaggtggggctgctgggagggaggaatttcaaactgaattatttttttaaacgtataactaacttacagaaccaactggtggcacatactggggttgttgaacagtcccacagttggtcacaaggccagaggataggggatgaggccctctagaggcatcctgtcttacctggtctgggaaggtgctgttgctcagtataatgtatgtgtgtccctgcatgtgcacatgtatgcatgagcatgaactcgtgtatgtattcgtgtatgtatgtaggtatttcaagcagtgcctacattcccaccgcagctctttcaaacctggttaattctacttctggctgtcagccctatctccatcacctttagcagatgatcgccctcccataccgggggagaaaaaggccattcttcctacttcaaaaatactgctctcatgacatcaccctggcactggggctgggggagggggtctaccttccttccaaagcctaagtccctgtcctaattgcccatctgtcaactttgcaatattgtcctaacttacttttcaaaagtccagttttttctctacaggaaacaagactctctactgttaaccacccctcacccttatctgtgcatccatgtttttgcacttgggatggtctctgtctccacctgtctaagccccctcctcccacggcaggcttctgagccaggctcacataacatctccgtgaactcgaaagtgaccccctcatttctgaatcctctcagcattgcattttgtttctaagtcttagagcacttaatacataagtgtagcagtttctcatgctccttgtatatcttctgataggcaatttgatttcaagcccttgtgtcccagttagactgtaagggtcctggggctaggaaccagaccaggtggtactgttatctgcccctgtgctttgcagatttcgacgtgaatcttgttaaatgcacattaggttcagtaggccagggtggtgcccgggagactagctttctaacgagctcccaggtgatggtggtagtgataaaaatgttggcttatggacatttggaaaagcagtgctcatagcttttggtactcagcacagctgttactcaagaatgctgggggtgcttctggagccactgagtcggcccttggtgctttgaaacttacattgcagtgatgctgttcttttcagggacactgattactcacagtaaaatgtctacaaatctttgaatgtagatagaacatggtgagtctaaaatatactttggggccaggcgcacagatcacttaaagcttaaagtcaggagtttgagactatcctggccaacatggcaaaaccccgtgtctactaaaaatacaaaaattagccacgcatgcacctgtagctactagggagccaggagaatcgcttgaacctgggaggcagaggttgcagtgagccgagatcatgccactgcactccagcctgggcaacagaacaagactctgtctcaaaacaaaacatactctgggggtcttttctgggaagcagtgttaggaatatcataattttgatgtaagaaccttcagctaaaaacatagttccagttccccatgtatctagaaataaggcataaatacagcattcagatgtatccttgtggaaatgatgacatggacaaaagcaacacatgtgggaccacagactcatgggcagtaggaacaaaactccccttacggtacctctattcatcagtactttggtgaggtggagactcagacccatccagaatgggtgagttttctgttgcttctctgaacaaaggaaagcaggaggaggaagagaagagaggtcatgttacagagagacactgacacagacacagacacgattagtagcttattaatatatccgaaaggcttgctgattagacacctgagttagcaacagatcatacaagtcatgcagtactttcagtccccataattgagtcaaaatacctagtttgttaggagggacgggccctcttttacccatggcctcattttgtatcacatcatagcaaacagtttatgccaagaaccaaaattgctgtttttcaaatttggcttgagtcctcactagttgtaggtggtgaaataggcaggtttcaagaccatcttaagtgcataggaccctgaggagggcttgtacatttcggagcctgttgacagccaaataatacaatcaatcatatatttggatcaggtgagactgggcatgattcagaaaagttggaagatctagagagggatcttgcaatctgaagtttcttgtttagtcactggaggtatgtattacatatatgaaagatgtgtcattcttttatgagttaatcttagaccccaaaccttgcagaggctgcctggccaaacaggtgagagctggggtgtgggtgggtgagtgttaatgatctaaaggacaaaggggcagctactgtccaacagacagcccaagaagtaggagcagacacaggaacaccgagctggggctccagtttctcttattttaaaaggaatcagaggcagcaggggatcgttcagtggttgtcaaaacttgagtgtgggtcagcatcacctggagggcttatcagaatgcagcctgctgggctcacccccagagttttggattttttttgtgttacaggtaagcccgagaatttgcatttctgacaagatcccaggtgaggctcactcgtgctgctggctttgggatcacacttaactaccggtatagtggggaaagacagggtttggggtcacagagggcagagctggaattccagctccctccagctgtcagactttgggccaggcacttagttcctctgagcctcatctatgaaacgaaaacatctgggtatttcccccgcaaggggatgatgaggattgtatgagctcatgtgtgttagaagctgctcgcagcctttgagtacacagcaagcactcagtaagtgttaggaccctttcttgccaaaaatgaaggctccagaaaacctggtgtaaaaaaattaccacagataaacctgcaggaacaaaaatgccgaccaggtgcctgtaatcctagcactttgggaagctgaggtgggtggatcacctgaggtcaggagttcgagaccagcctggccaacgtggtgaaaccctgtctctactagagattagccaggtgtagtgatgcacactagtaatcccggctactaggaaggctgaggcaggagaatcacttgaaccatggaggttgcagtgagctgatatcgcaccactgcagtctgggcaacagagtgagactccgtctcaaaaaaaggccaagtatgagagcctgaaaggcagacaatacagccaattctggaattgtgcttttctcatgattcaactcacagccagttgtcaggttttcccagacatccccctgatgctccaccaaaccaggaaccagacaaaccgaggaaggggcctccttaactcctctaaccaacagatgagatgttgacagaacctaacatctacttagagatgatgtctcaggggcaacagaagaggcaggtgctgtagggccaggcgggttacctgtgtctgccagaccctccagtagttcagaatagcctcactggcgccgagatgataatgctgtatgcaaacatgtcaagctatcaaagggagctgcctttcggtttcattaattttgttgtgtgcagcttccactgaaggcttcagggcacctgatctcttttgtgtgttgagaaagagcaagtgcttggccaggacacagccctttttcttgcaccctgagacatcctaagacactggctgtttcacctgccccagtgtatttgctgtcttcatcagctctctttctccccctgacattcttgcctggcattttgagtcagcctgagtataatccaaaccgaaatgaaatgctgtctggaaatcttaccaaagaagcacagtcccacttcgtgcttccatctccccacatcccaaggaccaccgcctactttaagagaacacagacaattcacctctataaaggcacagccaggaaaaggagtaggcagaggtgacagcagatcatggggcttctcttgaaaggaagacacctcccagtgatgaaccctcatcatccatttactgacatatccttatgtcaccaggatctgaacgtctatgacactctttcgagctgacacagtgaagaacatagaaggagaactcacccagtctgccaggttaggatgtggtgggggctgcttgggggggtggctccaatttcacttgacggtgtcgagcttctctggctttgaggtaaggcagctacatgcaggtggtgcaagaaaggcagagagcagacagggatcagacacaggtgaaagagcttgcgacttgttggctgacaccaacccagtggccagaggtcaccatttccagggatgctgggaaggaccccagagcagggtctcagcatccctatggcatggtcacagtgggcaaccatctctacatgcccccccaacctctgcatcccacccattccattttctacccactaccatgcaccttcattctgagtcaagctgacctgggatcctaggtccccgctttgccaccaggaggtaggcatagggatggtgacggtttctacagcagcaaagaatctgatgtccccatagtcctttgagcgagacctgagcagggctcatacagggagggcatatttctctggccccagggcattttcagtgtggccctgttatgaaattgtttctccccattgtgaagagagggcatccagaaaggttctcagagcctgctctctctgctgtttcaggcttatcattgctactgtagggcgctttgaagggagcagggcttttaatagctcatccaaacctgaccactacgcatttactgatgtaggcagcatggaagtccagctggaaagatttagtaggaagtcaatcctacgtaaatgcatcctttgcttttttggtaaaggaatcctttccatcagtaaacctcagatacagcttaacaattttagtctaaaatatgttccaaaagatctacctcatctctttacataaagcaaatctactagaccagtgctgcagttttgatagaacataaaccctcctgtttgttggagatatttacaaaacgttggttctttatctaatagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacgtccacggggatgtggggatagaatgccagagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaatgagtggtttcttccttttttttttgttttttacttgattcaataccgcccaatgctcttgagtatgagaatataaggtaaactttatagaaattttcagatataacgtcaaggatatttaagacacttaaataatagtttgtggctatggcataacatcatcatcgaaatgggaaagccaggagcagccaggaattctgtcaaacgcacagctctggcactgtttattagccagtctgcccccatctggggagacactggccaaatctctaggcttgacccaagcccatccccaacccagcttcctttgcaagctacagctgtgggctttcactgggatactctcctcactagggtaaaagacacctttggttggataaacccagagacattacttttactttacctaactaactttcttagatttctgtctttacaaggagaaatgggagagctggcccagtgcactctggagggtcaggtgcacggttatggtgcaagattagggttagaacggggcggggtcaacaaaggcctggaagacctcaagtctcccgcatctaacagcagcgttcccagaattaattaatgattcccgttcctcactgcacccagtcctaagggtaccttccccgcggtagcccttgacaccggcaagcagttcgccctcaggtcttcccgcgtgcacctggccgccccctctcacctgacgtggccttgcacatctggggcatcctggtgaccctgctgtgcgccacgaaggtgctctgggaggaggtgctgtactgcgagccgctgtccgaggaggtggagctggtgtgcgacaggcggctgtgctccttgtgcgaggcggtggaacgctggtaccactggcgcagctcgtctgagacggcggcacggcccgcgcccttgtcgtgggcgccctcgcggcccagcgacggagtccgcaggatctgcgatcgcgacggcgtcaggcggcccgtgtcgccctcgtcgccgccgccgccgcgccagctctccttgaacaggccgcccgccgtgtaggagttggacgtcttgaactgagccttgacgctgtagtggccctcctggtcgctctccaggctgcgcaccaccacgggcgtggcgccgccctcgatgtacagcgggtactccttgatgcggtactgcgagctgggctggctctggctgtgcaggtacacaccgccccccgcgccccccgcgccccccgcacccccgcgcgccgccaggttgggcatgctgcccgagctggctgagcccagtgcgcccgccgcccgctgccgctgcctctgcctctggcgcgccttggacggcgagtcctcggccagcgtggagtagttggcgttcatctgcgccgggtagtagtgctccgagctcgagtggctggtgcacgacgagcagtcgtccatggggtctgagccgttgctgctacgagtccgcggggtgtagaagtcggggctcccggtgtcgttttccgagcccaggagcttgccctgggactccaggctggagctccggtgcctaaagtgcagtgcgaggctgtgcagtcgggtggggctgatgtccaccgacctgccgggagacgacccgggttggtctgggggtggggagtgggcccaaggaggggtgctccggggaggagggggtcctgaggagggcactgggtgtctgcacgcgggcgcaggccccagcccagcaagccagagtctcactcagcagggctgccccagggatccgggaactgcccattgcgggaggtgaacctggggtctccaccatgattcccagtgggaagtgggactgaagctaggactcacagaaaggtttcgatttctgggtttttttttttttttaaataattctatagacacaaagagaatcacagaatccttagtatcatgttaaaccagatagggctgggcactgtggtccacgcctgtaatcccagtgcttcaggaggctgaagaattgcttgagcctgggaatttgagaccatcctgtgcaacactgtaagacctcatctcttacaaataaattagaaaattagctgggtgtagtgttgtacaccaggggtcccagctagtcaggaggttgaagagggaggatcacttgaggatgcagtaagctatgatcaaaccactgcactccagcctgggcaacagggcaagaccctgtctctcttaaaaaaaaaaaaaaaaaaaaaaaaagaaaacacaaaccagatgaaatgtccctatttacagatcagataaaagcagtcctacagaggcccttcatattgtttaaccaaatactattacatgatccatataaatagactcccctttcctgtgaaaactgggaaatagaaggttggtggcaaatgagataattaaacaatgaatgatgcaaatactcaccataccattactttataattcattctgctcgtttgagtccactcagggcttagggaagtgcaaaacagtatcacatggcagatgatgttgcccgatgctgggactgcatgtgaacttcacagcggccccacgggccaagcacaggaagaggcgagtcccacttccgactgccactcagaagggggatgaaagcccccatcacgtggccctccgtgatctggtttgcttctttttagaaaaagaaggtgtggctaggagcggtggctcacgtctctaatcccagcactttgggaggccaaggtgggtggatcacctgaggtcaggagttccagaccagcctggccaacatggtgaaaccccgtctctactaaaaaatacaaaaattagccaggcgtggtggtaggtgcctgtaatcccacctacttgggaggctgaggcaggagaatcgcttgaacacgggaggcagaggttgcagcgagccaagatcgcgccactgtactccagcctgggtgacagagcaagactccatctcaaaaaaaaaaaaaaaaaaagaaacagaaggtgtgattcactgaagcctcatttttgcctggctcttttgctctttatgaatttacattttgaggcactaaaggaagtccagtataaatttaggcctcagtagaaagatagaagacctcttcccatgctaacccagccagcctctgtggcctctgctttgcttaggaaactttccatgctccctgtctccagaagcccggggattctttggctgactccaagtgccctgtgcatgggtctcttggctaacgggggttgactgctgccagcttggttttttattccgcttcatttatcctcccaggttcaggtctgactgtagctcatccattatttgggccagcttggggctgacaatgcccaattttaaaaaggaaggcttggtctgagcaggaaggccaggcagactcacctcgtggaatggacgtagtggggactccggacccgcaggtctggcgtggacggcatgctggactgggagttccagtgcgggaggccgcggatggggctgttctgcaaggagttgcttcctccgccggcttccgcacagcttcctgtgctggggaagcgcttgtggctgctgcaaagccaaggatgccacgtggtcaccgccagacagacagcacctttcctggggggctggctagttcaggacaatgatcccagcatgtggggaaagctcgcccgtgactcccacctcgcttggtcagacctctactgtggttctcagcctttccccagcagggggtatgccctcccccctcccaacctaggcaatatgagaggaaaaccctggtcagccttctctgtgtcaggcagtgtgacggtcctgcccttacagtttttgttttccaagaaacaaatatttacctgtcctggcaccccccttggagcttggtagggtgattaaaggaaatgggaaaaacagagaagcagaccgaaaatgccttcccccccaaaaaaaacctccctacaaagtcagcccggtaatgagctgataatacacagcttggattacagctgcttggctggagaattctgctggatgagggggtagagttctgaaccactctgcatttgctccgagtggactttcacttgctatttcagaatagcgctgcctgagatttcctaattaattcctctggaatttaacagcattcaaaccatctgccatcacgttgattgtgggccaaagccccaatttctctgagtcacaaaaatgtacctcaacagtgtcggcagcagagggcgctgtgagcacggccccgtgaaaggcaaaccccacggggaggaactaggttgatgtggattttgtcaccgtggatgctacttgggacggccctttgattcttccagagcatagagggaggcctcatttggcctcattcacgatgcagctcacctggaatggctgtgagaggagcgcttcttgaccttctcatagggttcatctaaagaggactcactccacattttgggcttgatgggtgacttgtcatagtcgttgcggtgatagtgcatctgtcggagtccctccagggactggggaggaggaggcctgttgtgcgacggtggccgaggagggagtcccttgtgaggagaatgtaggggggatattgtgctggtaacctgagagtcttctgcacaaagacaggaagagaggaactgagccccggtcatccttcccacaggctgagacagaacccctacacccctccacccgcaccttggagccacacagccaaacccacaccttcacccctgtgatgagaaaccctgaaactcttccccagttgccaagacaagtcaagacgagtcaaaccaaaccagggcaagccaaacctccactgcaggcgggattgcatgggaagagatgcgtcacttttgattagacacgaatggagtgaagtctgaacgtcattaaataccaccaacaaatgactgcttcacactaaacagcaaaatgtagttactgctgtagtgctaagttgtctttcaacagatgctaagcatctgattcactgtgggagggtctgagttctgggagagttttgtctgtttcatctgctgctagatcctcagccgacacatagtaggtgcttgataaccattggttggagaagaaaaaatgaatgagggtctatatgtccattgtaaatacctgctgggtggatcgggtgtctactctgcttttttcccccagagctgtgtttattctcttttaatctcttcctctatattttaattttgaaactgccttaacttttttaaggagatgagctacaaagattatgtattaataaatgattccctgcctccaggaaagaaatgatctaacacgtcagtgcgctagaggactttcagaaaaagcaaattcagtgagtctaggaggtgctgtgggagaggctggtcttgaaggggcttgagcagtgggcaggcaaagaggaggaggaaggaagggcttgaaccaaagtgtggaggccctgagggcagggtaccagctgcaggcacatctggccaggcaggggctggtgaggaggggcagggggagtaagggcagagctctggccagcacagccgccttctgtgtgcaccatgtgagccaagagcccgactgatgggggcctggaattccgagttgagattttgaaaagccacaggaaaactttgcgatgtcttaagcacggatgcgtcggagtgaaaaatcctgttttagaactattcacctggcagtgttctaaaactagaaaggaagggagagagactagagagggggatgaatgaggacttcaggctagggcaggtcagcattgagaagagagaggagggaacgattcaggcttcacagggaaggcagacatgggaggtggaggggaaaaaagcacagaagcaaaccttacaaccaaccaactaccattcacttgcccctaaatccatttccagcgacttgtttcacagcctaattctcagtcccccagccgtggacacccactatgcacccactcctcctttgccctcaaatcagtaaaggaagagtccccagaaagagaccctgcagtgggactgtggcaaaaggatgtgccgacacctgtgaggaagtccaggggtctgcatctggaacacggggaagaagctggaatcacggaatgatatctcaaaattaccccgtgacattacctattgctccaggcacccctctactaccaaggaatctctcaatttttcttccctttccaggggagactgggatactcagaggccaaccgcagggctgggatctctgatgctcaagccccccatttccttgtagcccaatggcgtccccggcttgtaatgaagcagacaaatatattccaatctgatttctaatagcacagccaaggtgactgggtaaataatccgccagactttcctcacatcaagagcaatcattattattattgcaattatcattattactatgactagtgtggacctttcatgctttccatctgaacagccacttatcactgcctgcctgaggtttccatacagggcaaaaaaattaactgccacttaatatatttccatataattaatgtacccgcctcccagtacgatggttaaacatccacaggagtattctcacatggttctgggtttggaattctttcttccccgacgtatggtggtgatgggggttgggggagggatcagttctgtttttttaagaatttcccaagaaaatatcctaactgccaggttttaagagttcagtgggaaataataagacagttttccagcctgagtgtgtatctactgggatatctcccctcttactttcactactgtcttgggaagcaacagagggtgtgttccatttcttctcacgatccttacactctcctagtgggtttcaatctttgatttgtgatctaaatcaatttctacccttttcttttagataccatgaatactcaaaaggaagctatgcctagtgtgtagattctctgtctagctaaacgtggttttgggccaggtatggtggctcctgcctgtaatcctcccagcactttgggaggccgaggtgggtgggtcgcttgaacccaggagcaacatggcaaacccagtctctacaaaaaaatacaaaaattgccaggtgtggtggcatgctgtagtcccagctactagggaggctgaggtggaagaatcacttgagcctaggaggcagaggttgtagtgagccgagatcataccactgcactccagcctgggcaatagtgtgagaccctgtctcaaaaaaaaaaaaaaaagtttttggcttctaaaaaagtaaagcaccactcactgatgaaaagctctaatacacatgggtttatgcagcacctacccactcccaaccaaagaggtgaatactgggaaatgagagagcttgcagggagcccagctgccttttggcctggctcttgcctttacacaaggcaatccccagactacatagaaattcatctctgtttactctgagctgtaggtttgtaagcaggaaatgcataaacctaccatcctcaagaacaagggcatctgagagggagctgtcttcactggcaatgtttccatctgagaagacaaaaagcaatagcctatgagttcagcacattccttcagcaaagccctatctgtaaaaatagcatgtctactaccacctcatacctttctcttcctaaccagaaacaacccaccagatacaataaaaatgctgttgggtgtttcttttgtcagtccccgtggtgggtcattggctcagcctccccaccccgacactgccatgtgcccatgtgccctagcctttgtgtgtttgtgccccggtttcatagaatactgcaatgcagagtggcttcataccgaatataaaggctgccccagcctgattaaaccacatcattgtccctgcacaaacccagggcgtgtaccagcaaaaccaaaggacgcaaactgcttttgattctacaaatgcgaaaccagggtaggcactttgctttgcttctgtggcaataaatggcttctcaataaactttgtaagtcattagtagagaaaacaagcgtgctaaatacaggctccatctctccaaagcttatttttatagatgccattcaattaaccgggagaacacacccaaaagggagatggtaaaataatcctccctgtttcactgctggggaaactgaggggtaggaagggaagagtggtttgtccgaggtggttttgctctccagcaatgtgagcaaaggtcccaagtcttcagattccaagtttggtgttttatctctaaaataatacgctaaggaactagcaagaaccttaattactcctctagttcaagtgggtccttggatgtttctataggaaacatgtttctgttgggaacccctaagtgccttggagggggcagagggtctcaaatggagtgtcagaaagaggttggctgagggagctttactaggaggtaggggaaaagttgtgtggtcttggccaaggacaacaggatgagatagggaaagatggtcattccaaatttcctagagcaaaagaattttaaaaaattctctttttaactagaaattcactttatttatgttgcatgatggactatgagcaaccaggagctctgacttcggcatcttggaatcttcagcacatcactgctacgctaggatgctcacgagtttaggctgcaaatctgcatctatctatatttatctatctatgtaattgtggtgaaatatatataacatcacatttaccatgttaacatttttttttttttcagagatgagtcttgctatattgcccagactggcacgcatggttactcacaggtataatcatagtggactacagtctcaaacctctggctcaagtaatccttctgcctcagcctcctgagtagctgggactataggtgcatgccaacatgcccagcttaactatttttttgtttgtttgtttgagatagagtttcgctcttgttgcccaggctggagtgcaatgtcgcaatctcagctcactgcaacctctgcctcccaggttcaagcgattctcctgcctcagcctcctgaatagctaggattacaggcatgcgccaccacgcctggctaatttttgtatttttagtagaaacactttggtcaagctggtcttgaactcccgacctcaggtgatccgcccgcctcagcctcccaaagtgctgggattacaggtgtgagccacctcacccagccccagcttaactatttttaagtgtacagttcattggcatcaagcacattcccattgttgcgtaaccgtcaccaccatccatcttctgtttgaataatattttcatgtttccagactgaaactcggtatctatcaagcagtaactcctcattcccctgtcccctaagccccctatagtaaccactattctactttctgtctttctagagcaaaggtattttaaacacacatacctttatgtgtgtttaggaggaaagaatgcttgatatatattttcaagaattcactgacttagacaagaaggattctaacagtttaggggacttgatgctttgtgggtggattttgggggatttccttctagaatttaccaaaggtcatcacccaaattcctaacccatgactggagctcagggttccagataatcagatggtccagtctccccaagcttcagctcttgggataggaggcccctggcagcataggggtcagtgggttggcgggggccgctcgaagacagggatcactgctgctgtgtaccccagccccacctgtccttccagacttgagtaggggtggtcaggtccctgagagtgtcagagcctggtctagcccagtcaactcagctcagttcacagtaagggctgagaagaatgctagctcctggctgcaggttctcccagggaggaaaccaatagtgataccaacagtttgattcgtacaatcccttcatctgtgtctgagtccacttggtttctctcatgtgggatcaggccttactcgcttcattttatggatggacaaatgaaggcagcggacagttaggcagctgctcaggtcgtgcagggaccactcgtgggacctggcgtctggttgccggggcccgggcgtgggagtggggtgggggcagcccggttggcactgaccgtctatgatcagcgaagccctctgggtgggtttcttcccagacttgatgcggttctcattgattgcattttcaatctcctgcagtttcttcagtgcattcagatacgaggttttcctttgtttcttcagttttttgctgacgttggggtcactggctaggcggcgggcggcctccgtaatctgggactgaatggcaaactctcgttccaggcgttccagctcagcttcctgtgggagggaaagcaccggtttgggttactggggatgctgagcagggagaccctcatccttccctcccctgtcccaaggcaagtccagttccatgggagacactcttaagagtagccccactcctaaaatctgcacccactgaagtccccaggcacacccactgttgtaacccttgctcctgttactttctgaagacaagtgttggtgtgaacgctgccgccatcgctgagaacagagttcccacgatgcaggtttagggatcgcttggctgtgtttcgactgtctccagcaaggttcatcaagacaaaccaaagcctttggagagattcagagcccaagtgactgtcacttcctttccattttggatgtaggatgcagcaggatttttagtttctttatgccattcttctctgtggacttgctaccaaggagctcacacacatgagctaatgcacgggcctctgactctcacactgtgtgcccctcacgtgtgcctaactcacaggcctctgactcacatatcttgtctttccctgtacccccactcacccgcgtgtctttcgggagcttttcttttcttttctttttttttttttttttttgagatggatcttgctctgtcacccaggctggagtgcactggtgcaatctctgctcactgtaaccactgcttcccaggttcaaatgattctcctgcctcagcctcctgagtagatgagattacaggcacctgccaccacaccttgctaacttttgtatttttagtagagatggggttttaccatgttggccaggctggtctcgaactcctgacctcagactatccttctgccttggcctcccaaagtgctgggattacaggtgtgagccaccatgcccggccatgggagctcattttgcaagctctggctgtccctcccccatctgcctattcatgtatactctgctaggctacagccgggcccttcaaggggcacaaatggacagtgggtggtggtggaggcagtccccctcccaccccacccccccagctcacttgatgtccttcccctctttttactgtagctccctcccacctctattcttcctttagccaagaagtacggatggatgagattctcctcagagttttgggaccgggaagaatgaagctgtggctgtcaaaaatgcctggtggacctagcggatgacacctagacagcatgtttgctgctgtcctctatgctgaccaagcctctcctctgcagatgtatgtacaccagctgctgagggatggggggaggtagctcatgcatgtgtgcgtgaggatttggggatgaatgcggaatcccccgcaaagcgtcagattgttcatttttctatttcctctcttctctagtaaaacccctccggatcagagctagctctaaacagcaccttgtcggttgagattttgagcaacagggtcctgcaaggtgggcatatttggcagcctgaaggagaggtagaatatttgcctaaccccacagctagtaaacccaggacaaatgcatcggcagcttctcaaggccagggagagagagcacacatcttgccctaggaaattcacagacacgctgaaatttgatgggaactgatctagccaaataggaggagatcaattgtttgctagaatcaacagatcttcctgtttagttgctcagtaaaatatccttgcctctgggcacaatgcaccaagctggaggatgccatcaaggagaagttctttgcctgatctcattgacttttgagcactttaagcctaaagggagcaggaacaagaagcgagaggaaaaggtgaaggttaaagagaactatttcggagataataaactccttctgaatcctgccaaggctggctgcgctgttgtctcagagggagaagaatatcaacatggactcctgcctgtggtcttgaaataggcaagtcaccaagggacaaagactgttctgtgagtttgggctccctggggcagctgttcctgagctgttacaatggccctggcaccagacactgattcagagttttgtggggagcccaggacaaattctcactatttaaactaagacaagtccaaggctgaatgccctgtccatgcaaatgtctgcctgttatatgaatagggaagcaaagtgcgtttccaggagccacagtagagaccaggtgatcatctcatgcttcccagaggaaccccgcagaatgccagctgctcctgtgttggttccttttacgaacttaggaaagatcatgtgtggggacaggtaaggaagcacatggctagggcattctcagggagctaaagtcccgcggtactgagatgcgtgaaaggtgtggtgggactctgggaagaccaaggagggtgttgggggaactccctaaaagtggggtccctttttaaagcttaagggccaggtatctgcccagcaacagggggagttgaagttcctccctagagtggctctgatgaccagcaggatttggaaatacccgacctcaatccctccgtcccctgcagttcctgcctacggtgtggcacccctcctttgagactgcatctcccctacaagcaactgtttgctgagcatcacaagtgccaagtactgagtgacgtgttttacatacactggctcattcaatcccagggacaccccaagaagtaagggctatgagctccattttacagaccaggaactgcctaactgagctttagttttttttttttttttttttttttttgagacagggtctctgtcacccaggctggagtgcagtggcgcaaccttggctcaccgcaacctccgactcccgggttcaagcgattctcacctcagcctcctgagtagctgggattacaggcatacaccaccatgcctggctaatgtctgtatctttttggtagagatagggcttcaccatgctggccaggctggtctcgaactcctgacctcaagtgatctgcgcactctggcctcccaaagtgctgggattttgcagcgaaaggcgtgggccaccacgcccggccacatgagctttagttttaattgaagcacattggtgtgtctgccagtgtcccaggacctgccactgcagatctcaggagattcctctaacacagatgggccacaagcacatgggtccctctctgaattcaccctcaccctaatcctacctaccccaggtgtccgtttctcccaatcactttcttaaaatactaaaaatgtacagcattcctttttcccctggctctaagtcctgaccttttaaggcctctgttcaagagcatgttaattagtaacttccttcagaagaaatctgggaaagcatttcctgggcaggagccctgggcctgagggtatacctggcctttactttctcttggcctgaggctggattctcattaaccagccagagagtcaagtcttggttttgtttgtttgtttgtttgttttctccccaaatctgaagtctccagccccatcttcacccgtgttcagtccaaaggatggacgtagcttctccaaacacagacaaacaaggccagggccgcccaagcatcctgcacacattcttggagggatgtgagtagccaggtgaggctatgaccacggggcggtggaccctactggtctctccccagccaatgtacccttgcacctgatgccgtggcctaagttttccttctctcggcagcttttcttccatagatcacacatcaagcttggctctcagtcactgagggctgagaggccattacaaagccaaatacacgtgaatgctactggaatgttttccccaagctcaacgtggctgcttgcgctagacccacagcgtcagacaagcaacttcgacagacacccaaatgcctgcaaatgcaagcaaactactcctaccgaggggaaccacatactgaccggccagctcactcaagaaaaggtatgagcgaaaatactggcattaggcagaaatgaagaaattggtacagaaaacctggaaggcctgaccaatgggaaaaacaaggataacatgagagaatccaacaacagaaaggaaggacgcacctctcctttgggcaggattttctgttcatccagtttgaaggctgttcctattcttctccgaacaatgggtggttcctcccctggatccaggggatattctactggcagcttgcccgtgagctcctgcatatgtgaaatggcattcggagtgagcacaaatcagagtggggcgtgtctgcttcctagaacacacacacacgcacatacacgcacacaaaaatgcacgcatgcacttcgatacaggtcaacgcttatgctagaaatgttcacattaagcactatgcctaagtaagaggtcaagaaatgaaatttcatttctctaacaatgtctcttatgtagaatagttgcacttccaaagttttttccaaagtaaatttctgtaattgccatttgactttcattataaaacttgaatttcattcatttgttaagtgaacagatatttcctgcctgcctcctctgtgccaggcaaggtcacccagccagtgaggagcagtgtcagcgtgagttctcgggcctctctaactccaaatcccgtgctcttgacactgcatcaaatattcctgctcaaatatctaagtttaaagtttccttcaaatggattttcacaagaggagtggtatctatatggcaaatcccagaaaagtgcatagataaataatttagaaactgagtaaggatagtaacctactctggccagatgctacaggaataggctgtacttaaaagacattaaactgtttaatttaaaagttttagtagaatggctgggcacggtggctcatgtctgtaatcccagcactttgggaagccgaggcaggcggatctcttgagatcaggagtccgagaccagcctggccaacatggtgaaaccctgtctctactaaaaatacaaaaattagctgggcgtggtggtaagcacctgtaatcccagctacttgggaagctgaggcaggagaatcgcttgaacccgggaggcggaggttgcagtgagccaagatcatgccactacactccagcctgggtgacagatcgagactctgtttattaaggaaaaaaaaagtttagtagaaactgaacatataatccatgttattgacaaggctactaaaaaaacacttgttttgtgtattttgggccccggaaatctacttgttgtgggtacaaggacagtgaatttagttgacagacttccatggtgacagtgatcctggttaaaggctaaggatctgggggcgattcaagattagaatcaggctctctgtgagtgagttgtatcagggctgaacaatgatcaaatcagagtcagtggctgccccacactgtagaggccaggcatcaaattcaagaagtcacttccagagaccagaaaaggctgggggaccaactgtgcatctgtctctaatggcaaagtgggcacttccaggccaagcccagctctggcttttctagcccaaatcaacgcagatgctgcacaaagactgaaggagctgctctgacaaggaagttcaggaggcttttctcaggaatatccatcatctacacagaaagcttttgcgcagggcagcccagggctgagtgcccagcaggcgggaaaatccaaatcatgagagtgtgatgctggcccttcttctccaactgctgtgtgcacatgtgtacgcatgtatgcatgtgcaggcatggtgtgtgcatgtgtgtgcgtgtgtacatgtgtacacgtgacatgagcataaacacatactccgtcactcgcctgcttctccctcgctgtgttcagattgccgggaaatgaccccgtggactttatattcctcaatgtaagcatttcagagcacaatggccaactatctgagtatcagactctgcaattttcttccctggttttttctttaaaaaaaaaatgtggttcaaatgtctccaaagtagttaagtgtttattccgcaacttttttttaatctgcttccctaaaagtctatctataagtaacacaactattgagggttttatattgtcaggacttgattttttttttttacttagaaaattccaaaaaggagggaaaagttgttaaaattgccatggatctgtaactctaaactgttggtggttttaaaatgtagtttaaaaaatgaggctactgatttttttcaccatccacttgaaggtatttgagtcgaagtcttgattctccagatatttaatctgatttcatgtgtaactggagctgcacgctgaagacgtaatttaacactctgcagtggggcctcggcttggtgcctccctatatcctgccaaatgctctccccctccatcattctagttgcccccctccccaggggtcaagcagcgcgtcttgatactctgagctgaggggagagatgcaggaacagcacagatttagcaagacctccccccagcccttgactacacatgcgtcaagaggctatggtgggactaactatagggaatgatcacaggagaaatctacctgcaactgatttcttgttgggttatttcttccactcaagttacattttctggtgttaacattataagaagtggcagctttgttttccttcttttgtttttgtttttaagagcgatggtgagatttttttataatgcatgctcatcttgccctgacatgttccttacctttttgaaacgtggattccctgccgggtttagggactttttattaaaaacaaaacaaggctttccaaattattaaaggcagacacccaaactcatattttttccaatccttcaagcgtattctttataaaaatgttgctaatattaacagtatcacatagcgcattccccagccaggccaattgctttcctaagatttgcaatggatttgtgctaatgtggttctgctttgagctggctccggtttaaatcaatccagaccataattaagccaagttgaaatgtaatgtgatctcactccacggccccttgtttcattcttcccgctgcaaggccttagtgtttgggggaggggtatacgtctctttgacttactttgggaacctcttttgacttcccattctcaactgtttaccggcgaagctctttctaaggttaggtggtgcacagttgctcctgccctggagagctcccaccccattgtgcccatgtgcacaatgcacacatgtgcatgcgtgcgcgcgcgcacacacacacacacacagagtcatgtgtattgcattaaaacatgaagccttcaaacacttctaacaaatagtcatgaaataaacagacaaaggtggaaatggatatttaaataaataaagacagcagcttgcagcaacttctgtgagactagcacatacatagggtcgagaaagcattgcttttttttttttttttttttttttgagacagggtcttgctctgtcacccaagctggagtgcaatggcgtgatcactgctcactgcagtctcaacctttcaggctcaagcgatcctcctgcctcactctcctgagtagctgggactacagacacacaccaccacctctggctatttttttgtagagacagggtctcactatgttgctcaggctagtctccaacccctggtctccagtgatcctcctgcctcagcctcccaaagtgctagtattacaggcatgagcagctgtgcccagcctgcataaaatttaaaaatgtcattaggctaagatttcattttttaaaatgaaaaagctaaacaccagatcacagggtctaaaggtgactatataccaagtgagatcgtggtttccttgttgaccaccagtgtttctcaataggatgtccaaagacaagtctgaaatacccttaagaaagaacaaaagccaccacaacaataaactcaggcacaaaatcttgggaggatggtggccagccattatgatcgatgaggcactatcacgtgaggagatgctttatgaaccaccatgcaagtatgagggatgagggatcatcattgggacttgtcgcttggactcccatggggtcctctttgggattttgccagcaccaactttaactggtcatcacagtgcttcatcaaccaattctttgatgggtttagggactttttcttttgttgaaaacaaaacaaggctttccaaataattaaaggcacacaccaaaacccatattttttccaaccctttaagcatattcttttaaaaaaattcgctaatattaacagtatcacatagtgcatttcccagccaggtcaactgctttcttaagatttgcactaatgcggttctgctctttctctgacaaagcacattagagaggtttggatgtttccaacatttgtgtttcaggagagcgctcgccgcccagataggccctctttttatcactacccttgccttctgtcaaaacgatcaaatgacatcagtcaaatgacatcaaaaagatcaaatgacatcagaaagatcagtgacatcacagacaacaccaatttcaacgggatgagctaggaaaggcttacagcttctcggagacacagcttcttcagttcctccagcctctgacgcagggtttcctccagagcttcctgcctggacttcaaggcagccagcatgtccttcttggccgactgcgagctatctgattcctgagaacctgtcgataaacagtggggttacttggccagctgacaggggacacacatctggaccactaatgaatttaactggagcccatgctgcggagatgggatttaccccaggaatcaagggagtgtgaaataaaacaggtgctcagcactctaactgtgagaagcacattccagcactgcatggaatttatagccagtcacaagaaatggcaggaagatggaccctcctgaaaaagaagtttatctttctcaattatcttaagaaatgtcacatacctttttaaattttactagcaaattctaatagactttacacaagaaagggggaaagaaaagctcatgtcagcaattttaatacgtattgagttatttatctttgtttgagacagtctcactctgtcacccagcctggagtacagtggcatgatctcggctcgctgcaacctccgcctcccaggttcaagtgattctcgtgcctcagcctcccgagtagctggggttacaggcatccgccaccacacccggctaattttgtatttttagtagagatggggtttcgccatgttggccaggctggtctcgaactcctgacctcaagtgatctgcctgccttggcctcccaaagtgctgggattccaggtgtaagccaccgtgcccagccctaaaacgtatttaaaatgttattttgttcccttaaaaatacttattatttttgcttagtgcaaagataatgtgtgtttatgatgaaaaccctgaaaatgtagacaggtataagaaatagtccattaactaatcacccagaaataaccattgctatgcattttcttttggccttttttctaagtacatatatttaaaaaataaaattagaatgctattgtattttttaacttcatgttttgtatcatgagcaaattccctcctaataaaagttatacatattttaacatacttttcctgggtaaaacatgatgattcaaatagcagagtgctcgataggaaaccttgtggaaggcaaacttcaaaccaaaccaaaggaaaataagctgaaatgccatctggaggaatttaggttagaccaaaggagtaatttctgggctgccagtgtttggattctgaaataactttcctggagtgaagctattgtactttttctaccttgatgggttagaaaaggaacactgactctctacaaagggaaaagctgattataacttttcttttctttttcttttttttttcagacagtttcactcttgttgcccaggctggagtgcagtggcaccatctcggctcactgcaacctccgcctcctaggttcaagagattctcctgcctcagcctgccaaggtagctgggattacaggcacccgccaccacacccagctattttttttttttttttttgtatttttagttgagacggggtttcaccatgttggccaggctggtcttgaactcctgacctcaggtgatccacccgcctcagcctcccaaagtgctgggattacaggcatgagccaccgcgcccagccgattacaacttttctttgcaagcccatcgtgagcagaagtgttagaaacggacaggtgttagaggctgtgcattcaaggggctcacaccatgccattgacaactgcatcaaagaacttcaaatacctagggagattaatctaattaaagatgagcaagatctccaccgcgaaaactgtcctaaagacctaaatagacagaaagatacactgtggtcaaggattagaagcttgatgttgtaaagatgtccattctccatcaatcaatgcaatcccagtaaaaccttggcaggacttttggtaggaagatgaaaaaattctatttccataggaaacaatggattttttggacaattttagtaaacagatgagagaataatccagtcagaattcccagaatccacagttctgtttcttccaatggtagaaaaggcaatgcagcatcataaagctagaaagaacttctgtcccgtggcatcaaacagctctgcttcacttaaattgtccccataaatatactattcttctatttaacgtctctgagcagaaaaccctgcattccatcaattaccatacatacaggctcttactaccctaatcaccaagaactctcaatgtctaagaacattttaactctaacatgggttttgttctttcccttgcctcaatttgagcttgaaatagagaatatatctgtcaccgcagaaacatactatcattatgcctccaaagcagctaacaaatattagcttgaatgaacaaccaaataaatgttcacagtcatatacttggatgctataattatctcctcttcataacaaaaatctaatacctgtaatttgttccatcgtggaacctaccttccgagctttgaattattttcgtagctgtttcctggattttgacatacttcagttgcaggtctccaaatgcaactggacacaagaaagcttcatccgtgacctcatggttctcaggtactaaatccatatagtgtcatattcacacagcacatcgctgaacattattgcaggttcccctttttgaaatggttcaggtttgctctctccataagccaatcaccctgtgcttaccaatcctaaattgtctccagtttatgtccctccaaggttacatggctaaatcattgtgactcttaatctggttctcttagtaacagtcaccaatcacatctgaagactcaggaacatttactgaagtactccgtttcatcattgaaagaattaataagaatgtaaaacaatactggaaggaagtcagactttagatttaaaaaacagacctagagaaacttgggtccaagaagattaaaggatttctagctcaagtgaaaaattcattgttttccctttcacccctgcctaacctctcaataggaaataatgatttattaagtccaatctaagaattaactgtgttctggaatggcacaaattacaaatgaaactcaagggaggtaaagcacacagtttttggatgatcatgttgctagttatgggattagttaagatttggccctgagttccagggctcattaatgctacccaaattattatcatttccaataattagcctagataccaagcccacagaaaacaggcaagaaagtcctggcagactagatggctcaagagcccctctctgtatccgctaatgctggttggcaccactaatgctggttggctccgtttcatgccattagcctgggagttacttcagggcgaagatggtgtctgggtaccaggtcaaatccccgcaaaatcactgagccagcctgccttggacatgcagatttccactgtggcggtaactggatggtggatagagggtaaaacagatctgagtttgataaagtcagaaccactcactggatgtgtggccttgggtaagttacctgccctccttaattcataaaggctgaatgagaaaacacatctccagcactttgcactgggcctggaataggtcaaccctcaaactagggcaggttgaacatgagcatgtgtgcgcacgcgcacgcacacacgtcctagtagaattagaaagagaaatcattgcaactgcctcttcactgttgctcaatgaagtatcggtcaaagagcttcgtacccaattcagtgtaacacttgaggtccaaagctcacctttagaaaggaacaatacgaactaggcagtgttttctttaaaaaaatttttttaattggcacataatatggggtgcacattgatgttttggtacatataatgtatggtaatcagatcaggataattagcatatccattatccaaacattgatcatttctttgggttggaaatactcaatatcctccctctagctatttgaagctatacaataccctactgttaactattaacatcctacagtgctataggacactcgaacacattcctcctacctcactgtaatttctgtcctacaacaaatctcccccatcacctactctctctacccttcccagcctctagaaacttctgttctactttatacttctatgagatccacttttaaaaaacacatagtgttatggctgggcgcggtggctcacgcttgtaatcccagcactttgggaggctgaggcaggtgggtcacgaggtcaggaggtcaagaccagcttgatcaagatggtgaaaccccatctctactaaaaatacgaaaaaaaaaattagctgggcatggaggtgggcacctgtaatcccagccagttgggtggctgaggcagggaattgcttgaacccgggaggcggaggttgcaatgagccgagattggtccactgcaccacagcctgggtgacagagtgagactctgtctcaaaaaaaaaaaaaaaaaaaaaaaaaaaaaaaaaaatatatatatatatacacacacacacacacacacacacacacacacacacagtgttcacaaacgatgtttcctgagtccctgggttagcagctaggtctttggggcagctatggttggaggtggggtcaaggaggttctgtggctattcttatcctattccactccacgttcctcaaaacagagcagctccccgtgaacctgctgcatgtattcaggttgccgtattgtaacgaaaagaggttcccattgccttttttgtctttaggaaatccactgttctggggcaagggctcggagctttcaccgctgctctacctcagggcttgtctgatctgagcctgcgggctgctacctgcaactaagcaaacgtggccaccaaggcaagaggtggccgagtgcccagtgacacggacacaccagcaacattccacagaagcagctcaaagggcgtcaggagagggagcccaaaatgccctctgatattgatctgctttcccacgtcctccacaaatgcccactaggcatccactgacccagcaggttggttttaaaagggaagaaggaaagaagctacaagacagggagaaatcaagaggtggaggttcactctcactgcctgccttgatgccctcaagtgacagaatgactccaggaagaaattgaggcagggcagagccttagggctcagggaaatgggactgtcaaaaactaaaagctggtcacagtggctcacacctgtaatcccagcactttgggaggccaaggagggagcatcccttgaagccaggagtatgagaccagcctgggcaacatggtgagactctgtctctacaaaaacaaaaccaaaccaaaaattctaatttcaaatcagcacctaggcttatgctgatttatccattttcagttatttgaacacatatatgcttttgcaagtgcaaacctctttgaggttgtgtttagccccttggaaattaaaaaaaaaagggctgggtgtcgtggctcatgcctataatcccagcactttgggaggccgaggtgggcagatcaggaggtcagattttgagaccagcctggccaacatggcgaaaccctgtcttctactaaaaatacaaaaatcagctgggcgttgtggcatgcacctgtaatcccagctacttggggagccgagacaggagaatcgcttgaacctcggaggcggaggttgcggtgagctgagatggcgccactgcactccagccggggtgacagagcgagactccatttaaaaaaaaaaatttaaaaaaaagtttaaaaaaaggatataggctgggcgcagtggctcatacctgtaatactagcactctgggaggctgaggtgggaggactgcttgaggctaggagttcaagaccagcctggccatagtgagacccctgctctactaaaaaaaaattaaatgatctaaatctgctatcatggagagagggtggtgactggagggaaagacactggattttcatcacatatctgccattaaatggtgtaacgccttgagttactaatctcatggttccatctataaaattaccaattgacccatctctaagattcctcaaactgaattcactattactcaataaacaacttactcggatagttccctcgtgcctctagcagtcatttttgcaatttttacaacaggcatcttatacacagcacaatcttccctcccctttttctctaccttcctaacttctagccttctgccagtgctgctctcatttcagttactgctacagcctctcccgggctggaagggtgtgtctcatcattaaccagtgcctaaaggatttactgcttcatcaacagaccgaagcaaatatttgtaaactcaaaagctaaacagagtttaatctgagctgtctctgggattaatgaagtagaagatggatggaacctctttattctaggtagaagggcgagatttcaaaggttattgattgagaaaacagtagctaagtgctacctggaaagggttgtccaaacatgagttggtgtaggagtcaaggggaaaacagaggtgatctcaatacggtttgtgaaaggcacatatatatatgtatgtatatatgtatatgtgtatatatatatatttttgtaaagtttcaggcaacactcagatttattagagtattctgaatattctttagaagacacaaactgttatgtagcttcctctaaagccaaagctcacaccagtggttttgaggtaatagggctgggtgtgtgttccagcactgccgtttaccagctgtggggacttgggaaggttgtgtaacctctcgaagtctgtttcctcccctgtaaaatgggaatgaaaacaggacttcttcagaagttgggagaattaaaagagaacgcttagaagatgcttggaagagaggtgagaatatattaagtgttacatgaataccagttactctttctattaaaaagtgaggctggggtggtgtctcacacctataatcccagcacttttgggaggctgaaatgggaggactgcttgaggccaagagtttgagaccatcttgggcaacatagccagaccttgtctctacaaaaattaaaaaaaaaaattagtaaggcgtggtagtgcatgcctgtggtctcagctacgctggaggctgagatgggagaattccttcagcagagggtgttgaggctactgtgagctgtgattgcgccactgcactccagcctgggcaacaaagcaagaccccgtctgaaaccctcccccgccactattcctagcctttactaggagtctgcaccccaattcagagagcttcaaaatgtagatgagaaagtccatttcgtggacaagcaaggaaacgtagaatgcttgcagatgtaccacccaccgtggccacatcaattcaggaagctcaggaggagaagggtaaggaaatgagtttttagagaactcctaaacaggagcttcctacctgctgcacttcattgaatcctcacagagacatcattcccattttctttctttctttttttttttttttttttttgagacagagtctcgctttgtcaccaaagctggagtgcagtggcctgatcttggctcactgcaacctccacctcccgggttcaagtgattctcctgcctcagcctcctgaatagctgggaccacaggcacacgccaccacgcccggctaatttttatatttttagtagagatggggttagtagagatatagtatgttggtcaggttggtcttgaactcctgaccctgtgatccacctgcctcggcctcccaaagtgctgggattacaggcgtgagccactgcgcctggcctcccattttcatagaaaaggtcacagagtcataaggaggctgaactgggagtctaactctgctattctgtcttctgcctcttgcataaaaactcaacacgggtaggagctttctgtcttgatctcagctgggctgccctggtaaacctgtgtagaaagcagtcacatcgactcccaagtgggggctctttgcgtgatagtgcaagcatcaaaacctaagagaaggaagcagggcaggggctctttggatcacccaggctggagtgcagtggcgtgatctcagctcactgcaacctccgcctcctgggttcaagtgattctcctgcctcagcctcccatgtagctgggattacagcgcgccacaacgcccgactaatagaagcctctggagccccttccacgtgcacggtggtgtgggagagacacgaacagcagacatgcatccagtgctcagacctgcctgccgggaggcagaagagagcaggccacaagaataggccgggcctggtggctttcacctctaatgccagcactttgggaggccctggcgggaggattgcttaatgccaggagtttgagactatcctgggcaacacagcgagaccctatctgtaaaaaaaaaaaaacaaaaaataaaaaaattagttggatgtggtggtaaacgcctgtagtcccagctgcccaaaaggctgaggcaggaagatcccttgaatccgggagtttgagagtacactgagctatgctcacaccactgcgctccagcctgggtaacagagtgagaccctgtctctaaacagacaaaaaaaagaatgagacaggtagtagttgccgtagaaggtggaaggtggaacccacagccgggagctaactgggtaattaacgtgaattgtagctggtcacatccagttttttttttttctttttgagacggagtctcactctgtcgcccaggctggagtgcagtggtgtgatctcagttcactgcaacctctgcctcctgggttcaagtgattctcctgcctcagcctcccgagtagctgggattatagtgcgccaccatgcctgactaatttttctatttttagtagagatggggtttcaccatgttagccaggctggtctccaactgctgacctcaagtgatctgcccgccttgactcccaaagtgctgggattacaggcgtgagccactgcacccagctgggtgactttttttattgcctctctgagaaggttaagcctgcctctgaattattgtcaggaaaacagtgtcatcaggtcagttctccagcaaaaaatctttcctcccagttatcgggaggaaatgatctacttgaatgatactaaagatagaatctgttgtttttggcgaccttatgagcacatttcaatcctaatccaaaggattttcattgaactagttcactaataatctggccaacgaggaagacaaaaagggctgaccctaaaaagacaattcccatccaagcagagagagagatggagttactcacgccaagtcagaaagtcattttcgggggcatttggaaatctttggagtgaacttcccgatgctatgaacattgtttgagaccctggagacactgcctgtgtcactgtgggtttcccagcttccagccggggaactccagactccagccggggacagctgggtgtggaggagcggatgtggaggcaacgccagcagcacaaacagcagctctcctcccggccggcagacacatggaaggacagcctctttcagcctcattcagccgcgagccagaaatgctccaattgttcagaagaccctgggcgactcagcaccggatatgagcgcacattctgccaggaggacgttgtcaggagccacgcgtggctcatctgtttttgacacagaggggatattgatgaccagccactgatttcagaagacagagaaggggtgctttcctctctggaaggaggggaaacttcaaagcaaacaatgctccaaagaagaaaggaatcggttgttctagaactaaagaagggaaatgacaatccgtctctttagaccttagagaaaaaaaaaaaaaaatgaagaaggcggtatattcccagcagatcagtaaaagctgtaaggaaaagttttggcagacatcccaggaataaatatgaggaaaaggttagaattcttctttatgataaaaagatatttatttccttgacaaatcctcagtgatgaattccttacataaaagatgtcccaggagaccacgggaaataatgccacattgcagactgcaggataaacgtgtcatctctggggactgttatagagaattagatgtgatttttaacatgaaaaaatgcatgcttggagaacttttcatcaggcttagaaattttagaaataaaatagttcatttcagagagcattgaaattgaagctctttgaaaaccaagcaccttttgatggtggctgggagtctctggaagagctttgctttctggctagattccatggctcactggcactcggtgaagagtgcaaatgtaatttaacagagagagaggagaatggaaaaaaataactgaacattcattttaaaaaattagcagcatccagtaaaatacccagctgaaactatggtttgtaaatcctacagtttccatttcttaggctgtgaaatgagggagctgacctatcttctgggtccaagcttgttaggctattgcaataccaacgtttgcaggttaactgtgaatttcagtcatcctcattctgtgctcccagcaaaggagcactgcaacagagggctggccctaaatgggaacagagaaacgctcgtgggaagtgatagttatatctctttttagtatttaaaatttcatcacagtcctacccagtcaggaggctgaggcaggaggatcgcttaagcccaggagtttgaggctggagtgagctagcattgcaccactgcactcagggcgacagagcgagaccctgtctcaaaaaaaagttatcattggaaagtcattcatttaggttatacattgtcatttggtcctggttccctttagtgggcaaatgctcctttattagtaacacctcaggggataaatatagctgtgtaaatgactttgtctttatttcccccaaaataagaacagaaagggataacgactctgtctccctctcaattttgactcaggccagtcctgctcaaacatgtccagaaccatccattccccagaaagagatttcgcagctctccctgggcacacggtccagcataaacaaaccctggcacaatccgactttggctgcgccctggggcagagcagaggctatgaccaaaattaaggcccctggaatcctgtccattgttagacctaaaaggagaggccacaggccatgggtaatggaggactttaaaaggccaggaacagagatacagggaggagaaggaggaaggacaaaagagaagggatgaagacaaaaccgaaaaacgtcgtgtgatttatatcagcgcaaggcagtgaattctgagctgaacacagccgccatcatgacgctgacagagcctatcagctcccctctctgtttggagagatgtcagatagctggcactctcattgttacattagttattaataaactccttaacaatgggaggaagtgctagcattcagagaatgggagtgtgtcaacagctgaggactgaatgtggacggatcccaggcaatgccaggcccatgtttagcacaacctgttttctcccagaacagaaagtgtcagagccagggtacaatgacagactgcaagttttgtttcatttctcgttttttaaacccaagatccatcaccagattcttcgcaatcttgctgatcacactgcagatgactcaatggccatctcagtaatcacacagccaaattcctacttgaaaacacaacatatcccttagttttacagagaatgggtcgtttatggccctagacttctagtcgagaagccaagatcagcctcatcatctcatttaagaaatgctgcagtcccatttattcgtttcagtggttaatacaacaagccacacgtccctgcagcacactgggtatttcctaagtgggtttgtgctattttccttaaaaagcctgagaacaaaaactaactctcctaactcccattgaaatcagaactgttctctgatggcttggccaggtgtggtggctcaagcctgtaatcccagcatgttgggaggccgaggcaggcagctcacttgagctcaagagttcgagaccatcctggccaacatcatgaaaccccatctctactaaaaatacaaaaattaattagccaaatgtggtggtgggcaactgtagtcccagctgctcaggaggctgaggcaggagaatcgcagataacccgggaggaagaggttgcagtgagccgagatcatgccactgcactccagcctgggcgacagagcaagactccatctcaaaaaacaaaatgaatgaatgaatgagctgttctctgatggcaaatccccaaaacaacacttagaacaaatctcaggctctgtctcactttcagacaagctatgaatgggctgtgtgtcttcacctacaaagatacacccagttattgttgctttgttgttgttattcccttttttctcccctccaacattttctggaatttcaagtaacatgagatgggaaggaaggaataaacccattcaagttctttcaacatggattttggattctttttttaaaagaccctgaacatgtcttaaccagatggtttgaattcatagttgttctctcaaactgtacctgaactttctgcaaatgtgttacctgaagacttaggagtgaaagcaacagagagacgcagctacaaatgtggaagcaatcactgggctgtcacagggcagagtgaatccaatgcaccctgcctgctccccctccagtggtcaataacagaggcactgagcacctgcacaaatggattcaggacgcgggttccacgactttcctcccatctgaatgccactcagtgctgcatggggaggtgagaatttcattccttttcttccaacacaggcttacagctctgattcagatggttcaccacctctaagggcctccacttaaatacaggtctacggggtctcacaggggacagctctgcgtatcactactacgggattcagggccctgatctcaagccttaaccaatcactttaactacgctgaaatcatctgccattgagtcatctgcagtgtgatgagcaggactgtcaagaatctggtgacagcatagcaaagacttggaaccaacctaaatgtccaacaacgatagactggattaagaaaatgcggcacatatacaccatggaatactatgcagccataaaaaatgatgagttcatgtcctttgtagggacatggatgaaactggaaaccatcattctcggcaaactatagcaagcacaaaaaaccaaacaccgcatgttctcactcataggtgggaattgaagaatgagaacacatggacacaggaaggggaacatcacacactggggactgttgtggggtgggggacagggggagggatagcattaggagatatacctaatgctaaatgacgagttaatcggtgcagcacaccaacatggcacatgtatacgtgtgtaacaaacctgcaccttgtgcacatgtaccctaaaacttaaagtataataataaaaaaattaaaaaatttactattaaaaaaaagaatctggtgacggatcttgggtttaaaaaataaaaatgaagcaaaatctacagtcaactatgttgacttttttatttgaaatgctaatccgtggctcagggcattggtaggtatggatattgacttcttttttatttatttacttattttagagacagagtctcgctctgtctcacaggctggaatgcagtggtgtaatttcagctcactgcaacctctgcctcctagctaggctcaagtaactctcctgcctcagcctcccaagtatctgggattatgggtgtgtaattacacgcctagctaatttttatatttttggtagagaccggatttcatcatgttggccaggctagtctcgaactcctgcctgccttggcctcccaaagtgctgggattacaggcctgagccattgcacctggcctggcttctttaataggtatcaatgacattcttcatttcttcagcatctgaggcctcagataccaagtactagacttcagtagttttaaaggtaattatgtgtccttaaacaggcaaaccaccttcaaagttactaatagtttagaaacattttacgtcttttttttaaatcaatgagcagtacacaaactctttgcggggggggggggggggggggggagggctataactttgtaaaatgctgtgtatagtacctggcagagttgggagctagcagaaatgtttataccacagaaatcttacagtgttgtgacatggctcagacacaccatgatttgggtttagatgagggtcagagaataattgaaagatgacaagatggatactactgcaggacactgacgtgacacaaactttaaaggtctcataccagtgtgacaaaggcttacaatataatttgggaaaaaaagtactggagacagatcctatgggaggtatcagcaaggcccagggtaccatacactctaggaacatagattagaagattcttttttttttttttttttaagagacagggtctcactctgtcacctaggctgttagtatagtgataccatcatagctcactacagccttgaactcctgggctcacgtgatcctccagcctcagcctcccaagtagtgggaaatataagcatgcaccaccatgtccagctatattaagaagatttttttttttttggtacagatggtgtcttgctatgttgccaaggctggtctggaactcctggcttcaagtgatcctccccaccgccccaaacccctaccctcctgaataggcgtgagccactgtgctggggtgaatattcctaaaacacagcacatgcaggagtcttattagtatccttcacaatttaattcaatttcaataactgtgcatcaaacacctattgggtgttgggtactgggcaagtattagaaaattctgaaatggagactagtttctcaaaatgcttttaaggaacaattattagacactatctaacaaggaggtgaaagagagaaaacagttgacccaactggacactgggttatacatatcaccttttctgaatgaacatcagaaaataaaatccggcaagtgtaataagagtattaacaattagagctctcctggaattgcaagcagcggggcttgtcccctttgtgggaacacattctaggcaagagggcagaaaggcaggaagaaagggatggagatgagccagccgcctagatcttcaggccaaggctagatttccccattgcaagggatgtcgaatcagccccttccagatggcgctgccaatgctttcatcacgggaaagctttatcctcctggtgcaaggaaacacaggcagccgtcagccatcccagcgggagggagaacaagatctaggggtgctagaaattccctttgttccctgatggaatgtttcctgtttgcagtgcgtccccccactgtcttggccctcctaagtcacaggaggtgggtgtggggcaccccaaggagcctccaccctggcactaaaggatgtttttcaggctcaaacttgcagggctggtaagagtgggacctgccctcgggttgagtcatggggctttctcaccttctcaccagggtttcttcttgctcagctgtgcagctgcagaaagggctgagggcactgaagctgacaatgggagccgctctgcaagtggccccagctgctactactaactcctaatcacctcagcctggggccccagcgctgaatgataaagcatttgaagatcgcttcattgtattggtataccgatgcttatctattaggtgtacagatggattaagcaggaaggttttcttaggatttctcttctagcccaccagattgattagcaaagtccagcctgtggggagtcatagagatgtactgcttttaagtcttaaagacacttggatttcatttgtgtgtgtgtgtgagagagacacagtctcactctgccgctcaggctggagtacagtagcatcatcttagctcactgcaacctccgcctcctgagttcaagtgattctcctgcctcagcctcgaaaataactgggattacaggtgtgcaccaccatgcctggctaagttttgtatttttagtagagatgggctttcaccacgttagccaggctggtctctaactcctggcctcaagcgatccgcctgccttggcctcccaaagtgctgggattacaggcgtgagccactgcgcccggccagatttcatttctgatggtgcatgatgtcaatttcatctcaggaggtttggggctcctgttcacagcctcatctatagctgctattaaggtaaattgctgccttggtgccccctggagtctgccagatacaagggggcccgtgcagatggaccaggacacgggcttaaaactgggcacacctgggttctatgagcctgggcaacacacccaccccaagcttgtctcttcctcagcaacaagagagtctccccaattaaagcgactagaccagcagcatcagcctcactcggaaacttgttagaggtgtaaattctcaggctctccccagacctacagaatcaggagctctgagaggggttttgacaagccctccaagtggtttcgatgcacgccgaagtttgagaaccactgagcttcaagaatccaagctgaagtcagccagattccctgtgctaagggggaaggtgggctgatagatgcagcctctctcatctgacactgggttttcacagggttaggaaaaaacgcgattgtaggttgtgtttaaaacacaaacaaggtgttggctctgactctgctctaggtcattcagcaggagactgggagcggctgtaattcgaggtaggggtcttggtctttgaatttcattctctttgatccttgaagacaacattctctgcagtcttcatggccaactcccaagcttcagaaagaatgagcattgaccccatttttttggatgaaatattttcgaagaacttaaggcagggaggggttgacaatggaccccaggtgatgtggcagaggcagatctaggtttatggggcttgaagcttataaaattttagcagcttttttttttttttttttttttttttgagacagagtcttgctctgttgcccaggctggagtgcactggcacgatctctgctcactgcaacctctgcctcctgagttcaagtgattctcctgcctcagcctcccaagtagtgggcttataggtgtgcaccaccacactcggctaatttttgtatttttagtagagatggggtttcactgtgttggccagactggtctccaactccagacctcaggtgatccacctgccttggcctcccaaagtgctgagattacaggcctgagccaccacactggcctttagcggttctactgaagaaaaatacaaaacatattatgttcacagattttataaaaacacatgaccgtgtgaacacactgctaaggtccccggagggcctcagcctgtccaaggaggggccttcaacttaacgctccactcaccagaacagtaacctcgcctctcagtccaggaaggatgtctgtcctctctctggtcctttaaatttctcctggctatgattggatcacaccagcccacaagctaacgagacaatttttagctcctcttcctctcctgtcttttcctttttgttattgtttacagccactatatatagtaatataaattaccagggaagatttcttgccttctttgcgtggctcagagacagctgcatggttcctacatcaatcaggtttttttctcatattccacttttctttttttgttttttgaaacagggtcttgctctgtcacccaggttggagggcagtgcagtcactgctcactgcagcctcaacctccagggttcagtgatcctccctactcagcctcccaagtagctgggactacaggtgctgtgccaccacacctggctaattaattttttttttttttttttggtagagacggggtctcattatattgcccaggctggtcttaaactccctggcctcaagtgattctccagcctcggcctcccacagtgctgggattagaggtgtgagccaccgtgcccggccacaatgcccttttctaacatttccaaaccacggctgcctcccttcctctctgcttctttcaaacccactcctcctcctgccatttcagtaaatgacacccccctttttaagtcagtcagatccaggaccttggaactcctctgtccctcccaacatcaaaagacaaaatgacttggccaaggctggcggaagcggacgacggaaccagatctctgactcgcaatttcaaaaggcactgaatggagaaatcatgccctgcgacacgatggagagagtattccgcatttttaaaagccggagaaacccacctgggagtagaatgcagtgtctcctggcaccagatcctgaaattcacaacacacaagtgggcacatgagcggattccacttttcacccttggacctgacattcccgacagcttgccatggggattgtgaaacgctctggggggtacctgaagacacttaagtgtgaccagcaggccttcttgcactgcgtggttctactgatgcttttttttttttttttcccttccactatttgattcctgggagcagttttctcagattcgcatttggatcccaaccttggtctggaaagcaaagccagctttggagcagcttgccctgcagtctccccagctgcagctctccccaccttcctgggtcccctctggggtcccagccatgctcagggggcgtccctccagctggcctctgcctacctgaagacagcaggctgccgctgctgccgctgatgatcttccccttgctacccatgttggccagcttcgaggtcttcagcgtccccgtctcggtcaggtcgatggcgatctcactcaggctgcgtgctgcatggattttggactggaatggaaagggaagcaggtcaaagaagtgacgctcaccttgcggaaaggacagtcatccctcgcccgcgcctgctcaccgtcttgacattccgcaaagggacttatctccctgactaatgtgcagcatttttgtttgcatcccttggcctcatcattaatcaccgaaactctctgcgaagagcagaggcagctcaagagctgcatcaattgaggatgttctaagcctccgattctgtaggctgcactgctttgtgcttaagagaatgtcctgatttaggaaaagtgacttaatctcattgagctttattattcccagccacaaaacagggtagatgccactcaccacccaggggttggttcgggtcaaaggagaaaaagtgtgggaagggtgttcctcccctcccaactcccctgtcctcccctcttcctccttatctgcctggcacacagctctcaacaaacactgtggttataattatttagtgcttaaacaaggaggagaaaatgattttcagtgctgtgaaagacctaagagatttaaacctcttaaatagtttgccatgtggtcatggaaagtttagctgatggagaagtgacagtggttctccagcttgggcatcatagcaagatcccatctatacaaaaaaattagccaggtgtggtagtgcatgcctgtagtcccagctactggggaggctgagacaagaggattgcttgagcccaggagttggaggctgcagtgagctgtgattgcaccattgcaccccagcctgggcaacaaagtgagaccctgtctcttaaaaaaaaaaaagagagaaatgacaatgacagatctctagacctgcaatcacagggtgcatgattgtggaaaaactgctcatttggattctggggtcccaccaacgaacgtctgacacggtgctttgcttattttgatacctaagtacatgttgccctagtcttcctattatggttcaaaggatactccctttaatccacgttgactggctctatttggttaaaagtcacagcaggtaagaataattagaaaaaactctatgttcacattgacattcctaaaagcagcggtttttcaaaaaaaaattttttttttttttgagacagagtctcagtcacccaggctggagtgcagtggcccagtcttgactctctgcaacctctgcctcctgggttgaagtggttttcctgccttagcctcctgagtagtggggattacaggtgtccaccaccacgcccagctaatttttatatttttagtagagacggggttttgccatgttggccaggctggtctcaaactcctgacctcaggtgatccgcccgctgcagcctcccaaagtgctgggattacaggcgtgagccaccgcgcctggctaaagcagtggtttttataaggtatctgctccagtttctaccttcggtagtgacaatgtgtttgtttgcatttcccacacgtgtgtccaatgtttgcttgttttcttcttcaggaaatcaactttttgtgagtgtgctgaaggcaacaggctttgccagtacacagaacttcgtgaaaacaactagaaacggtcacttgctcatctgtcctttctgtggccactgtctacagcacacacacggactgggcgaggttcaccattgtagcttcctgcctggcctgtggaacccaaggtctttcccacacaggagaaagcaggcatgggggcggtggtgaaggccatggaggggtgtggacccaccactcctggatgccccgtgtacagcctaccttccgtgcctgggggcccttactgtccagccagggctgtctgaatgcctgcagctctgcccttcctctgccctcgacgttgctgtccacactggcaaggacagcgacttccgacctcatgttaacacgatggaagtctgcgggctggaggaaacactgaggcatggcgcttgttttcttcacctggtgtgaattgtcttcctcctcctcctcctccctaccccgtgggcctttcctcgacttatgcttccttgctaacctcaacttttttccttgcattcagactgaagtcgacttcctcaggcgaatttccttgttcataaaacaatcctggctgccaggccctcgaaggattttggcttgccgcagaaggaaggaaaagggctttttatttcattttgacacagcctatcatttgcgcccatctggttgagttttaccctctaagcaagcatggcgagtacaacccatgacttcctttctttctacatcgctctgttatggagacccaggttttaataaaaagtagcccactcccaaacggtgatgtaacaataactcacgaaggcctagaccaattcagtgctgggtgaagggtctgggctctgaagtcagaatgacctgaattagagctgggcatggtggctcaagcctgtccatcccagcactttgggaggccgaggtgggtggatcacttgaggccaggtatttgagaacagcctggctaacatggcaaaaccctgtctctactaaaaatacaaaaattagacttgtgtgatggcacacgcctgtagtcccagttactctggaggctgaggcaggagaattgcttgaacccgggaggcggaggttgcagtgagctgagatcacgccactgcctgatctcattccaggctgggtgctagagtgagactgtctaaaaaaaaagacctgaattagaatcttggctcttcccagtgaatcactatcggactttgacccttcaccttcctgattctcagatacatgtttgtaaaatggaggtcttaaaacccacatcccagagttgtgataactaaagtagataatttatgtaaaggccatcgtaataagaataggatctgcattagggcctggctgtaatttgctaactgaggttagattgatggcccaaccagatattttggggacctcattaatcacatgaaaaacttatcccccttgtcataccagaactcttgccacacatcattcttaaaacaaaaatatgagatcaaaaggcatccttcctaaaggagactagattcctggaagccttatggaagctttagcaaactactggatttttttttttttttttttgagacagagtttcacactgttgcctaggctgggggagtgcggtggcacgatctcagctcactgcaacctctgcctcctgggttcaagcgattctcctccctcagcctcctgagtagctgggaccacacatgtggtccaccacgcctggctatttttagtagatacggggttttgccatgttggccaggctggtgtcaaacccctgatcttaggtgatctgcccgactcagcctcccaaagtgctgggattacaggcatgagccactgcgcccggtccggattctttctagaatggaaaatatcacagcgacctaacagactcggtggggagaggaccgggaggacatgggcattgtcggggagagtctctctttgcaaagtcaggtctctgggctgaccttaaggagtccccagactctggaacattttggtctgggagtcttggctgatacacgtgactcagtcttctgtctgatattgtgggaacaaagcttcaatgtccctgtccccctttgactctgcctttgactctaaataaaatggtgaactgcatcagggagagaaaaaaaaagattaggaagaaggaaagacgtttggattgggggccaattcaagaagtccccactctgagttcagagggaaaagtgtctaatgtcgactctaaacattttgaactttcaaatattttcctgcaaagtctctaagacgttccttggctctgggcttcagaggctgctgggatctagcagacaacgtttctgatctctggggtcagcatagaagttaccaattataattggtgcctgtgcagcttctcattctgaaggagctacaaataaccaaccagcacagcctccctccgccctgtcttagatcgtagaatggtttcttgatgtatatgcatggagagctgatggagggagggagggagagacaggcagagagaaagaaggagagatttccttaaatgatttgcacagtgaccctgaaagaagaaaaaacccgagtgtcaggggagcacctgaaccctcatggctccctacccttgctgactcgaaccactagacctcacttgtctctctagggttgataaacatcatttgggaggcctgggctttgctgaagctcttcagagaaaggaatggttggcatgtcccagtacagtagagtgtgagcagtggccaggataccagccagaactggctgcctagaaatgttatgaagctctctgtcccagccctgtcggccatcactcacccagaggccgtgctgcccatcagagatcaatcacatcgctgttctataaagaacattccagaaacagaaaggtgttgtaatgtaattcccaaagggtacgtcatcatctctgatttaatttgcgggccttttagagaatttaaacttcatgcaagtgttggccagtgatagtatgctagattaactatgacattagtaaaagatggcacgtatttcctcaagcaatttcacaaacgtggtgccatctgaccaatcactaattgaggtcaggaatttcctttgctgctaattggggaaagcaaaacaccaaggatgaaagacccacccggggtcccagagctggaaaacagaggcctccaattcccacatagagggttgtgatcctcacctgtcactgcaggctggggaactggttcctgtgagaagtgtgagggctctaggacatctgtgagcatgccaggcttcctgggaaatgttctccttctccttctgggagcgtgggcattttcttcagtccccaagggttacttttacaaaagggacagctgaaacattcctaatgctatggggcatttggttttacctcctaaaagacacgtcttgttgctaatttatctacaataatctttttttttttttttttctgagatggagtctcactctgtcaaccacgctggagtgcagtggtgtgatctcagctcactgcaacctctgcctcctgggttcaagcaattctcctccctcagcctccctagtagctgagattacagatgcctgccacgatgcttggttattgttttttttttttttttttttttttgtatttttagtaaagactgggtttccccatgtttgccaggctggtctcgaactcctgacctcaagtgatctgctctcctcggcttcccaaagtactgagattacaggcgtgagccatggcggccggccaataatttccttttgagatatacttgctgtgtcagtgagttgacctgttagcctgttcaacaacaaggcttgccaactgcagaatgagcccatcttcccgggtgcagcaggaaagccataagaacaagtttcttgaaatgctcaagagaccgcctatgcaaaaaccggcgcagagaggaggagcttgaacagccaatgctgtgctatcctcagggcgagatacaccttttcctctgtccacactgtggtacagtgcgtggggggtctgccgtcaaggggaactggcagtggggttcaggagcattgcccaatcccctaacccccaccatccatcacccaaccacagagggtgaaattaacgttctcaggtgtcgacctccaactgttgcccctggacagcaaaaccctgacacccacccactgtgtcaatatcgagcatgagtcaaaaacactttggccccatttcttttgatctaatcgagcttcaaattcctgcgctaggactaggacccatcactgccaggagagctgcggagaatactgtcattattcctaacaacagaaattctctgtcctgcgctcattcatcccagaaaatgaccaaaaagggggtcagaaagtagaggacaagatattttacaaaggataaaatgacggctgcgggggacagaccccaatttaaaactgaattatgactaaagggattgtttcatttcgtcctgtcctcttttcttcttttttttttcttttagtagagatgggggtctcactatgttgcccaggctggtctggaattcctgagctcaagtgatcctcctgccttggcctcccgaagcgctgagactacagatgtgagccactgtgcccagccctgtcctcttttctttctcttatcacctcccccttgacccccaattcgctcactctcctcttccccagaaaaagagaaaccccttaaaatatggataagatggcaaaagagaaagaaccctagagggcaccgattcagtgactcttgtgcccagtaagttgagcatcttgccaccttctcccaagaactcacgcgatggagggaaatcctccgtaagtgctagaaaccactagcccaggggcccagggtgacctcagtctgtattcccccagcccaagccagcaggatcttgagagaagctgcagggccatcttggcagggctcttcccctgagggagaatgaatgggagtggcttgtggggggctgacaggggagtctggggagacagggctggaggaagagggggcagagtgttgatataagccctgtgtgaaccaaggagacgtcatcctctcacccaccagaaaacgcagctgcgtgcccagagtcaggggtggtgacatctccttggaggaagtctgtttaccaaggccccaggctctaggtctaccttagggaaacagggtagttgctttttttttttttttttttttttttaacgtttccagttttgcattaaaaaaaaaaaaatggagttggcagttggaaccgcctgagggttttcacagcaattaccctaaacagttaggtggtgtctattcgttgagaaagattccttttttcttttcaaaaggaagatagtataccactgtttaaacaccaaaaagggcttgccttcacgctgctagaggattctcccgagggccaaaagcacagtgggaattcctcaaaaggggcctacctggctgcagtcagcggcttgagcggctctgatggtggtcagagccccctggaccaagatgcatggaatgtgccctcttgaagagctagtctcatccctcccatctgtagccctaagaggcaagcctgtatctgtgcaaggtatggacccgggcaagggacatggcgcctcccccacccatccgatcctcattcctaaactaagagaggcagacaatggcccgggcttggtgagaggtctggtcactcaccttactctgctttctgtccagatagaactggtgttggcttatggccatagcccagatggacttgatcaatgccggacatgcataccacgtgtgcactgcaatgccgctgtgcccaaacgtcctccttgtcactgaagccctggggaagcaagaatcacaaggttcaatcccatttctgttgagagaaaccatttctcagtcaacagcttctgtagagaacccactgcgtcctagaagccctggcgtaaagatgatagatgagctctcacatacacctaggcgtacacacacacacatgcgcacacagcttacagacatcattggctgggcaaaggccaccttctgattttctgactccctagagttcagaatctggccaagcctcggccttgtctgggataagatgggtcattctaggtcaatggatggtcctttttcgatcctggacttggcactgggccaagacaaacttcgcagacaggaaaaccttcaatgatgctccctatgagacaggaaatgtgcctacggtggggatgagtaaattattttctaatcaccacaggctacagcgtcccagggaattgggacttcttatataactaacccaatgttccttgaagatttggtgatcaatttccaatctattcagagggcagggagggtataaagaatcaggagaagaaaggcagagagaaatgtgcccagccccaattcccccaacgtctgtcgatacatttcatttatatttttcagatggagtcttgccctgtcacccaggctggagcgtgctggcaagatctcagctcactgcaacctccacctcccaggttcaaccaattctcctgcttcagccttctaagtagctgggatgacagatgccccccaccactccgggctacttttttgtatttttagtagagacagggtttcatcaggctggtctctaactcccggcctcaggtgatccacctgcctcggcctcccaaagtgctcggattacaggcatgagccaccgcacctggccctgtctatacatttttaaatctacatggagtaatcagactttaaaagtgaaaacgggaactgttcatctccacattcatggagttagggggagttatatggtcatgctcttagtgaagtatattttataggataggcagattattttgcaaatgaaatctaagaatgtgtgtttgcatgtgtgtgtgtgtgtgtgtgtgtgtgtgcgcatgcatgtgagacaagttgacaggaaggtgggctgggatttggggcattttacatggacatcagaaacaaaatgtatgttctcaagactaacatatctaatttggaagaaacctgggggtaatcaggacttacaaacaataacattttttttcatggctaattttcccttaaagaaaacaaagctgccagcaatatcttactttgggcgggggtcgggggtgctaaagatttaaagtggagtcttgttcaccctcacttttaaggagaaattcagatccggtggttaatgttactgagtccacacaggttttttctcccttcggttccaacaaaagtgaaggaaaaaaaaaaaaaaaaaagccagagcgtgaaagagcacacagttgaaaataattgaaaaaaggagccagggagagagcgagggggagatccctcgccagtctctctaaatttaaaagaaaacagggatctgtgctcccagcttggcttccatagcagttcttgctcttggaaataaatgaatgacttttttttccccccagaaaagctgaattagacaagaacagtatcttgaaaggtggtgcaaggctaggtacctccatttctcaggtaccgggagggcagaagaggtaagtggctggtcaggtccgggtagttccccggagcatctaaatcagatactcagagttcttctcctgctctatcattactttatctcctctcctcatctttcgcttcaagcccttcctattttacccaaaccgtagaagtgaaatattggcccagcctggagaagctcagaaatgaagctaagcattgagttaggatgcccagggggagaaagtgcacagtgttgtccagtgccccacagggaatggtgcaatcacacctgagcccatcggcccagaaagcagcctctgccctgaatcattcccatcgattacatcttcattaaatgaccgtatctggcgttgcccatcctattactgcagttctgactgccttcctggcttgggggaggggctgagcccggaacaccaaactaacgtgaggccaatcacattcctcttccctacctcaaataagcaaggccacaagcaataggatgacacattcaacttaaaaagcaccgcgaggttcacttcaaagtaactggaagagaggacttgcaatgataccaacataaaaatagtaaacactgaggcgggtggatcacgaggtcaagagattgagaccatcctggccaacgtgatgaaatcccatctctactaaaaataaaaaaattagctgggtgtagtggcgcacgcctgtagtcccagctacttgggaggctgaggcaggagaattgcttgaacctggaaggtggagggtgcagtgagccgagatggcgccactgcattccagcctggggacaaagtgagactctgtctcaaaaaacaaaacaaacaaacaaacaaaaaaacactcaaggccatggataccccacgtaccctgccttgatcattccatgttctatgcatgtaacgcactcacacgtggctcatgaatacgtgaaatagtaactctcaatacaagagaaaaaaggcaccactaggatgtgaaaaagagaactgagtgcaagaaagatcttacagctcatagctctggctctgccatgctaaataactgacctgaagccatttcctttccttgtgtgtctttaatgctgaagtcatcccgggtctccacctctggcctccctgggcctctcccccattcctgcctgtctgcaggctaactcagtgtactcagagcgagtttgcctgggacgagacagctctgcttcttcctctgggctcctccaactcccacttccctccagccagaccctccctcatttgtttatcctaattgagaagcccccacctgacatctatatccccctgaggccctaccacgtggctttaatcctagttacccctccaggtccaactcagacctctccttcctggtaagcctctcccttcctgaccagccaggcctctggtgaccctgtccttcacccttcatggcccacgacgtctggcccttctgtacagtatagagataaagggcatgagctctggagccagacctcctaggttcaaatcctgcctctcctgtatactagctacttgtcgtctagagcaggtttctttgtttcttgtgacactccatgagttccttcttctcagccaggttccaggcagtggctcacgcctgtaatcccagcactttgagaggccaagatgggaggattgcttgagcttgggaatttgagaccagcctgggcaacactgtgagacccagtctctccaaaaaaaaaaaaaagctgggtacggtggtgtgtacctatagtcccagctactcgggaggctgaggctgaggtgggagaattgcttgagcctggaaggtggaggctgcagtgagctatgattgcaccactgcattccagcatgggcgacagaatgagaccgtgtctcaaaataaaagttccttcttctgcctgtcttctcagttacactagaagatctttaaggaagaagaccctgcctccgacttccttccttccccgccacagcacccgacaaggacacagaagcttcgcaagaaacatgacattgatcactgctgtctaataggcgacaggcccactgaatagtcacgtgtgagatctagattctttcctatatccctgggctttggtaaagagagtttagcagtactcaccaatagggcgacagacgcacagagaacacgaacacacatgtgcagatatatgcgtgcgtggttaaaggatttgtccaaggtgcctgggtgttcactgaattcccagcagagcacaggcatggcggagggtctattccctgcgctcagccccttagattacccagcccctcatttttatcctatggagcatcccctttctgcatctgacccattgtggcaaagttcatttcactctttctgtacttaaatttcccctctcttacatgcctaagaacctggtccaattcagttcacctggaaaatgaacagtgagtttcttcttggctggaatcttatttttgaaatctccccgcccaccccacttggcctgcacagatggatctgtgctccatggagtggggcttctggccgcgaaaccccttgcagggccctgagaaacaccggataaaatatttttctgttaaaggctaccattttcacctgactgtggagatgcagaaactctcagctgctctccactaactattcctgtagtaaccgtggtgctgagataagctcttgccctacacaggagtggctgtttcaggcagattaccctggagggcaagcacggcttcattcctaccgggttatcatgggctgcaggaacaggggctactgcacaggtccaagccctctcactgggcggggtaactccaaatctccctcctgtccagagctcatggggagggactgcagcttgttttgagcatcagaagccatgtgtgagctggaattggtgccaagtcctccttctaagcccagggctggagcgtcaacagcgcctaaaacccacttttgctcctctgtagagtctgatcttttttctgtctccctggggctaccttcttattgtaaatgtctctgaccttatggaaagtgatttcttagttgtcaggcctggttttagggaattacgctgctgtttttggggatgcatataactttaggtccagcggcagacaaagagaggaaaacagtgggtatgagctgcccagaccccagccacctggggctccctgcattccaacctggggccccactgtcttgcatctgacttaagagtacagggactttttacaaccctggtgctctctggggtacgattttgggtggagggaaaaataatttcatttctttcacatccacccacaatactaacatcctaaaattacagctcctggaataaaacaacgtagcacaactgctttggtgacaaattcattttcgcattgaccgtcctgcctgaaatacttttagaagctctaatgagggattcttcagactcttctatagcaaaagtttcctatggggacttactggtgtgtgttacaaagtgctataaagcttccttccagtgccccggcaggtaagacaaacacatacactgacacacacacacacacacacacacacacacgagccagggacacatgtggccagatgagacagtcaggggattgctacttacacacacgtgcgaacccactgcatttatcaacacatgtaattgaaaagaaagtttcactgtctgatttgagctccattccccaggagcccccaccctcgctccctgctccaaactgaccatgaacaacgacagccccaaaataatatccataacacgcccggccgagagccacgccatcccgcaagaaaaggacttttcaagcttacctgcgtgggtcatgaacttccacggaaaacttcttttctctgaagtacaggttttccaactgtctccattggaatatctggacagaaaacagtgtagtttaaaactcaggaggggctggctcctgggccatcttcccctctctgctggttaactttcgacagctggcagtttccttatcaaaacagagaccgtagtctgtgcctcctccgcctcttgcttgacacacacacacacatacacacacacacgcagctctccagttcaaaaccaggcaatgtgggtgtggattttcctgcaggttccttaactggaacaaaacaagttcttttcaagttctccgccttcggtcggcctttgttggtttggtcgtggcagtccccagcttggcagacttttcccttccaggagagggaggagaggtggagaccggggagagggacccagcagggaaggcggcgggtgaggggagaggagcgagaggagcgagcgctcaggagggagcggtagccatctgcgtggagtgctgaactgagcttcctcccctccagtgctgaaatgggaaggcgttcaaattcccagcctcccatcgggactccacttcctgctcactaatgtgtaagagccttgcaaagggcggaggaggctgggaccttatttcgggggcaggcaactcaagatcacagtgtgagcctgtcaagcccattcttcttgctgcagcacaaagaaaaccaagagttctgtcgcccggaaggacgctgcggccagagtctctccctcaagcttggccagggagggtgagaagtggaatgaaggggccctggcggtcattcctccttcggaccagtgagctcgttaactgagaagctgactgtaatgtttggaagtaattagggctgcatccaattgctccaggaacggggttcctttcattggatgaaaaagaaagttactttaaccctctgggaaatatcacaggaggttcaacttgtgtgcacacacatttgcattaatatttgctggttactgcatcaccttccacatactgggaatttcggtttattttgcggaaagaaggggtaaagtaggaatcttgttcttgtctttctgcggggaacagcttccctgggctcccccctttctctggccactgagttaaatgcttttcagggtcttaccccagagtcctcggacctcaggctcctgaccctctctgacctgctcatgttctgcccaccttagagacgtgatggccatttcctgtatctgacccaccctgtcttcccaggctggggacactgctagtcaatggttggctagtggacctagcaccccatataaaactgggctggaataaaaactgcttctggaatggccacattcttttatcctcacaatctgctctctggaattttacaattattttgtctgcgttaagtactgggaaggagaatatctattatctcttattacagagttgcctcttttgtccccggctcagagtgcatttcactctgaagcccaaggaaattgtatttttctttcttgttaagcatcaactccaggtgggtggagagacactgcaaggaaagcaaatggcccaaagctctatgttggctgacagctttgtgtcagagattcaacagcgccttagcggagtctattactaaaatacacagacccaggtctcatggtcctgtctgatgcttggccactataaatccttccattaaaacacccaaatttcctctctggtccccaggtattatatattcagcgacattccacctgaacttagccagagctacaaaaataccagaatgaacaggttccacgacattggcctcatagcctgggggcagtacactgagcaaagcggtcaggcaggcaggctttgtggtctgactacatctgtttgaatccaagctccactactttttttttctgagacagactctcactgtgtcccccaggctggagtgcagtgtcacgatctcggctcactgcaacctctgcctctcgggttcaagcgattcttgtgcctcaaccttccaagtagctgggattacaggactatgccaccacacctggataatttttgtattttttagtagagatggggttttgccatgttgggcaggctggtctccaactcctgggctcaagtgatctgcccgcctcggcctcccaaaattttgggattacaggcgtgagccaccgcacccaactcaggctctaagctgctggacctgacacaagttacagcatttcctttagcctcagttttcccctctgtaaaatggcaaaaataacccctctaaggtagatctcagcagccacagatcgtagcacagtaccggcacaaagtgaccttagatcttactatgaatcccaaatgctcttacttctcccaaatccttgcagattaaaagagagtaactccagaacaaccagaatcattcttttcttagatttcctaactcaagccctgagttttggatttaaaaaaaaaaatatgtgtgtgctgcaaatccttaaatacagagaatttttctcccagtgcctctcccctcctctcacgtaagggatgtggatggtacttcaatgaaagggtcctgttggctgcataccacggcggtccctcagccgctatcctgcacccgccttgctcaggcaaagtgaagtcttgaacaggatcggccttctgggtgtgcgacctgagggccctttgctcagaaggtccttggcttgatttcctgctctgctgttgatatcttgaaattcctaacaggtttttttttctttctttatatctttattctttttttttgtcttgttgctatacgctttttaaaaaattaatttccataggtttttggggaacaggcggtatttggttaattagttccttagtggtgatttatgagattttggtgtgcccatcccctgagcagtgtacactgaacccacctaatgggtttgatcaaggggccctgcatttccattttgcactgggccctgctcattgtggacttgatcctggccttaggtcctggcatgtactggtgctggcaggctctgtggggtaaggtgcctgccagcctaatgggcaggcctgggaggtggaaccctcaagccctccaagagaaggaaagaaagcagaaccaggtgtgagcacgcttgagaaaacccctgtgcctttcatgggaagcccccctccccacccgatgaagaaccccagagcagaatgctccgaggggttgtttccctggcaactcctgtctcccccattccatgcaaaataaaacacaaaccaagctttgctttaagtgctccctgatgcagttcagcgtggagaactgcgcgtctgccaaagagcccgaacaaaaccatctggactctgctgcatggccccgtctgtggctgctgtagctgcccgtgggaaggccctgcctccagcttctgcccttggctgcgaaccatggagtcccggctcccaggcctatccccgggatgatgcactagacatttttgtggcagggtgcagaacaatggattccccctgatgcttgctttaagcatgaatttttgttttgcaaatgcaatcctgggaaggaagggtaagagtaaagtgaagggatgggtggttttcaggatcagattgttgcgttgagacattagaagggcccaggaatgggctgggtatggtggctcatgcctggaatcccagcactttgggaggctgaggtgggcagatcacttgaggtcaggagcttgagaccagcctgggccaacatagcaaaactccgtctctgcgaaaaatacaaaatttagctgggtgtagtggtgggcacctgtagtcccagctacttgggaggctgagacaagagaatcactagaacccgggaggcagaggttgcagtgagccaggatcatgccactgtactccagcctgggcgacacagcaaggctccttcttaaaacaaacacaaaaacaaaagggtcccaggaacagaagagaaggtgtgcatgtcagaacagtagcctgatctgacttctcttcacttaggagggagggggtgagctagggagcaggaatatgaaggcagtagggaccaggagggtggaagcagctgccccttgcccagggccggggtgcagcttgctggaaaagcatcattttcttcatggggtctggggcatttctgcccatgggcccttgaggcttagaagtcctgcctgttaaatacctcactctgaggctggcagagcaaacacaacaatcaaatcaacaaacaggagatgctccaccttgcctcccctttgtaaacagggtaaggtgggctctgactgagctggtttcggggcagccccgatggtctgcgccacctcaggggagcctcccgagcttgcgctggctcagtgcagccgtcataacccaccaccatgtaaagctgccaacacactctgcctctccgcataaaaacacagcaggcacccataatgatcatcaggatgactgggccggttcccttagggatttgtgtaacgcctatggccaattatatccaaggagctaattaaaaagctaaaatacttagttctaccaataatcaaagaatgtattaattcatacctattaaatcaaggggtttctagtgcacgtcacttaagcatctttaaaaagccctgcaaacatcgttcctttgatcttttggcatccctcaagaagatcaagtgggaaatttacttcttgggtgaaacaaggcccagagaaattaaggaaaactgcctaaggccacacagcaagtaagtgaaggaaccagaaatagaagtcaagggcacctggtccattactctaacctctaactatgttgctttccccaggagtccaccaattagtgggaacagctcttactgactaatggatggttaactttacaagtggaatgatttttacaaatgagctacaatatgactgtaagtagaaagtaaaaaagcaaatctttttcatcctgcaccatggcctggctttccttttatacggtaaatgataacaagtattctttccttctatccttggagtcctggcttcctctagttttctatacagcaatgcttcaatactcagtagctttcaatactcaatgctttccatactccaaagactaaaacacaacgacaactgtgatgaaggacagcctgggccaggcatggtagctcacgcttgtaatcccaacactttgggaggccaaggttgggggatcacttgaggtcaggagctcgagaccagccttgtcaacatggtgaaatcctatctctactaaaaattagccaggtgtagtggcacgcgcctgtaatcctaactactccggaggctgaggcaggagaatcgcttgtacccaggagacggaggttgcagtgagccgagatcttaccactgcactccagcctgggcaacacagtgagactccatttcaaaaaaaaaaaaagagcaacaacaaaaaaaacagcctggatgatctggacttgcgtgaaacaaaacttagaggaaaccaccaagtagtggcttccttgagactatgtctgtccctgttgttgggactggctgatactggatgtggattcttagtttctgacctagacttgccgtgactcccaatgcgatcacaggtcctccacttccctgttctgggcctcagtatcttcatgtatgaaaacaggaggtgggaaacacttatccacggagtgcaaacaaaagtgggtaataaatactgcctttgagacctgaatgcaacagggtccactctaagtacttaatgagcagggaccagttactggtttctattagatggcctgctggattcccacatcctgtatttagctgaaggctggggcagaggaaggggctttggctccactggacttcctccccagccagcatttatggagagctgggactgcatgtggagtggtgggcaagctcccaggacgatgtggaaatagacgcttgagaggaagctcagtctagtggctctgatgcttgactaggactttggagaacctcgtcttcccccgctgcccctgaggctgagtcaccaagcttcttaatgatctccctatgagtaacttcctgtttcatccaggggggctattacacagaatcacagcagccatctggtccacctcctccttgcacagataaagtaaccccagtagagagaggttaagggattggcagaggttaaataagtaattgatgatgggacccacatcttgtgacttctggtcctgggctctttctaacacaccatgaagctctgacaatgaacgagaacaaagttgtttcaagcttcttgttctgagtctctatataagaagaattagactcatggacaggaataatctccaagctcagaagaaaacatacaaactgaaaaactcacttccttatttcatttctgccctttttactttctagagcagactggcacttgcaaatctttagacggatttacattttcagcaaatacaaatgagttgtttcacatctagagggctgcagggcaaaagaaaggagtcactgaacccgaatcagatggaatttaaaatgtgagagcacccagaaagctccaaacctgtgctctcagaggactggatcccatgtgccctggtaaggttttgctattggagcacagccggttctaaggggcaacagaagtaggtatatatacacatatatataatatatatacatatatgtaatatatatacacatatatataatatatatacatatatgtaatatatatacacatatatataatatatatacatatatgtaatatatatacatatataatatatacatatatgtaatatatatacatatataatatatacatatatgtaatacacacacatatataatatatacatatatgtaatatacatatataatatacatatataatatacatatataaaatatacatatatatatatatatatatatatatatatataaaatatactttttttttgagacacagtctcactctatcctccaggctggagtgcagtggcacgttctcagctcactgcaacctctgctgcctcccgggttcaagtgattctcttgtctcagcctcccaagtagctgggattacaggctcccaccaacatgcccagttaatttttgtatttttagtagagacggggtttcatcatgttggccaggctggtctcgaactcctgacctcaggtgatccactcgccttggcttcctaaagtgctaggattataggtgtgagccaacatcctggcccaggtatatgtttttagtgggttgaaatcatatgtcagaggtttttttttttctatcagttttttaggcattcaatatattttactttttacaaaaaaagaagacagaggcaaggcccttgggtttcaggcagcattgaattcccattccctttccaaccattcatgtagtagtcttctactttgtactggactgttctcataggcaagaggaaacacatggtgcctaatacatgtttatatttgtagcgagcttacaatctacttgggaagacaagacatacataaagtagctgtattcatgctacaggaacccatgattcctatagccagagatggaaaccatctctggtttctgtaccaggctttacaaactctatagaagtgccgcactgcaggctgggcatggtggctcatgcctgtaatcccagcactttgggaggcagaggtgggcccatcgtgaggtcagaagttcaagaccagcctggccaacatggtgaacctctgtctctactaaaaatacaaaaaattagctgggcgtggtggctcacgcctgtagtcccagctattcgggaggctgaggcaagagaatcacttgaacccaggaggcagaggttgcagtgagcggagatcatgccactgcactccagcctgggcgacagaggaagactccgtctcaaaaataaaaaattaaaaaaaaaaattagaagtgccgcgctgcctcattcacatatatctcatgcttttgtctcaaataatcagtattcatgactcttgtttactcttgattgttttggttttcatttttaggagcaagaaccctgggtgggaggtcaggagccctcagttctagctctgactttgtagagccctctccatcttagcttcgtcctctctaaaacgagggggtgtgtgggcattcctacattctgtgcatgggttgaaggtcagcattgtaaatccagagaatgtcaagctgcaattctttggaatttaaaaataaagtagcttgagttaaacatttcctaccgatgggagacaatatagaatagcatggattaaaagcatggttttcaacgtcatactgtctgccacttaccggctgtgtattctcagcaattgaatttgtgccttagttttttcatctttgaaataataggaataatagcacttttctcatagggctgctgtactaatgaattaatatatgttaaatgcttaaaatggtgcctggtacatagtgctgaagaaataatatgagactggtgcagtcagtggctcttgcctgtaatcccagcactttgggaggctgacatgggtggatcatctgaggtcaggagtttgagaccagcctggccaacatggtgaaacccagtctctactaaagatacaaaaattagcaaggcgtggtggcatgcatctgtaatcccagctattcaggaggctgaggaagcagaattgcttgaattcgggaggcggaggttgcagtgagcagagacgtgtcactgccctctggcctgggtgacagagtgagactcccccctcaaaaaaaaaaaaaaaaaaagaaatgctatgattgtacacattcccctccgtcaattacataccaatattattgttcaagtaaaacataaaagttatgaatactttgaacacatatcagcacaaagtacaggtttgtgtaatgtttttttgaaagacaactcatatggtgtcatgagcattgcaaaaactgttttctgtgaaattggattgtttacaatgcaaggagaagttggacccagggtccccattcattcgtttgtgctggagtttgctgtattctctttggggttgtttattcctagtcttattggccaattcctccgtccactgcaatcttgaccagagtcagttttgaccattttcctgttatgacttctaatctcaaaacattcaccctgcgaaaaaagtatcccattgtaagatgactcagtcttacacagaacagagtgggctataatgggaacatatcaggccctcccaaatacccaaacaatgacggcagatcactggcttcctaaatgggtctgaggatgtcctccatcacttgcactgaaagaggcatctatcttcttcagagatggccacacacccagcacaggagacaatggctaattcttctctgcagccaggcctaatggaatcaagatgttcttccggccaattgcgtcttcctcattgtcagacaacgcgagctctaaattgatttggttcattcagtgacagatacccagagcaccgggccttgaccccttaatggatggcctctttttaacccatcaaaaacctcttagcttcctttggcttaagagtcattactaggggaaaagggagaaagaggttaacaagtacttgacaagcccattgagacgcaggccattttgtttttctccattggacttgatttccttgtaattttctccctagaggcctctctctgtattattttcttgtgtgtattttggcttttcttgcagaaagacttcaccataaagctttgatgaatgtaaatactttcaagagaagctggaattgtttttcctttcctatcctctgccccctgatgtaattccttccctcctcagagtgccccaagggactggctggggtcagtgggttgaatggctgaagctgtccagtgatttggaatatctgggtctagctttggtttttctagcaatgagcactgtgacccagtgatgtgtggcttaacctctctgtgctccagtctttccttgaaaaaaagccaaggctaattctacctgctatgacagacctcagtgggatgcttcaaaggggaattaatcaatctgagaaatacttggtacatctggggagaaaatgatggtaggccatttcacctgctttggccaaggcatctctttccagattggtgtaaagttatttttcttaaaattttttaatttttgagatggagtcttgctctgttgcccaggctggagtgcaggggcataatctcggttcagagcaacctctacttcccgggttcaagcgattctcctgcctcagcctcccgaatagctgagattacagatatatgccaccatgcctggctaatttttgtatttttagtagagatggggtttcgccatgttgaccaggctggtctcgaactcctgacttcaagtgatctgcctgcctcagcttcctaaagtgctagaattacaggcatgagccaacgcacccggctaaattttttttttttttttttttaatcagggtttgactactttggaggacaggctttagggagaaacctgttgttcttgttttttttttttttttttccaggggtggcggggggggttggcagttggcatttctcttatgcctgctccagctctatccagagacgtggcatcatagagacatcccgatctcctctgtggaggtcatcggactgtacggaagatggggatgggatagaagaaaatggactggcaaccagctctgcagggaaatacaggcatacactcacaagaaacaccgtgctttatcacccataacaaaaagaaaacgaaatgtcaatactctgccctagcgatatctgtgcgaggcaaaaaaagaaaaaagcaagcaagcaaaccagcaagggctttggcgtttgggaataattatttaacagcagcttgtttgcactttggaacacctcgtgcttccagagccggcccatcctgctggggaggggagaggtcccagcgctgctgtctggcagaccttggtttcggtgggcaccagaagcgaggcagattgcttgctgctgcaacttcacgcgtgagctccaggctcccctggttggaaggtgccagggagtgaggcgggtgagcaggcatcaggccaggggtttgtggtttgcttttcaagtcaggctgctgctgggagaaggaacgcttgcggtctcgccagctgctctgcaattgtggcggcagccagcagagataggaggcggtgggcctgccccgctccagcctggactttccacttggagggcctgacttctccgcttgacccgagacatgcagggggctgcggctgggccacggtctctgcagctggggcctttctctctacggatcctcttgcgggagcaatttggtatctgctctgcgaggtttccttccagaaagaagtgaggacttcagatctagactttctgtctttccaggagggctggtcctatttagagctctgctctttcccccagaggacttctgcagtgtgcagattgacttggggaaactgaattgtggggaagaggaggggcggaagcagaggaggaagctgaggtgtctactctgcagcctgccttaaacaactttcttttcaccagggctatcccaagcctcccaaaattcccagccctggtctgggccagttctcccagatattcatacacatacctctgccaaagcaatgatcatgtggtgccgtaatggcttttatgctctaatgtcttcctcaaccagactcaaatttccttgagtatgttttcctggcacctagcatgtacctgggggcatattagacactcaatagttgtctgttgagtgagtgaatgaatgaatgaagagctttttgagatattagctattatgacaactgaagttcagagaggttaagtcactttctcaaggtcacacagacgccacatggtgggaggtgacacttgagccctcctctgtctgctcgactccatgctatttccaccatgtgaggaacctccagtggctgaacccagatatattgttaaaaatacatttctaagctgcaagggatgcgataatagggaaatggcagttagagtcagctcaaggagggacaatggtaagagccacagccgaggagccgtagcccttctttctggcagctctgttagaactgaactctactcttccaaggtgaactggggaagtctacgattccagcagctcatggtctcaaactggaagcctactcccaacctagaggtcagatctttacaaatcatgttgcctagaaattgcctctgtctgcttgaggtggtcaagaatgaccccaggcaggtaggaccccgactgtaacacccttgagccctacttgcaggtgccgattcacagcccaaggcgggcaggcagagttgggcacagcatgttctggctgtgtaaggtttggtgttaaacaggtttacattttccggaaggtcagttcagcctgggcttcccctctgaatcaaactcattaagaagaaggagggggaaaaaaagccttacacagcttcctaagtattggctggttcagcagaaacaagctgttaaaactggccaagacaaagaggttaccagaagtcgacaagcagggtttcccaactgaacagatccttagaagaaagcaaagaagtctagattaaccagaattattcaagggtctgcagtactccagcaattcactcaagatatcctcattactctgtgttcttttggtgctatggacaaaaataaaatcaaaggagagcccagatgggagcaatttttatgcttttcattttttcatcagcaaacctaagctgtaaaaagccagtccctctcctccattctcctcccaactatcttgctctctacgtggagctctctgcaacccttccttggatgagttatattcttttttgagacagagtcttgctgtgtcgcccaggctgtggtgcagtggggtgatcttggctcactgcaacctccgcctcctgggtttaagcaattctcctgcctcagcctcctgagtagctcagactacaggtgcgcgccagcacgcccagctaatttttgtatttttagtagagacggggtttcactatgttggccagactggtctcaaactcctgacttcaggcgatccgcccacctcagcctcccaaagtgttgggattacaggcatgagctactgcacctggccccagttatgttcttaaagcatcaatcaatgaggccactatccacagacataaggaggagtctgtgaaattagcagtgggtcgcaaaaatgattagatattctgctccggcaacttttatccattcaacaaccacgtgttgagtagctaccatggacctggcactgtgtcaggcactgaggatacagcagtgtatcctgcacattcttatgaagggagaggtgggcaaataaataagaaataaataagaaaactacgtggtacatacagtaagttagaagataacaggtttgaagcacaaatgggaaccagggaaggataggacagggtttgccactgttaacaaggtagccagggaaggtgttggtgaagtgacatcgagtcaatatcagaaagaaaccaggggcaaagctgggcagctatgtgagggaaaaggatgactgcagatacagaagtcaggggcgtcatttgtgtgtttgtgtttgctgtacaagtgtagaaaatgctgaaataaacatcaaaggacgatagaatattatgcagccctaaaaaaggaatgcagtactaatgtgtgctgcaacagggatgaaccctgcaaacattctctaagtgaaagaagccagacacgaatggccacataccatatggttccatttctaggaaatgtccagaataggcaaatccatagggacacaaagtagatgagtgggtgccttgggctttggaggatggggagaaatggacagtgacaaggtactccccttgtggccctctgctcttttgcctactgaatcctagtctggattaatcacagatcacaagacagtctttgattaaaactcaatgaaactctggctgggcctagaggctcatgcctgtaatcccagaaatttgggaggctgaggtgggcggatcacctgaggtcaggagtttgagactaccctggccaacatggtgaaaccccatctctactaaaaatacaaaaattagccaggcgtggtggcaggcacctgtagtcccggctactcaggaggctgagggaggagaatcgctggaatccaggaggcagaggttgcagtgagccgagattgcgccactgcactccagcatggatgataaagtgaaactctgcctcaaaaaaaaagaactcgataagacttattatttaaaaggagctagcagtccaggataaaacagaggatccctaatttttagtggcatcccttgtccataaaaagctccccgacccttgtcagatggcactcccactagggccgtcttctcacatctgctctgggggtctctacagagggcaactcacttcttccagcctgtcagcaccaggccggctggggcagcggcacctcagggtgctgttcttctacctcggggatgggcaagcactctctcatagacacggctagtgaggagtctggccagtgatccattttgtaaatgggttttcaaaccttaaacataaactcaattatgtccttaaaaatacacatgtgcatgcctaaaaatacacacacacatacagaggaaattctctcagctgtgacttctactgctcattaaaggtaggactggggttggttttcagtcaaacgtgaggacggagagaggctgcagggcagagctcctctggctcttggccttcctgttcaaaggccagagaagagacacccatgacaaggctgtgctcgctccagggggtacagggaccccacgcagtgcagcagatgccagggtacacctttcagaaagattataagcattggcaaagagatttgcaaaatcccgtgcagcagaaacacctgttggaaaagctagagagaaagaattgggtggttgcatgaactattccactggccagggctctttttttttttttttttttcctgactcagggtcttgttctgttgcccaggctggagtgcagtgatgcgatcatagctcactgcagcctcgaattcctgggctcaagtaacccccccacctcagcctcacaggtagctgggactacaagcatgcaccaccatactcggctaattaaaaaaaaaaattttttttttttttgtagagtcgagggtctctctatgttgtccaggatggtcttgaactcctggcctcaagcaatcctcccgcctcaatctcccaaactgttgagattacaggcatgagccactgtggctggcctcattgggaccctctggtcttcccaatcactggtttgattctcacctacacaggtttgtcatgaattatgctgtctgtgagtaacttcaccgctgcctaactagagccataggatagtaaactggaagttctggctgacattttatgatgagcagtatcactagagagggccatgagcagaccattccacaggagaggtgaaaagcaagggcagggagccggttagctgggtatccacgctggttagatagatctccatgctggttagacagatctccatgctggttagctaggtcaccatgctggttaggtaggtccctatgttggttagctaggtcaccatgctggttagctaggtctccatgctggttagctaggcttttatgttggttagctagctcaccatgctagttagctacatccctatgctgcttagctacatccctatgctggttagctaggtcaccatgctggttaggtaggtccctatgttggttagctaggtcaccatgctggttagctaggtctccaagctggttagctagtttttatgttggttagctaggtccccatgctagttagctacatccctatgctggttagctaggtcaccatgctggttagctaggtctccaagctggttagctaggtttttatgttggttagctaggtcaccaagctggttagctaggtcaacatgtatctttgtttgccagtaaccctggtttgtttgatatcatggaataattattcactaatgtcccttttcatttgtagtggtatcttggtttggatattaaaaccctatggttactaaaagacaaataactttgattccacttatatgagtgttcaaactcacagaaacagaaagtagaatgatggttcccagcagatggggggagagaaaagaggagttattgtttcatgggtaaagtttcagctttgcaagatgacaagagttctgaagatctgttgcgcaatgatggggatataccttactgaactggccactgaaaaatggttatgatggtagattgtatgttgtgtgcattttatcacaatttgaaaaatatcttctggttagatgaccccgaaaatccctcacccacaattgaggtataaagtgtttaggagggtggaaactgagagagcatttttagaaatgttcttgagagggagatgttctgtgaactctctgccacccacagggggaaggtagaagatgtactcttctccttcaacctggaaagagagggttcattagggttacctggagagcttaataggtatcccctgacatcagacgaactgaagcggggatggagctcagatgggagaatggagagatttaactttagagcaagtttgaagctttgattgtcataaagaactggacactctaatttcttaataaaagcttattttgctatttaaagtgactgggtgacgttgtaatacctgggagtgatcagaaaagtcatgggactgcccgtgtttttattgagagataaaggaagagcatgttcaaaggaacagtgggagataaaagagatttgtcagccgggcgcggtggctcaggcctgtaatcccagcactttgggaggacgaggcaggcggatcacgaggtcaggaaatcgagaccatcctggctaacatggtgaaaccctgtctctactaaaaatacaaaacattagctgggcgtggtggcgggcgcctgtagtcccagctactcgggagtctgaggcaggagaatggtgtgaacccgggaggcggacgttgcagtgagctgagatagtgccactgcactctggcctgggtgaaagagcaagactctgtctcaaaaaaaaaaaggagatttgtctattcagtcccaggtggtcgatgttcttattatcctagcaaagtcttctgtcttccagctagagaaaccagatctgttcataggttactaccggttcatggcttcttttggagcgagcgaggctattggatgctcctctgcagtggtttgggatccaacgatagcatttggttttgatttgcttcttcaaattgcatccaaggtcaacggggctccctgagtaatgggaatctgcatctgtagagttatttagaagccagccagtctcagggcggctgctacgtcatctggctgggtgtttatttgcatgttataaataccaagtgttgtgtttgacccctactgtccacacaatcaacgtggctatttatatggcctttctcagtgctggtccacgtgccttttcaggggcagggagaacagcaggtcgaggagaccaggcattgtgtgggaagcagatgaatcctgggagacacatatccccaaagacatatcagctgcagtaggaaaaccgcttttggttatttaatcagatctagcttgagcactggctccacgggagtcaaagacagacgtggggttacctacttagaaactggcattttcccctcctaccactttcttctggaaaactgttgcttttcatcctttctttcattcatgactcccctctggctttaaaatgagcttgctttatttaccttgttttatttctctttgtttctagttttaagattccttcaacatcaggattcccgatcatctcatcaaccgacttgttaagaaaactgaggcccagggaagtggctcacaattgtgtagaattgtgaggtgtcttgactgctgggccaggtatccggcaaataatggcagggggcaggggcaggcgtgcagcaccccaagggtatgtcaggcctggagactgacttcagagacaacttggggagattcttggagcttgagtgtaccccttccaggaggtgcctccaagcttgtcaccctgggagagatttagacctgcccctctttaggggataattacattcctcccctcctgtgactttccagattaattactctcatgcaatagttgctctctaagaattattcacctggacagggcaatgctttttttttttctgttcatagacaggtcaaccttcctcaaaggtgacagtctgacaccagcatgggcttcaacaagaacacaagatacaggctggtgcccttgggagcttggcttacccagaccagtctcgggatggccttcccagggccctgtgggaaccgaggaaccctggcttcccaggtccagtgaccaacaaaaaaataaccctcttcacaaagagacgttgtttgcttttcgaggccatcccacctcttgttttcagtataaatgactgtaacaatatttgctatgtcaaggccaatgccacttttatcctggggaatgagaaactctgtgacaagtaaacttattcaagatggagaaaattagactacatctattctgtgtctcttagtccccacttcacagatataaaaagagaggcacagggaggttaaataaattgctaatcatgactttctaaaataaactggaagtgagttagtgccaaggaagtgagttagcgccaaaattctttggtcaagaaaattcttctttgggggcctgggcaacatggcaaaaccctgtctctgcaaaaaatacaaaaattagccgagtgtgttgcacacgcccgtggctccagctactagggaggctgaggtgggaggattgcttgagcccaggaggtcaaggctgcagtgagctatgatggcaccactgcattccagcctgggagacagagtgagaccttgtctcaaaaaaacaaaacaaaaacaaaacaaaacaaaaaagaaacttctgttttgggtcttggagtggatatggaggtcatgaaggtcgtgaatttacaaaacatctctctctttttgtttagaagtgtaactgctctaggaaagaatttgactttaactcagactaaaatgtcttcataacaacagcaaaacaacgaagtaggatctcatagaaaggtcctcgttaactgcctgtatgcagagcagtgggccttaagctccactgcctgtgctcaagtcaccttcaaggcttgtggaattagattgcggagtcccatcctcagagtttctgagctcgtaagtctcaggcggggatccttagtttgcatttctttctttcttttttgagatggagtcttgctctgttgcccaggctggagtgtagtggtgtgatcttggctcactgcagcctcaacctcctcaaggctccaaagtagctgggactactcctttgtatttttgtattttgtgtgtgtagagatgaggtcttgttatgttgcctaggctggtctccaactgctaccatcctcctgcctcagccttccaaagtgctgggatgacaggtgtgagccacctagcctggccgttagtttgcttttttttctgagacagggtcccacgatgtcgctctgtcgcccaggctggagtgcgatggcacgacctcggccactgcaacctctgcctcccaggtttcagtgattctcctgcctcagcctccctagtagctgggattacaggcacatgtcaccacacccagctaattttgtatttttagtagagacggggcttcgctatgttggccaggctggtctcatattcctaacctcaagtgacccacctgcctcagcctcccaaagtgctgggattacacatgtgagccaccacacctggccagagtttgcatttctaacacatttccatgtgatgaggatgctgctggtccaaggaccacactgagaaccactgctgtagaagataccatgcagcaccgaccagcctctttctccctgcaggactgaaggacgtacgccctctcccggaatcgtctcagctacagagaaccaccttgcccaaggtcaccaccctcttgccaagggggtcacttggatctaatgattggttaatgctggggggagggggtaagtcttggcccccagcctcaacagtgatggcggtggctccggggtcatcctagcttccgagtttcgtctaggttgagggcgccatgttgggactgcatcagcttctctctctgcctggttctgcttcctttactttaccatttgttgttagtccagggcacaccccagtaaacttcctgcatgcgagttcatcttagactgcttcccagggaatcgtatgtacaacactcgggagtagagagtcactgaaacggccctagctctgagagacccctcctgaccagccatcacccctcccgctcttccttactctgatttattgtcttcgtagaatttaactctcaggtctatggccatactgccctgaatgcgcctgatcttgtctgatttcagaagctaagcagggtcgtgcccggttagtacttggatgggagaatttagtgctcgaacactattgctgtagctttctttaataaataaatttgactgcctttcctgctagactgtaagctctgtgcatgcagggacatagtctctcttgttctgcagagccaagagcagggcctggtacctgacaggcactcggacaacacgtactgaacaagtgaatgaacttccaggcaggaagagtcacacatcctcaccaacaactcctagggtttcagagaactagaaagtctaggaatacagagggtgctttcaaaagtgttgtctgtaattggaaatgccttatgtttgtttagtgctttagttttattcatttttttttaaagcagttcattcaatattgatagcaacccatattatcataaacccccatgtggtgggcaagatagagggttgctttgaagcactgggagaagagaaaccggccttggtgagttgagtctcttgctcagccaggcccacatggaaatgctggtatcctgcctcctggacccatggtcctgtctctgtatcatcagcagaagcaaactcaagtcagttgccactgaaactcaccgagtctgactttcccccatgaatactcatatgggggccattttattggagaggatttcatattcaccaccctgtacggaattctaagtgctagctcagtgctttcaggtgattaccattctttttttttttttttttgagatggagtcttgctgttgcccaggctggagtgcagtggcgtgatctcggctccctgcaacttctgcctcctgggttcaagcaattctcctgtctcagcctcttgagtggctgggattacaggcgtatatcaccacgcccagctaatttttgtattttttagtagagacggggttttatcacgttggccaggctggcctcgaactcctgacctcaagtgatccgcccgtctcagcctcccaaagtgctgggattacaggtgtgagccaccgtgcccagccgatgaccactctttagagtttgggattattcttccaaatggagatgattcagccatgtctgatattggtgatttgagaaggaggatgtctaggattgatgctttgagaagacgatctcaattttcttagaatatgattccttttgtccttggagagttatttttaagtagcagattctgggaactccccatgccctccacctcctactcccaaattccgcccccgcccgcccccgcggccaagtaggcctggtctctagacgcatggaaagcgttcaggtccactcagactgtgctgcgatctgaaagaatgataacatacgagaaggccctttggtcctacactgtgaatgagtaaggggcagctgcaaaatgctaagaatgctgagtgcattaagtgaagtgtttctcccaggtgtgcacagggtgtggcttccaaggggaatgtggatgctggaatgagggaggcagccacctaggccggtcaagtcagaggcccagcaaggagaaagcgagccaaggcaaacgccgacagaagagaacgataaatccgcggcgcactcggcagaacgtacaccgcaccgcataatttagcggggcaatgccgccgggagtccacgccaagttaatggaatatttcctgtaaatattattttcccttcctgtctcatcatctcatttcattcaaaaatctttactaatccgggggagtgaaagtaatgcatcaatttccagagccaatgcccctgcttccgaaatacccttaggaatcactggaagccaccgcggctgcttagggacaggggggcaggccgtttactctggttccttctcctaatgcctcagaggggaccccatagtgctcctaattgtgcatctaagtgtacataaaagcccccctaattgcacatcaaataaataagtaaatgctgtctgctgaatatgtaacaaggactgatgttgctatttcttcccaggggggagatttcattaaatctgggctgcatttctaagtgatgatttacagatattgaatattctttacaagggaggcttttttggagttatgtgcttcacaatatttgctctaatgcttaaagcctcagatacagcctgctggaggtctctttattctaactcttagtgtccttttggaaagtcttttctgctttaatgtgtaatggcttccgatgatcagatggctggtttgtctgcaggtctggggactgtgcaaccccctggtctcccaatgcctcagttactgacgctgcaaacaaggcagattgtcccagagattagagctctcaggctttctcgggcttcaatcaatcaaaggaacgtaaggacccctcccctacagagagagccggacgtgagccagattttgtccagacttacttatatctgccctgtgggatcccgattctgcaagatttaataaacaatgcctcaacagatagcatttaattttcattcaaacgtttccagggaagaaagaggtaaaactcttgcttgtaccagcacaactgcccgaaacccgtgggatacccagtctgaggcatgttgctatcgacagtcatttcacacagctggcagttttttcttttctgatggcctagctctctttactccaccgtaaatgcaaactaagacgaaacttgggatttacctccggtgcctaaatgccaacctgacactgtctcattgtctcctgagcccagtaggacggtaatttgtgaaatacggagcctctcacctcagcagcgcttctttctattcccacacatatgcacatgctaaaatggaatgtggtaactagcataaaatagggtacaacaattgctgcaagatttgtttttttggctgggcacagtggctcacgtctgtaatcccatcactttgggaggctgaggtgggtggatcttttgaggtcaggagtctgagaccagcctgactaacatggtgaaacccagtctctactaaaaatacaaaaaaaaaaaaaaaaaaattagccaggcatggtgacacacgcctatagtcccagctactctggaggctgaaccagcagaattgcttgaacccaggaggcagaggttgcagtgagccaatatcgtgccactgcactccagcctgggagacagagcgagactccctctcaaaaaaaaaaaaagattttttttttctattgtgacttttctacttctgtcatcactgctgagccaagacagacatgtaagatcccgtcagcaccgtacttggatgctgcattcacaattgtgaattccaaccgtagccatgacaaaggagagaggagagctacaaagcactcaaagggatgtccccaagtgtcacatagcgtttgagtataaacaggagatcagaagtggggaggaaggcaaagagggagggggaaacatcattgggtgaaggactgaagtagatttactgagagctgatgacgggacatttaatgtcctataaaaaattctacatcttggccgggcgcagtggctcacgcctgtaatcccagcactttgggaggccaaggtggggggatcccctgaggtgaggagatcaagaccaacctggccaacatggtgaaaccccgtctctactaaaaatacaaaaattagctgggtgtggtggcacgtgcctgtaatcctagttactcgggaggctgaggcagaagaattgcttgaaccggggaggtggaggttgcagtgagctgagatcacaccattgcactccagcctgggcaacaagagcaagacttcatctcaaaaaaaaaaaaaaaaaaaattctacatcctatcctcagatagtgtttagggttctgcttgacctcttaaaaagaacttatatatgcaagcaagggctgatattctgggggaggtgcatgcattgtagattctgatttttcttagtcttgtttgctgctttttttagggtgttctgggagctgttcttccatatatgttgttccaaaatactaccgaagttggccttcagaagttcaacgtctctgaactcttctgaacacgcacaaaagccaaaatccagtctgcagggtgtccccacgtgttcagctgttcctgacatgtgtaccctgcaggcaatgaagctgtgattttcgattttttgacaaactccagcagcttgcattgagggctgtgcttctgaaggccaggaggctgtctctttagaaggtccaggtagcagagtgtggggtttaaatgttctctgttctcggagccaccggtgaggtcccttgcgttttactccaacccccaagagcctctaagctccagactggtgattaagtgactgagggcagactctgaaactaggatggcaaactgcttgcaactggagaatgagggacgggctactgttgtgctcttttctggacagtcatcagctactctttcttggtgccttttttgtttgtttgggcttttttgtggggatgaggggtaggtcatatggaaacacttaagtggattctcaaggcggctgctgagcccctgtgagtgtgccgacgggttgccaatgctgttggagctgtgcaggcagtggacgcctctgggctctgaaaaggagagggagcagactcacccctgccactgcctctacttaaacatgggctcttcttgtgttggtgcaacgtgacagagccgctgtaactgggtcagagtgtcagggagggcctctgtctgccgccgggcaggagcagctgcctgggctggagatgcagctgttactgcagaagcctccaggtgcacagtgctgggtgtcactcccttgcctgagcatccctggaggctcgaggtggcagagatgtgccaagcaccagagccaagagggagtggcatcccctggagtgccacccctcccagatggctcacccagccatgaggcccatgcatgggacctcccctgccctcggtgtgcagggacactgctggccacactagggagcctggctgaccttccccatgtctgagttttcaaagcacagagggctgccagtggtggtccttgtctccaggacatcagaatccctgtggggcttcttctgggctcagtggcctggtcggaggtgtaggtgagaaggcctgcagggggctgtggcatctagatgtcccagcagcttcagatgagttcctgatgtacagcggaggttaagagccactggcctggaggcactgaagacagacttttggcttaggtgcggacttgcatcgatatgcattcacacgtgtgtgcatcttttcagattctgagatctgggatcagggtgtggggctttttgtagcctcagaaactgacatgtcccttaaacataacacagatggcctttttataatggtgatgaggttggcaatgcaagaaaaacaaacaggcaccccgtttaggtcttcttgtagctaaggcttcttaacaatggctccagctgagtccacggccttgcctttaagttccatctgacatcttagcggggtgggggggtacccctagaagctaacaaaactaaggttttgctttccctcaagggcttttcaaaggcctggttttttttttggagatggagtctcgctctggagtgcagtggcgaaatctcagcgcactgcaacctccgcctcccgggttcaaatgattctcctgcctcagcttcccgagtagctgagattataggcgccccgcccccgcagcaggcctggctaattttgtatttttagtagagatggggtttcaccatgttggacagctggtcttgaattcctgacctcaggtgatctgtccgcctcggcctcccaaagtgctgggattacaggcgtgagccacctcacctggccaaaggcctgttcttaattttatattcagattgtacattcatttcttaaggagggccccaaattatgtaagcttcagagcccatgcaacggaagctgcctctgcatctcaccgtgatcgtcgtgattgggaaatgaactcttcactcctagctactggtgtgccaactgccaatccaacctcctccctctgtccagtctctggttcagtgatgctttggaaattcttgctactcctgagctccagctgaatgcccaactgcctactagtcacaggcacctggatgtcccatcaagcctgccgcgttgcatgtcctaagctgcactcatccctcatctgtcactcccagacctcctcttctctcagcgtccacactctggtggatcctgaagcctgggagtcattctgcattgccctccttctctcatggcctccctcttccgcctacaggtgatgagtaacacacaccttctcaacatcttggttccccttctccatcctgaagccccgccaggtgttgcccgccctaccctcatcatgtcctggtttctcagtcttgtcctgggtttttcctatccagcctccaagcagtttccggagagtgcttctacgacaatggaaatctgacactatactcctcagcttcaaatagaccgcggctaacactccctatagaggaggaagtcctcttcgcagagccttcaagcctccaggagcctgcaggccccagccccctcaccaactcctctcttttcacttgatgttccagaatgaagggcactgtgtcccctacccctgtcactgtgatttcaggcacactggcctctcccctgcatgcctccccgccccattcctccgtctgcaaaattctttgcacccttgaagaccccactcactctctgcttcctctgtggggacttctcttctccttacacccagttgacgcctgccttcttgaatcatccccgaccctcacacagattcctattacaccactcagacactggctggattatcacacatcttggaggacaggatttatgtctcatctcagtgcccagtgatgtgcttggcacctaataggtatgcaataacttttttttcttcttctttttctatttatttatttatttatttatttatttatttatttatttatttatttttgagatggaatctggctctgtcacccaggctggagcgcagtggtgcgatctcagcttactgcaacctctgccttccaggttcaagtgattctcctgcctcagcttccccagtagctgggattacaggcatgtgccaccatggccagctaattttgtatttttagtagagacggagtttcaccattttggccaggctggtctcgaactcctgaactcaagtgatccacccgcctcggcctcccaaagtgctgggattacaggcgtgagccactgcgcccggccacaataactgtttttttgagcgaatgaatgagtgatggctgtgacagattggtagtctgtccttcaagtaggaatgggctggaaaattctaacttcttcctccaaggccacagaaacccaagtgattttcaataacaacccagtttgggttagagacaatggcctggaaaactatattgaccttttgacatttttaattcatggacctggataagttccattcattattgtaaattctcttatttgatggctgattattcatgcctttggcctcttaattcttatcttgaagcctgttttagcatcttataataatagttataattgactgagccctagctatgcatcctttcctgttttacatacatcaagtgctagctcatcacctcttcactcttcattagaacctcaattagaggaataaagaaagcttaaacatattaataaattgaaccaaacaagtatgaatacttgttagcatgtcctctaaaaagcttagagggagaagagatttcaactgctggattttaattatctctgctgtagacctcaattatgcatgtcggccttggtcttccaccactacaggcaagagagagctcaatgtattgcagccagaattttgttaaaggctttagggagtattcttggcttttgcaagtgcaaaaacagtcaggcaggttgaaaagagaagagtcaggccaggtgtggtggctcacacctgtaattccagcactttgggaggctgaggagggcagatcacttgaggtcaggagtttgagacaggcctggcccacatggtgaaaccccatttctactaaaaatacaaaatcagccaggcgtggtggcaggcgcctgtaatccagctactggaaaggctgaggcatgagaatcgcttgaacctgggaagcaaaggttgcagtgagccaagagcgtgccactgcactccagcctgggagacagagcgagactccatctcaaacaaacaaacaaacaaacaaacaaaaaacaaaaagagaagggttgttctaaaaagaaggagggaagagagaactcaggaagaaaaggcacagaaaattaaaaatgccacgtgggaaaaaggcacagggaaaacaggaagaaaaatacagggaggaagaggtatggatcccacaattgaggaacacaaagccagaaaaggtaagaacagggggtccaattcatttcttgttgcatataaatggataaggaaaggctttggagatagccgcaaaacaacactccctccacccgccaaagagccaggttcttcctgaattgttctcagtcaataattcccccatcatttgctcagcatcttttcttagaacttaaccaccttactgatcaatggagtaaaaatcctcccaacatgggaacattttttcttctatcaatttaataaagaagtttgccaaggacagatgttaactggagagcctacaatccacttagatatgtagtgtgggtttcaatcctattcgaggataaaacagcttggaaagcaatctggaatgacataatggcccaatattgctttctctctgctaaagcaagtgtggttttcataggtttttaatatgtatttcagggtttggactgcataccatctcctttattctccaccgggggatctgaatgatagcactcgcctctaagatatgtttccattataatttttcaatttgttctggtctgaaaagtgtttgtaaatgaaaacagagaaaattcaaacgttgtatccctttcaaacattccattttgggtttacaaggactttgcaaaccgttttctgtttctctccctcttcagcaaataaccttattttctgatcacctttattgagccagaaaatatgtgctggatttccaggaaaccctctctctcttatttttcagcttttctgttttttgttttgagacaaagtcttgttctgtcacccaggctggagtgcagcagggcaatcctggctcactgcaatctccgcctcccgggctcaagcgattctcatgcctcagcctcccaagtagctgggattacaggcatgcaccaccatgcccagctaatttttgtatttttagtagagagagggttctaccatgttggccaggctggtatagaactcctggccttaagtgatccacctgcctcaggctcccaaagtgctaggattacaggcgtgagccagcgtgcccagcctttcagctctttttgacctgcaatctcttctttcagctctcccacctcccctgatcctgtcccagaaatctttgggagaactcagactggcttcaggattcaagagaaatgttacatcatttttccaaagaatacagccctgcccgaaattaaggaacaggatagtccctcaaaagtctctttgcctatctgctctggggagaactgagccagtcatctcaccttaagtaattataacagcttagatttccttagagacagggagaaaaaaaagaaaaaatatttacccagggaactcagatgggattgctgtggagtaatttgtatacactaaaattagcaggagattggtgagcctttaggctgcatggcgttagcatttttaaagtgactcctacgcctgttcctctctggatctgagaggagttaaacccaagcaggagaccagccttacctttcttggcttcactttatcatggtagtcatactggaagatccctttgtagctcaggcccagccaccatggtatgccctgcttgtcctaggatatcaaaaaaagtttgggtgaatatgggactggaggaagtaaacacacgcaaagtggagatttcctggctcaggggcagacgagggaaagggccatttccttggaatggatggagcccacctgtctactttgtttcttaacagatgcgtctgtcattgaaggatactctgttatgtgaagagggtgacatggggagtgccgggggctgggggcctggctctgctcttaatcagccgcacagccgaggtcctttccctttataaataaggaatgaatgccctgcttgcgctctctctctctcttttttttccttctaagaatttaggcattccatgccgggatgctcactcaccacaactgaaaatctgtgagatgtcacacctaataaaaggaccttctgggcagagaaactgtcatcgatggtcagagccagaggagctgtggagactatggaaagtgactcctctcattttaacaacaaatcacagcaaagagttggcccagctttacccaggaccttccccagctccggggagcacaggctggaaggtgtcaccctgaggtcctgctcacccaagatgacagctgggtgccaggcagggttttaggactcatgctgttggacagggtagcacagtggaagctgaaacagtctcaggactgaattagaaacaccaagtccctgtttattcctttttttttgagatggagtctcactctgtcacccaggctggagtgcattggcacaatcctggctcactgcaacctccgcctcccaggttcaaggaattcacccacctcagcctcccaagtagctgggattacaggcacgtgccaccacgtctggctaatttttgtatttttagtagagacaggatttcaccatgttggccaggctggtctcaaactcctgacctcagctgatccacccgtcttggcctcccaaagtgctgggattacagtcatgagccactgcgcctgcccccactgtttattaacagagacctcttgtcacctgagcgtaagttgcaattctatattcaaataggatgattctgagttaattagagcccccagaagctaggattttatagtgagcatatcaagcagcttttccctaattgccaagtttctaaataacctaatacaaccccatagtgggtgtctggaaaacttgaaactggcatcacggttttgaaatatttgtggggcgtgagttatttcaagatgagcaaaaagatgaaaggcaaaagagataaattttgaaatttcttttcaagcttctgggtatatgatttcttaaaactttaaaggtgggataaaatccttgtattaaacccctgcctctgggaagcagctgtgtgcactgcaacggtttcagagaacagaacaagaggaaacccaatgccactgcaacagcagattgaccagagaagggctgtcatcacaccataaaacatggcatcagtgagaccacaaggccaccagacagggagcctggtgcagctgggccaggtttcctggattcgtgctcttttccaaattagtagcagagccattgcttatgctttgaggttctaagtgccaaacacctctactcctttggcactttgaaaatcacaagccctgcttttgatctttaccaaactgaaataaagagcacagttttgaagttttcttggaaggcagaaagcatatatatcagaggcagcctttctgttaagttctagggctgacaaagaaatggaccacaggttgaagcaagttaactggatgaagttttctgtatttgaaattgtctccccgcagtgtgcaatcttcctgaccaagtcctccacaacctccattcccaccaggaattataaagaaaaaaacaatgagggccaggcgcggtggctcacgcctataatcccagcactttgggaggccgaggcaggcagatcacctgaggtcaggagttccagaccagcctggccaacatggcaaaacctcgtctctactaaaaatacaaaaattagctgggtgtggtggcgcatgcctgtaatcccagctactcaggaggctgaggtaggagaatcgcttgaacccgggaggtggaggttgcagtgagccaagatcgcaccctgcacaccagcctgggagacaaagcaagactctatctcaaaagaaaaagaaaaagaagaaaacatataacgagatgttttgatttgtttgcttaggggaggtttggtaaccttcaccaaatgagtctactcaccttcactgcataatagtgaaccccgtaggttgggagagactccacgatgctcatgtagctggaatgacaacacgaagatacacaaacacacacacaatgcgcaaaaggctagttattcagcagatctggtatcatatatatatttgtgtatgtgtacgtgataaagttctcggagtgattatttacttgaaaattaaatggaaacatacaccccccactcccagatatgtctttggagaggaactgaacaatcctgacatacgatatattaacacacacaaacactgtccccatgtgagctgggaaggggccacttactttacgattgcttgacctcttgtctgaccgttcagtttcttgtagtgctcaatgactctgtcttcactgtaattagaagaaaagaatgctgttgttggagtctctaggtcaacagccaagcttcctgccagtaagatatttctcagccccatctcataagaagctccaaggcaccaacagctcctggaaaaatgatttgtcctggagtggtatttccaaactcggtctgagtgctatctatttggatgtagatttactttaaaaagagtctgttttccccacaaaggacttgcattctctttgtcttggatgtttgtttttttttttttttttgagacggagtcttgctctgtcacccaggctagagtgcaatggtgcgatcttggttcactgcaacctccacctcccgagttcaagcaattcttgtgcctcagcctccagagtagctgggactacaggtgcgtgccaccacacctgactgatttttgtatttttagtagagacagggtttcatcatgttggccaggctggtctcaaactcttaacctcaagtgatccacccaccttggcctcccaaagtactgggattacaggcgtgagccaccatggctggcttatcttggatttctaatcaagaaatataagactggagcccaggccgggtgcagtggctcacccctgtaatcccagtgtttagggaggctgacatggggggattgcttgagcccaggagtttgagaccagcctgggcaacacagtgagaccttgtctctatacaaaaatacaaaaattagccaggcatggtggggtatgcctgcagtcccagctacttgggaggctgaggtgggaggattgcttgagcccaggaggtcaaggctgcagtgagctacaattgcaccactgcattccagcctgggtgacagagtgagaccctggctcaaaaacaaaaaacaaaagaacaaaaagactggagcccaggttttgggatcagctccttggaagaaatggtaccgtgggaacaagaggaagcagacagcagagatgacgcatgaatgcccgggctgagctccctggggcccttcttatcctcatcttcccagtcctgttcacacagggcctcatgggggaatggcaggcattgaccttaaccaagtgcccacagcctacctgctctgaatgcgtagtcaggaatggaaggctttccaggaggatggaatgttctggaatttgggcttggttaatatgaaccatgaagcaacaaaagccccataggaatgcttggagaacaacagcaaaccagctaccagaattagacaggcgctccctccttttttgaaatcttaggtgtttttgtttttgtttttgagacgcagtctcccttgtcactcaggctggagtgctgtggagcgatcttggctcaccgcaacctctgcctcccagtttaaagcaattcttgtgcctcagcctcctgagtagctgggattacaggtgtgtgtcaccacaccttgctaatttttgtatttttagtagagatggggttttgcatgttggccaggctggtctcaaactccgggcctcaggtcatctgcccacccctgcctcccaaagtgctgggattacaggcgtgagccaccgcgcccagctgaaatcctagttctaatataacaagaggttagctggctccttggcagcagtggcaagcccgcctcctgagaagtgactctggtgcccatgaggtaggagatacggccgctcccacccccgctttcggaagggcagagccaacctggggaatcccagggaagcaggtgcaggcagaaagccccaaccccacctgctgaggtgtggagtcgacacctcggtctccctggtctggccccagagccttggaacctcagttctcactctcaggtcttactcctcttcaccctccctgtcctctgtcaaagctctgtgaggggagctgattctaggggtgtaccctcgagatctcaatagaggatctttattatctattatttttgagacaaggttttgctctctcgcccagactggagtgcagtggtatgatcctgactcactgcaacctccatctcccaagttcaagcaattatcctgcctcagtcttccgaatagctgggattataggtgtgcaccaccacgcctggctaatttttgtatttttagtagagatgaggtttcaccacattgaccaggctggtctcaaactcctgacctcaaataatctgcccatctcagcctcctgaaatgctgggattacaggtgtgagtcactatacccggccctattatctattatccatcagcccaggatctacctaaagccttcttttacccacctttttgttttcagttttagcaaggccagtgttgggggtaacaggttctacacattcatcacctagtccttgggggtaatttatttctcttccaatgactaccttaacctccaactagtatcttttaattttaatactctggaatttgatgcatagaggacagtgagaggtcttgataaagaagggtctttataaatacccagaatgaggaccagccagctacagggggccttgcctcagttggagagtcacttctgtggggtctggatatcctctattcagaaaggggcagacccagccatctctctccttggctcccacatgccgaggaagttctatatcaagtgtgacaaggtcgtctcctgaagacgattctcgaaaagcatgctccccaagggcaggcccagcctcactaatcctgcagaactgcgtcaggaggttcagcggctccacttccttccatcccactcactaaatcaacagctgccttggcgtgtttcctaccacgtgacatggggttttgtgaagtcgactcctagatccagggtcaagcaactcagtgtagatagggacctttttcctttgcagcactagggagagagggtccctggggtgagttcaggaggtgcaagtcaacatagcactgtagccatgaacacacagaaggctcaggagaaacaccagtgaaagaaagtcaaaaccactgtcagaaagccgcgtcgctgtttaaccacgacatgtcctgaccacagggttctgggtggccgacagcagcagaaatctttgccgccccctgtttgccctgtaactcctgctctctgaggccatctgtgaagccacaataattgccttctccatcctcagcttttcctgcttgttttgcccccttaaacatggtgggcttatcctggaagaacaggctcaatcctgaccgagaacctattctgctcccagcctgtccccacctctgctctggaacttgccagagggctgaagtgctctgagctttgcagacaattttcccataccctagatttgtagcagggactcaaggggataactagcagaaatccaggaagcagagtaagtgctgcctggaggacacagggttacatggaggaaaaaggcaaatgatcaaagctgcctgtgcccaggtcgctggctgggtcatgttgttaagtcaaatgacctctcagcagacaaggggatacatgaaatgcatgggtgatggaaggggaaacagggatggtgatatgatatggttccccgtcttggagcagctgctggcctgctgtgctcagtggtttcggggttaaaaatagatgtccctgcataccttattgaggcgataggggtggtcaggtggtccagcatttacaaactaggcccgcgaggcagaatccaggtcagggtcctgatccctccttgttctgtggccctgggcacatcattctaactttctgcctcagttgcctcctcaacagggaaatcgcacggtgtgaaaagtccatgcttgttaaatgcatggggagaattagcagaaaggcttcttgcaccataactcagcattattatgctgctttcactgctttttaatgacataatgtgactatgtatttcctctcttaattaccgtctcaagtaggttggtgtatgtcatcccattttgcagaggagaaattgatgaaagctacctggctagtcactgcagaggcttggctgggatgctaagacccactgccttggttaccaggctgcagcctgcaggttgcccatccaatgtgcgaactccagcgggggcaggaaagcccccgaagaatggtgagtacagctccttagttcaggaatgatcaggggaacttgacactctgggtaactgtgatgagacgggtaaaaacgtctcccccaccagtgaggggtcctggttaaccttgctgagtggtgaatctgaggcccagagggaaaagcagtgaacaagctgtgtgcacctgctctctcttcattctgtatctgtaggaaggaggaacagcacttatccctctccttgcggctttgctttttaaaaatctatgtatatatagggatatgaaaatagttagctagaaggaatatgttctagcatttgatagaacagtagggaaattatagttaacaataatttgttgcatatgtcaaagtagccaaaagtgaagacttgtaatgttcccaacacaaagaaaagataaatgttcgaggtgatggatatcccagttaccctgatttgaccactgcacattatgtacagatatcagagtatatatacgtgaaaaatatgtacaactattatgtatcaataagaatcaaagtccatataaataaggttgaaatattagagccaacatcaagtagccaaccacagtgaaatgaggtgaaagggcctgttgtggttgtggttgttgtttttcagtagggtatcgtcaggagggtccctgtcattgacttttatacatcgtctgggctgtgatgctgactgtgatacacgtggctcccccgtcctgccacactctcagggcatttaacactggcttgggcacttatgggtctgaaggaggctcagggaaagcgctggcctggtcgtgatggtatgggatgttctgccaagccagctataggtgaagatgttcatatgcagaagagacagagagagtgtgtgtgaagggcgaggtgcctctgggttagtaatcatgtgtgagtacagagcagataatggagatggtgaaggagaaatccagagacacagggaggagagaagaaattcaaaactctcagatgagcatagcagtgttctaaggtttggaaaggaatgaatgaagggatgactaagagacccacaacaggacaggtctcagaggcaaagagattcctccctggtcctctctagttaccttctcacatccccagggccttgaccattggatttttggaagtgaacagccaggaggctacagagggatgaggcccagtggcacaaggaattagggaggtgggtaatagggtccatgaacaaggaaacgggaccatcatttttgggggttcggattgcaagtctcgacatttggaagctgatgcatgcaaaatccctgcaagttaacagattttgctctttgggggcaggttataattagagaaagccatcatttatttacatctatgtttccaaaagaggagtggcaataaaacagctcagagagatgaaattagggacgccagacacggaagggagctcccagcctcgggtcttggggccagctccctagtgatgtggtctctcagagagatgtgatttatgagccagagttgtttttttgtttgtttgttttgagatggactctcgctctgtcgccaggctggagtgcagtggcacaatctttgttccctgcaacctccgactcccaagttcaagtgattctcctgcctcagcctcttgagtagctgggacaccaggcgcgcgacatcatgtccagctaatttttttttgtatttttagtagagacggggtttcatcatgttggccaggatggtctcgatctcctgaccttgtgatctgcccgccatggcctcccaaagtgctgggattatgagccagagttcaatgctgctaatgagccctgcatcaagacatgccctaccccagacacacgaatcagtgaacaactaggtcactgtctggataagtgtccagacaagacaaaatgctcataatccatacagttcagaagttgtcatcaaaagcacttacacaagtcacgtattgtagtttattagaatcaacttggtctgtgctttttgttttgcttttaaataaaaggagttgcaatgatttctgttaggggatcagaaggaacatcagagaagaggtattacagttattaaaggtcagtggccagggcttaggaacccagtaggatttcaaaacattatccaggaatgcaagccctgcccaactgtggcccaaaccacaacctgggagtctttcaaatggcttgaatcattcagaatcagccatttagggccgacagatgagctatggcataatgttacatagtggctaaatcaggagatgtgaaacatcgagggaaaataaaacaatcaatctccctcttctgaaagaagaaaaccctgtggttctcccacgtctcaaaacctcacacatgctgtcatcaaatgacaggtgttccaaaatgaaactctagcagcacatgaaaggctctcgaaggcggtgaagcttccaaagtgaaattttagaaggtattctttttgaaaattaaaaaaaaaaagaagaagaaacaaaaaaggagaggtctcaggcacagtgcttcacttaagtaaatgtagaaaacgggccaggcgtggtagctcacccctgtaatcccagcactttgggaggccgaggcaagcggatcacctgagtgaggtcaggagtttgagaccagcctggccaacatggtgaaacccggtctctactaaaaatacaaaaattagccaggtgtggtggtgcgtgcctgtaatcccagctactcaggaggctgaggcaggagaatcgcttgaggcagaagttgcaatgagctgagatcatgccactgcactccagcctgggtgacaaagtgagatccgtctcaaaaaaaaaaattaattaattattttaaaaataaataaataaataaataaatgcagaaaatggtttcaggaagacacagggtacttaatacagctgcaagtccaggctggcacgtgggagctggtggagggagggtacattcagttgtcctgtgtcccctcgcaccccgagagggactcgctcctggggaagactccaggggtcttaccagtaggccagggaagggtgctccttcagggcttgggtgggaagggctggcagcttcttcaagtcactcctcacaacttcattgctgaaagagagaatgcccagaaacgcactcaccctctgagaaaataatcgcactctctgataccacttgggccgctgtcttgtctgagagaccccacatctgcttccctgttaataaaaagcagtggggggaaggggcgctctctttttatttccgaaatacagatgtaaacgaaggcagaacacaccaagcccagtaaccgcctttcaccgtgcagaaagcagggcaaaacaccttcagatggccaggggtgtcttcccaaaccctgctctcactgaagggcacagagtgaacgcccctgagcagccctcagcaggaatttggggagaagaagtgtccccaggggtcccccagggcaggatcttagaagaagctccccagaaccccgccgttaggctcacagagctccgagaatgggcaatggcgccactgtctccctaagagcatttgcgctgctaatacacaaagctggttttcatggcttacgttgaccacatgctggaaactgttttctgaaatatgacaaataaatactgatggagtctcctttatcggaaatgcttgggagcaaaagtgtttcagattccagatttttttcagatgtttgactgtttgcatttatatacttactggttgagccccacaaaacctgagcatctgaaatccaaagtgctcaaatgagcatttcctttgagcgtcatgtcaacactcaaaaagtttctgagtttggagcatgttggatttcggattttcagattagggagactcaacctgtaacttttgcttttgaggaggctcagaaactacttagaaagtgtgaactgcgttgtctgggccaggctgagcatcccatatcccaaaatcccaaatcagaaatgtgccagaatctaaaactttttgagtgccaacatgacgctcaaaggaaatgcttattggagcactttggatgttggattttcagatttgaggatgctcaaccagttggtatataacacaaatattccaaagcctgaaagaaatctgaaacacttctgctcccaagcatttgggatgagggagactcaacctgtaccattaggcagttttatgcatccggtcctgaaaccagaaattcttttccctgtagactcacacatgcttaggtttggaagatgctttaaactcccctagcttaaccagccttcttcaggtgactgactcctccttacacactcagcaggtctgcatcccctctgggccggaccatctgtggcgtctgcacccacttactacctccagagcaacaaacggcagccactttgggacagttttgatactgaaagagcgtttccctatcctggtccaccaaagagccttggaagccttagccggggttgcaaaggcacatgtaggagcattctgcctttgattcgcagttctgacctgggctatgttagcagcttcgaggttgcttatattaaccaaggcaaatactggccaccaggacactgggcagtgccatctaaaaaggaatgaaacaggtataactgtttcatttttagcaatgtttttcattgctaaaaagcaatgaaacaaggtataactctgaaggaaggaaggaataccgcagccatagaggggagttcctcaggtgcttggatggtggacactccagcacctatgctgctaactggaggatgcattgttccctgtgtccccggcgagaaatacagccaagggcaatgcaatgatcagcgtcaccattggatgcccagtgccactgggcaaaaccacaccaatacactaatacattacgtctgtgtgtggtgataaagaaagacatggaggtttggtgacattagagcactcccagaaaaagcatttttctgttgccctaagaaagaatgaggccaggcgtggtggctcatgcctataatcccagcatctggggaggccgaagtgggaggatcacttcagtccaggagctcaagatcagcttgggcaacatagtgggatcctgtctctacaaaaaatacaaaaattagccatgcacagtgatgcatgcctgtagtcctagttacccaggatgaggttgcagtaagctgtaattgcaacaccacactccagcctgggtgacagagggagaccctatcaagaaagaaaagaaaagaaaagggaaagagaaagaaagagacagagaaaaagaaagagagagagagaaggagagagagaaagagagggaaaggaaaggaaggaaggaaggaaggaaggaagaaagaaagaaagaaagaaagaaagaaagaaagaaatgaagaaagaaagaaagaaagaaagaaagaaagaaagaaagaaaagagagaaggaaagacaatgaccatgaccagtggtgttggtgaatcctgaccatgaccaactagagggaaaagctcaaagtgtaactgtttgaatcaatccatccaagtacttgaactgttagaatctaaatggtaaggccaggacagatcaactgataatcaataagctgaaggtgtttatgaagcccctgccattacatggaaagaattgtagaggatataaaaaatgatgagatatggtccttaaccagaaggtgcccacgatttagctgagaaggtgagaggagctcctacaaagctcactgaccacaggggtgatgtgtgatcatgtcaatccaaacagcagacacgaaagctcagaggaaataaaggcacccttgggctctgatgtaagactggctttgggggaggccgtgcacgaagaaaaggataggaatatcactcttctcctgaggggaacacggacagacatggaagccacatgaactgaagaaatccatcagagtaagaggaatgtcaggggcaatacactgaaaagggcaggtcaggcagagaattgtgaaactttaatgccaggctaagagggttcagcctctcctgggtttgatccaggaggcagacagcaggacagcacctggtgattttcaaacgggtaaactcctagtgttcaggaaaactcaattccaatcccaagtacagtcggtaatttttaagcacatgctataaaggcatagtttcagcaagtattcaattcaccaaacactcgagggcccacactgatgaatttccggatcttctctccctgcgtcatggtaagttccctgagaaaagggatttgatttattggtccatcagcacacagagggctggcttcaatgtgaaaggcacttttctcagatcaactttattggatgaaaccatgagaaaggcaattagtggctccctgaaggagctgaaacttgagtttgggtttcactcacacccatcacatctaaagtatatttggggaaggaaggaactccaggaggaagggatcgttttacccaccaaacccttgcttgttggcaaacaagttgccctgatgacagccacaggtttgatttcctcactgaagcctgcagtgagttctctagctctgctccagggcaaggttacacacaaaaaaatctaacaagaaatcaccaaggcgtgaaacctgtccaaatccattatattctggaagggatccatggcccttcatccttccccgaggacaaatctatagaaatgttctgtttgcttttctgctgtttataaacatctgcaataacttaggggtgtctagccctgtcaatctggccaaactctgtggctgaaaatcagaaagctcccctaatgggaaacttggtcactctacccccagagcttgcaaggctgtggcctaacgaatgttctagaagttcacagcttcctccctcaatgtcttccacttcgacattttccccagagttcatgacatatgataaatgccaacttataaaacaccttaagacagttcactgtggctgcattccatttttagaaaaatgcaaaaaagagctggatgtggtggctcatgcttataatcccagcactttgggaggccaaggtgggaggactgcttgagtccaggagtttgagaccagcctgggcaacatagcaagactccatctctttaaaaataaaaatataaaaaacagccaggtgtagtggtttgcacttgtagtcccagctatctgggaggctaaagtgggaggattgcttgagcccaggagtttgacattagagtgagctatgaccatgccactgttctccagcctgggcaacagagggagaccctgtctcaaaaaccaaaagaatagaaaagaaaaagaaaaatgcaaaaagttctcttgaaaagccagttgctaaactgagaataacatccaagtcttcttatctttaatatgaatcagtttttattaaaaactctccggcagttattaacgttgccaggataaaagtggtatcaatgctgtattggtcttcgatttagtggtgtttttttctttgagatgatgtgcctgtcttctgcagcctatactcctcacgaaacaaggaaagttagaatgatctactggggaaaaacaaagatttctagcaatatatcaaatagagaatttgccacagtgaacagcagatttaaccaagatgccacaaagtgaagggagcaaaaattaaacctgagagggaaggatgaggaaaatccacaatgtgtttgcttttctttaaaaaacctggaaataactttttcaagaaagtccccctgggtcaaatgagatgtatgtaatttgtgggagaaacttgggacgaacagaataggcttagcgtgaaagaattcttgctaaaaccagtcgtttctgtctgcactggtacaaaaacagcagagcacaaaacccagaatgtgatactatcgtaacagaaaggaacagcctgcaattcagaaacagtaatataatgctagcattggcctcactcctccatattttatgagcagaatcatgaaggtcaagttctcaggggcgggatatttcataagtagagtgttgcaggtccttcatccattatcacaattccaaaattcaaaaagctagagtctaagaaacatttcttaacccatctggcggcaaacttcatctttttgcatgaggcaatgatggacctttctatttgcgcccacttgctgcgcatatccatgttttgggctggaggtgttgatgtgtttaattccaggtgctgccctaggccctgcccagggtgtcgtacaagccctgaattacctgcctaaatcctgccaagttctgaattcgtaaacattgagaccctaaagttctagatatacatacgtggctctctgttcctttgttcgatcatacagtggacctagaaaactgagacagattaatgagggaagttatagattttcattctttgctgatctttaagaaatcatgcaggaaacaatctttaatttccctttcctttcttcctcctcctttttttggtaaaccaaggtgaagctgaggttacaacaaagaaaagagagcacctgcctatctccgcccaatcacatgcttttttccccaggtgtgtaggaaagaaatgttgcaggggtcttccaccattgggttgggtcccatctgtctgagaaacttttcctgccatagtgtgtgaccattcacagacaaagggaatcacttggaggccccaggaggtttttccagcatgggattctgaattctgggcatgaatcatagataaatcacatgaatttaccaactgtttgttgggggcaacattgcaaacacattgatgaaatatgtacctttctatttttttttttttttttttttgagacagggtctcgctttgttgcccaggctagagcgcagttttgagatcatggctcactgcagcctccacctcccaggctcaagtgaaccacctgccttagcctccaagcagctgggactacaggtgcttatcactgcacctggttaattttttaaatattttgtagagatgaggtctcactatgttgcctaggctcatcttgaactcctgggctcaagcaatcctcctgccttggcctcccaaagtgctgggattataggcgtgagccacagtgtctggcagtgcctttatttctgttgctaattgttaagttatataagtaaggatttcttccttgattaccgagtctcgttttctggggtgaaatgaagttttatgaatttctaatttatgttaggtataaacatgtaaaatttaagacaaatttaaaaattgtttcataagtctacaatttcaggcaaataattttctcaaaaagcccaagaagaaacgattaactttctatatttctcagtatcaccctttagtttcagaatttccactctgaaaaactgacacagtaccatagccatgaaacgttttgctgttcacaggtataactgaaaatatgatattttaatatgttaaataaatgcctaacaaaagaagtaagctgtcataatacaaaatttcctccttacttggcttctaagcaattcgcatagaatttgaagaatatcatcctgcaaaaaaaaaactaccctatccctatccaaatacttttttatgctttgaaaatgtgaattacacacttgaaagctccatcaaatagactttagtgcacaaaacaaagctttctgtaacaatttataacttttccacttgaacattttgcttcaaattttcacagattctgttcctttcaaaagctcttgctggtgtgaaagattccatctgctcttcaattactcatggcccttaaagtcatttttaaatcatgggaaaacgccacacacaattctttcgtgtgtgtgtgtgtgtgtgtgtgtgtgtgtgtgtaaaacagtatataaatagtatatgagaattatattaatttcaattcttcccacaaaaactcttctttgggctgttaggtgtgtttcaagtttaacagatcaacttttttttttctaggatgtttccaacagggaaatttgaaagtttaggtagatattaaagttactgttaagttacataagttatgttcccaatgttaactatttcagacataactgagtattttttcaggaattatctaaaagcctcagcaagtctatttctcgtaccatatgatcatgccagctgtttattttcaagtggtcaatttaaaaatcgtagggaaatatgccccaaatgatctaataacgatttgaaaccgagctagctagagctagagctaaagctgtggtagtaaaaccacttctgtaagtgcagggaaatgatattggtatactaggaattgtgatttacagactgctgctttagattaatcaagtctccatgttgtagctggcaagaaaatgactttgtcatctttttaaagatcgcaatcgatataaacgtttatattactcaaaaaaagtcttttagaagaaaattagttcttcgtgttcttttcctgttgatcatctaaagctcttcctctagcctgtgacttcccaaaaggcaccctctggcctggcaaaaaagacttacaaacctggaattttcggataccagtaagttgagttcagtttatattaattcacacatggctctttataaaggcagaacagatttcaaagaaagaaagagaaaaccaagaaggcactctttttgggccataaaaatttctttccacactagtgagcacaccatcccatggtttatagaagataaaatactaaaaggtctttacatttttgcctctaaccgctcccctgggcacctaataacatgtggtttgtggaagttaatgggaatttttcagcacaaataaatactccaactcctcttctaaaatggaggtgaaaatcaattttccttgttaatgagggactgctactatttgtttccattgattgggtgatgcattgttctgtttctaaaagcaagctgtttttcattttttgttttaaagaaacagaattagtaacttgcagactgacaccacaggtatacactaagatttcttagccgacactcactaagctctgataagctgatattctctcacttggactggcatttcatcttgtagagatgtcatgtaaactggcccccaagtattcaatcaaaacctgagttcttttcctttggtggctatgtttatttggaatggtgagcctgtagacacagggtcccttccatcgcctcttaagcatgtgatgggttctgctgaacagagccaggtaggcaaaacgtggaccaagaatctttacacggaatttccttactatctgtcttttccaggtgctgtttgctttctggtcttaataaatctcatgctgggagaatcctgttttagtgattagcatcagtatatccagtcctcggaaacaaaaatatttccaggtcccagaagagggtccagagtaacacagctttactgatctggtttcaataaatcttgttaacaaaaaattctatagaacagatgttttttacttgtctctgttaatgtatggacgattctttatttcaaaggtagtgtgattttggcatttgtgatttgcattgtttagcgcaaagcattttaaaagtacttcaatattgcaaaatgctaaacgttattttttattttattttttgagacagggtctcgctctattactcaggctggagtgcagtggtgcaatctcggctcactgcagcggcagcctctgcctcctgggatcaagcaatcctcccacctcagcctcccaagtagctgggactacaggcacacgccaccatgcccgactaattgtttttgtatttttagtggagacggggttttgtcacgttgccctggctggtctcgaactcctggcctcaagcaatccatccgcctcggcctcccaaagtgctgggattaaagacgtgagccaccatgctttgcttaaagttattattttaagaaaatttgcggcacatttttagaaagatcagaagggctggcagaggtgaagtgattctcaaaatcagggtaaggagattggctgataaggttttcagttaaggtcccttatagacaaaaaccaaaaaatcaagtttttgtatgtgatatctccctcagtacagtgttgcaatgagacttctgttaaattaaattagaatataactagaaaattggacgtcctatcagtcgattaaatgaggtattctctgcactgaactttttaaggaagagaacattagtttttctatcataacccaagagtttttaaaaaagctttgaaacagaaaacatcagtgctccattctcaaaaccctgcactgtttacgatgaataaagtatgtaagaatcatagataatgtctgttagttagttggccaatggtcaacagcgattatcgaaagacaattttttgtttttaaactgcatcggttcttgtcttccaaatatttggcccacagctgcctttgttaacagcttggaggctactgaattgtttttaaagagaaatgccaactctactgacttcctgattgtcgacagacatgaggttttttgttttacatgtatatacatcaggaaatgaaatgagattactacatgctgtgctaaggaaaacaataaaagtgaaaaaatgttatttttagataagactatttcctaaacctttagaagtatcgtacaaatttgtcctccatttggtagaatatgaacatgtgtggtctgtatctcttctatggcaggcgatactaatcatctatctagataacagtcattttctctcagcacgctaaacctgacatttcagtgtaaagtccaataagacaaggaagtgagctattttgttagtgggaaagaaaagacagttatgtaagaataagccttcaggcatctgctgagcaaaacagagagcccaaaagaagaaacggaagagcaagtgagtttcatgagaaagagtagctacggttcacagttgtctttatatagttctctttccattaaggtgtatcagcacttttgacttcgtcttttttttatttgagagggagttttgctcttgtcacccaggctggagtgtaatggcacgatctcagctcactgcaacctccgcctaccaggttcaagcaattctcctgcctcagcctcccgagtatctgggattacaggcgcacaccaccacacctggctaatttttgtatttttagtagagacagggtttcaccatgttggccaggctggtcttgaactctcgaccttaggtgattcacctgccttggcctcccaaagtgctgggattacaggcatgagccaccacacccagcccttgacttctcttttgtaaaagcaatccccttttctcttgtacctcaaggaaactgctcccataatttatgaattaatactcattccacataaatgtaatttggatatagtccctgaaatgtaaatatctaggataatagtatcctgaagaaaatagccttttgggaagttttagattcaggacctttcaggctatgaaagagttactttatcttttgtgtgtggccattcatttaaaaggttattggatcctctggattttagaagatctttgagttcagccctagaccctgtgttatatctagaaaagccttttctagggttctgtgtgttctaagctggtattttattaatgtggttcaggaaaacatatctacagtatggaagtcaaagccattcctttaaataaaactgaggttatatagtcatgcatttaataatagtgatagatgcaggaggcatgcagatgcagataaggaaacctgcacagggtcttgcccgggcgtgcctgcaagggactggggcccacatgtgcactaggagaagggggtggagccaccaagaattcatgccttatgcaggggaggagactgatattcaatctgtgaggtgggagcctgttggcaggaccctctctttttttgctgagagccttcttttcgcttaataatccactctcctctcccttcagtgtgtccatgtgcctattttttcctggtcgtgagacaagaagctggattttagttgaactaaggagcaaaaaatcctgcatcaatagcaaaaacaactttctataataaatcataaataaatttatttatataaattacataagttatgagaatgggacatctaaaatacctaatgtttagccactgaaccgaatgtggtcaatttcgacgtgttgggtatcttcccagaagcagatgggaaggaatttggaattacttctattactccacaattttaggccactcaagtgtactagtttctctggacctctgaagatggctttactagcatgggcctgctacagaaaaagggtgtttatcagagactcccatgtaacaaatcacccccaccgtccatggtgtaggttttaggctgtgagataaactgaccttttggataaggtgtctgacctctcccctctcctgacagtgatttctcttcccagacagctgcgcttacaaacaaactgctaggtagcagtagcactttgacaaatggagcacaacccggatcctttgtttctttgaattcagccaacaagctggcattccagaagctcattagggggccatgaattactgtggaggccaagcctgcacttccttctccctggcaatccatgtggccacacgttcccatgatccgtggggccagatcatgctattcccagttcacattccatcccgtcagggtactctcaaaataaataatatttacagcagagttcagagctggcgaaagaaatgtggagggaaaaatgtgagtaagtagactagacactggaatccattggatttgtggtttttaaatcattttttcatgggacttcagaaatctttgtaagtagatatggactggcacttatcaaaaccccaaattccaaggccaaattaatgtcataaaaaagtgacaaataaaaattgtaacaagatttagtttctgtaacctgaaaacattatgtttagcaaattcggtaaatggttactggccacctacaaagttcaaggtctccagccaaagctacttacagtcattatctatttaaaaatttgactaccactgctttataccaaaaacttggagaacttaaataaaaggggcctggaggtctctttatgcaaatattcaaacagagctgaagagatggcatttgagatcagagtcagcaactacaaccccctagacaaatccagtcctctgcttgtttatgtattacccatgaactaaggatggcttttacacttttaactgattggaaaaagaaaccaaaagaagaagaatattttgtgatacatgaacatttatatgaaattcatatttctgtatccataaataaagttttattggaacacaatcaggctcatccatttacttatcctatggggctgcttttgcacttaggaagagttgtgtaattgaaacagagatcgtactgcgtgcaaaactcaagatactgacaatctggccctcaacaaaaaaagctcgccgatccttgttttagactgtaaaataattttttgcttttgctgagatgtctgactgagaacagtcaacatagtgagagctcatctctacaaaaaataaaataaaataattagcccggtgcagtgactcatgcctgtagtcccagcaacttgggaggctgaggcaggaggatcacttgagcccaggagctggaggttacagtgagacatgactgcaccactgcactccagcctgggtaacagaaggagaccttgtctctgaaaaaaattaaaaaataataataataaaaaagcaagcatgagaagtgtacatggagagcaaggagaaagcagttgagacctgaaaaaccagtgacaaagacagccaactacaggtggccaccaacagaagtagtttttgctgcatttacagataaaatccctcaaagcatggggaaacagacaggttcttagatggagcagaggtacgatctgtgtttctttttaataccaatttgctaatttcctgttaatgggccagaaccttacgccttgatgctttcctttcctgttcatgtggttcactctttttgcctctaaaccttgattctccagaatgggctaccctggccttttttttttttttcagaggagcttgatcaaacagaatcccaggaataacgactatctttgagcagatagtcctgctagtggttggctacaccctctgctctgtgcagggtctggtgatgatcacaagagatttcagggcgatttcagggcaatttcagccatactgatcaacatatggtgatgaatgaaataaatgacaagtttgcagttttacagggttattaacaacattcacagattcccagtagttgtctgtttatgttttctccaacacaatatcctaagacagaaggaaagcagaggtggggtatttttatgttgtaacattttcacgaatgaaatttccctgtaagaaagtattttgtcccttgaggggcagggactacattgagagaaaaaaagatgtccacctacttgtcaggactgacaggttatctgcaatcatatttacaccacagtggtgattccagcctctacgagacatttgagcagcctgtccaacctcaggacaatgggcatgtgtgacgctgggcctaatgtcagctttccagtaatctccgggctttgcatgtagtggagaatatctcccttgctattactatattttctccacctgatctatctgtttcagtggacaagttgagagttagatctcatcattaacatataacatgaataaattgtccacctaaaaaggacatcctgattagtttcttttaatagagaagcaagggcttacattttaaacaacacaacaacaaaattgtaaacttacctagaaaaatctccctttgcctcctgtagaagaaaaaattcaacatcagcgaaatacactaagccaatgttagagactctaaagtacattctataatcatgagagtttctctactgaatgagatgagttcagcttcctgcagttatcatcctatttgctgcaggaatacaattaaaactgaatgcacacctttgccatttgaatatgaaatatgaaactaaactctagaaacttatatacaaagtaagtgattcataatgacaaaatgcacatctccacctctaagcctgggtctgacatgttctagattaaagattctaaatatgaacatgtatctggatagaactgtcgatttctagggtcagtttttgttttggtttgtattttatgctagttcccaattatactgaagactctggaggtagggaccagagaaactttagtgaatccagtataatgccctgaacatagtagttgctcagtaaatacttattgaaggaataaagaaatgatatcattttaactcatcttgccactattaagctaatattctataacatctttttttacgttttatttttgcataacctaaagggctttaccttgtctttctagggggcagaacatgattttttggccactaactctagctattcacttggctttctccagggtggaggtaccaaacccaaagaaaatggggtcagtaaatgatctcagtttctcccaggctcaggttaaacacacaacttcgctttacagggattttctgtcttaacattttgaaatactacaagcccctgtttattgctatggtttccgtcagtgtctctaatagctctatgcagcttgtggctaaaaaaaggtaagacgacaaatagtgagtagatacagctactggctatgcctggtaagtcttacttcctttcttctgtgtatggccgtgggacataaagaggaggagaaaaacaacttacctgtaaaatataggaagctaattcaaacaccacttcgctgtcaacgtcaataagctcctgaaaggaaaaagcaacaaacgaagacaagtttggtatttaaccaccatttttttcttttattttaaatgacagctcttcttcgggaggattacttgagccctggagtttgagaccagcctgggcaacataatgagatgctgcctctacagaaaatttaaaaattagctgggcagggtggtgcacgtctgtagacgcagctgttttggaggctgaggtgggaggttgaggttgtagcgagctgtgatagtaccaccgcactccagcctgggtaatggggtgagtgagaccctggctcaaaacaaacaaacaaacaaacaaaaagccttattttctgaggaattgctcagaatccccaatattcatagaacatcttgagtctctgagaccacaccctgaattattcagtcctaaacactcccaacatcgtttttactgctcttagctgggatggactaggggacctgggcctacccgactatctcaagggcctcacctttaaatctttagagaaattaagaggcagactaggccccagcattttacaaacctgtttgttaatgttattaatcactggaatagggatgcttgacaacaaaatgcattttctttaaaaactaaacttcagaactttctttctataaagaaaggctttcttgaaaggctgttttttgaaaggaatgttacagtgggattgtaactccttaaaattaaataaaatgtaaaaatatagttcctcggttgtactagccacatttctttcatgtgctcaatagttcagtgtcgctagtgactaccgtatcgtcagctcagatacagaacgtttctaccactgtagaaagttctattggtcagcaactgttacacagtgtaagtttaacaatgtttctgcctattagttcttcccccaaatacttaattgtgatctagggacgtggtcttcaaagcacttaaacctctccttggtttttgaaaaaattccttttctctctctctctttatatttatatttttgaaatacatatttcaaaatgtatatagttcatatcttttaacagcttttttctttctctgagacagagtcttgctgtgtcacccaagctggagtgcagtggtgcgatcttggctcactgcaacctcctcctcccaggtacaagtgattttcctgtctcagcctcccgagtagctgggactacaggcatacaccaccacaccggataatttttttgtatttagtacagacggggtaccaggttggccaggctggtctggaactcctagcctcaggtgacctgcctgccttggcctcccaaagtgttgggatgattacaggcatgagccactgcacccggccaaaacagctttattgaagtataactaaaacacctcaaaaactgcatatgtttaatgtaaacaatttgatgagtttggacagatgcatacacccatgataccattaccacaaccaaggtaataaacatatcgatcacatccaaagatttccgtgtgtgtgtgtgtgtgtgtgtgtgtgtgtgtgtgtatggtaaaaacacctagctgggcatgatggctcacacactttgggaggcagaggcggatggatcacttgagcccaggagttcaagaccagcctggtcaacgtggcgaaaccccatctctattaaaaatacaaaaattagcctggagtggtggtgtatgcctgtagtcccagctacttgggaggctgaggtgggagggtcccctgagcctgcggaggttgaggctacagtgagctgtaatcatgccactacactccagcctggtgacagagagaccctgcctcaaataaacaaacaaacaaacaaacaaacaaaacctaacaacaacaaactcactaaccatgaggacatgacctaccttcttaataaacttctaagtcttctaagtgcacaacactctctcattatacatagctcacatgttaaagacaaagagaagcctggagtccatcagcatgccagaataatacacaatttaattgatatcctatgtctggtgtcaagcttaagcacaaatatccattttatttttctttccctagtatcacaagatcccatagtggctgactggatgacagagagctagaggtaaaagagatttagagaccagccagcctgaccctgtgcttttactgagaatggaacccaaaaacatcaagggactttgcaaaaccacagggccttaatggcacttaaggggccgggaacagaccccctactacttgtccagtgtgtgacctcccttaggacttacatttccacccaaatcaatagagaatcagtttcagccaatgtattctaagaacaatatctataatccaatttgcttagcaagagtttctattcacttgcattacaagccagactctgattcaaggattgattttttttttttgtttttttttttttttttgagacggagtctcactgttgtcgtccaggctggagtgcaatggtgcgatctcggctcactgcaacttctgtctcccgggttccagcaattctcctgcctcagcctcccaagtagctgagattacaggcgcccaccaccacgcctggctaatttttttgcatttttagtagagatgggatttcaccatgttggccaggctggtctcgaacttctgacctcaggtgatccacccacctcggcctcccaaagtactggaattacaggcatgagccaccatgcccggccgattcatggattttgtaattattttttgagaggtccagaattggctcctgcaatttaaaacaatgcattcaagcacacctggatcttttgaaggagagatatctttcaggctcctttgggcctgggaatttcacagttggatactaatatttgccctggaaccaccttagaagtacgggttaaaagaactcatgagagcctacggaagaattggggacaataattccttacgtttaaccagctgaaagagctttacggcggttggaattgatagaggctgtcggtgctgggatgcggaagaatgtttggaattgcagttccgggattagcaggtcccatcagaatgtaaatcatttaacagtgtacagatggcttcacagaaacactgtccaggatttccacaatagatggtttctactctcactctgtgcgtttccattcccacctgaatgccttggggtgcacttgttagcgtgctgttgtatgtgtgcttttctgtcaaacatttacaccttatgttacagccaatggtcgactgcgggctaatatttaacatctgctgagaggcttatctgatgcgcaactcaaaaccaaccatcagaaaataacacttttaagtgtgaacatagcttttagtttgctatttgattcatccgctaaacgaagatgtctctacctgcgcggaggcgggtaacacgaaggaaggtcttttattctattttacacagcccattatgtggtcccaggagagtatcattggtgaacattaactgtaacataactgatatccacaggaaagctaccaaaaatatccacaggaaagcaccatcaaatatctaacctgattgattcaacttctctctcaccatagttgttctcgggttaagtgagaactggcacctttaactgtggtgacttttcgggtgaaaagcctgaccttgactatctatctcccagtgaagatatcaaaaacaggaggaggtgaaatgtggccagtgggagggaaaatgattaaagattcaagcgccccaggcattgcacatgcttacaaaatctgatggaaagagctgcattattatttctgacctcgcctatttaacatgcattgaatttaaggatcatttcattggatgttctcataggactcaacacaaagaccaaaacggtgtggataagaaccaatctagggtggtgggaagacatcctgagagtctttgcccaattccccaatgtcacttgttcatgatactgtttcccccttatacacctcatccttccaggtggctttatccttaagattctaccacgatggagcagagctctagacttccggcttactctgaaaatttcccatggtacttcaaaacctgaaagctggccgggcacagtggtttaagcttgtaatcccagcactttgggagaccgaggagggcagatcatgaggtcaagagattgataccatcctggacaacatggtgaaaccccgtctctactaaaaacacaaaaattagttgggcgtggtggtgcacgcctgtagtcccagctactcaggaggctgaggcaggagaatcgcttgaaccctggagatggaggttgcagtgagccgagatagcgccactgcactccagcctggtgacagagtgagactccatctcaaaagacaaaacgaaacgaaacaaaacacccctgaaagccaagttccacacaggggagttattagatgttttcaggggtcttcctagcagaaatgtgctcccatatgacattaagaaaatgactctcccttttccttatctgacttctccagtggtccagaggtggcttttcatttattttttttgagacaggatctcactgtgtcacccaggctggaatgcagtggtgcaacctgggctcacagcaacctccgccttctgggttccagcaattcttgtgccacaacctcccaaatagctaggattacaggtgtgcgtcaccatgcctggccaatttttttatttttagtggaagcagggtttcaccatgttggccaggctggtctcaaactactgacctcaagtgatccacccacctcggcttcccaaagtgctgggattacaggcatgagcctccgtgcccggccagaggtggcatctttcatgggtttctgctcaagcagaggaactacactgaaggagaccacacagagtgtgcaaaaatcccatttttttcctgggattctgggctttccccataactgtaactaaggacaaaatgggatcataggaggaggagcagaagacacttcccggaggcttgagggtggcttccatctgccttatgcaggggctgaggtgtaacattcctctgcgcttatgcaatccacagctctgcggtgaagccccccgtgctcttgcggccattggagggaggggtttctgcagtgtctgagctggaatctagcctgggaatcttgggctgtctggtgggcatggaataattactttgagactctagagaagcccagggcgatgctggcaggaggaagtgtaaggtcctttggtgactgtggccactgggtgtgtactttaggcatctgctttccttactactgaataatgcatgctgcttcctttgatctttgagaaatggtatggaaagacgaaccgtgaccgtctgcaggtatgtgtgtgtgtgtgtgtgtgtgcgaacgtgctctgagtaggggtgggaagggctgccccacttcctcccacgccgtgttgttttatcccaggtgactgaactgccgaaggaagaggcctgaggtcatttatcagcaacaccatgcctaacaatattctcagaaagatttccatctgagggtctccaagtgtttctaacaagtgggcccgtgggaaccccaaatggcaggtgttacggatgttctccaagagtcctgagagccggagggcctctttgctcagagggacttggtggtggtctttacatttaaccaagaatcttaatgacaagcagcccaccatggtccggaactgcaggaattccaactctcatgtaagacaaatgagataattccgtgagaaaatgtaattgacaaccatatagtaggtcgagaagattttgacaaggacagtctttgcaaagtccactcggaaccacttgtagggttaggaaagccaccaagcgttttcctaacgaattctcaccagttatcaccacgtttattcttacccacaaaacatctaaagataatagtggcatgccattctccttaagattatttctactgtcccctgaaagtcccatattctggtcttaaccccccaatgccttgaggacatggactgaaccacctgaccttgagtttgattttccttatcagtaaaatggggataacaatttcctttccaattattttactgggtttggtgaggcataaatgaagtgacttggaaatataaaacacactacaagtattagatctatattatttatttctgctgatgagtatctatagataatctgaactccacagttttgcctttgttctttagtatgtcttagcatttataggaaactttactagattttttttttttttttttttttgagacgggagtcttgccttgtcgcccaggctggagtgtagtggcgcgatttcggctcactgcaagctctgcctcctgggttcaggccattctcctgcctcagcctcccaagtagctgggacgacaggcacccaccaccacgcctggctaattttttgcattttttagtagagatggaagattttgttttaaaagagatgggttgtgtgtgtgtgtgtgtgtgtgtgtgtgtgcgtatgtgtgtgtactggtcaccgtgtctgtggtgtattttatgtgtcaacttgacaggccaagggttacccagattatttatttttgagacagggtcttgctctgtcacccaggctggagtgcagtgacaccatctcggctgactgcaacctctgcctcctgggttcgagcgattcttgtgcctcagtttcctgagtagctgggattacaggtgcccatcaccacaaccagctagctttttgtatttttaatagagacgaggtttcaccatgttgccccgggtggtctagaactcctgggctcaagtgatccacccacctcggcctcccaaagtgctgggattacaggcatgagccactgtgtccggccccgagttgcccagattaaacagtttctggatgtgtctacgagggtgtttctggatgagatcagcatttgaatcagtggactcaatagaccaccctccccagtgtgggtggacatcacacaatcctggaaggcttgaatagaacaaaagatggagggtggaggagcttgccccttttttcatttttctttctttctttttgtcccttgctttttgagctgggacatcacatttcatcttctcttgtccttggactgggacttataccactggctccctggttctcaggtctttggactcagccagtggactgacaccactggctttcctgggtctccagcttgcagacagcagactgtgggatctctcagcccccatgatcttgtgagccaactcctcataagaagtctctttctgtatatctatatatatcctatcggttctgtccctctgactaatacaccgtatatcattaaagtgggacacaatgcccatatttagcccaacttgctctcttcttgtggctctatgcctcattgcacaactcatcataattacgcaaatttgcccccggggcaaacaggggctgtggtgcaggatgagactgatgcgatctcgcacaattcctcattcttagtcctctgccagtttttcagcatcaagtcacttcatgtttgtctaatgatccacgaggtgaatgccactcatgctcagccgcaaccctaactctgccgcgttgggatttctcatgctgtccaccccaccgcagacagcccatgtcaggatctcaaggaatcgttcttttattaacttatattttaaataatttttacttttatttatttatttttgttgagacagggtcttgctctgttgcccaggatggagtgcagtggcaccatcatagttcactgcagccttgaactcctgagctcaagtgatcctcctgcctcagcctcctgggtagctgggaccacaggcacacaccaccgtgcttagctaattttagtttttttgtagagatgggggtctcactatgtttctcaggttggtcttgaactcctgggctcaagtaatcctcctgccttggcctcccaaagtgttgggattacagctgtgagctactgattcctggcctggaatcattcttttagagatcatgggcacagccaagacgacagatccatgtaagcttgtttcttgaaagttgaaaaagaaggtacctgtctgtccttctctcataccccctctgtcctacaagggcatgctctaaacctgcagatatttatgttgtcctctagaatgtgattctgggctttggcttggttctcccacctacagatgagatgacgtcatctgatcattagcaaagcatgttgaaggtattgaataaagaccatttatttcaatatcaacaagagtgatagcatttagacctaaactgcaaatgtggcccaaggatgattacttaaactccatttttttttaagagatgagttctctgtcatccaggctggaatgccccagtgtcatcctagctcacttcagcctcgaacttgtgggctcaagtgatcctcccatctcagcttcccaagtagttgggactacaaatgtgtgccaccatgcctggctaattaaatatatttttttgtagggttggggtcttgctatgttgcccaggctgatctcaaactcctggcctcaagccaactgccttggcctcccaaagtgctgggattataggtatgagccaccacgcctggccagcagaggctcccagaccaatttggacaagatctgcaccctcccaagaacacccataaagcagaaattttaagccttttcctttatgtcatgatttgttctcagtgcagtgtaggcaacaaaactcggtgatttctcaggaaatatgcaaatccttgctcccttggaaagtaaccaattaaaaaataattttctgagcatcggctatgtgcctagtacagtgataggccatggaagatgagcttaaaaatccactcagaaaaatgctggtaccaacttctcctccagcctaaagaagcatatttcagcccatctccagatggcaagcacagtcctgtttctttggttatcactgctggggaaggttagtgcttttagacgaagcataattgaaatgtgatgaatgtccctaaagagtgcattgccagctgggtgcggtggctcacgcctgtaatctcagcactttaggaggccaaggaaggaggatcactggagccctggagttcaagaccagcctgggcaacatggtgaaaccctgtttcactttgaaacaaaaccaaacaaaacaaaacaaaacacacaaaaaaaacaaattagctgggtgtggtgtcgcatgcccatagtagtcccagctacttgggaggctgaggcaagagaattgcatgaacccaggaggcagaggttgcagtgagctgagatcacgtcaccgcactccagcctgggtgactgagcaagactccgcctcaaaaaaatatatatattatataatatataataaagatatataatatataatatattatattatatataattattatataataataaatatttatttattattattatataataaataaataaagagttcatagctaatccctttgggcaagggcaaacttatacaggtgaaatattagattcctgatgtaatcttagagaccagaatagatgcccctttatcaactacaccagactctaaggttaagttacctacaggtcgagggttcagggccagctggcctagcaaatttctcaatttctgtggctaaactctctaccaataggagctgtcaatgctggtttacaacccagaccattacaactctgactggacagagggccagccttacaaacattctcttctgaggagctactgtagactttaggccagtttcagcagttcgcagaggctgcacacaaaccatctttgtgtcctatagttcacctggtgaggtaaagcgcctcaaattccacctcattttaatgctaaaagccatcccaggaaggaatgggaggtcatgatgtaaagtgaaataggccaggcacagaaagacaaagttcatattttctcacttatttgtgggagctaaaaatgaaaaccattgaactcatggagacagaatagaaggatggttaccagaggttggaaagggtagtgagggtgggagaggtggggatcgttaatgggtacacaaaaatagaaagaatgaataagacctagtatttgatagcacaacagggtaactgtggtcaataatgattgaattgtacattttaatgtaagtaaaagagtagaagtggattgtttgtaacacaaaggataaatgcttgagggggtggataccccatttgccctgatgtggttattacacattacatgcctgtatcaaaatatcttatgtaccccataaatatagacacctactatgtacccacaacaattaaaaatttaaaaaaccaaagtaaacatggtaagtatgtcaccaatatgtctacctatggcacacacactcgacactccttcgtaactatgcataacttttccccaaacctgctgaatgtgtatgactctattatgtaataagaacaccgtgagtcataaaacccgacctgcccttctccttttcaaaaagagcaccttcagtccacgctggagactttctcttctcagcttgcaaaccggtactgccaatacagccctttctcctagttagccacctcggtggccttttggatgatactgatggtgcatctaggcattctgacagccactcacgccacctaacctcaatcaaggaactatcaaagtacttctctgacgaactgaatggaaaggtctttcgacatgagcaccaattttcttttctctctgaaggtttgcatgtaaagaagattgggagctggtgatttcttgatttctcttatagctgtaagatgtataatttgtggaaatctttctgataaaaaaactaaacagactctgtcattttacgacctatgtttgcaaagctttcagacatcactgtgatgactaatttttgatggtggatcatcttcttctgtcagtgcagaacccagaataggcaggattcaatcctgcagccagaaagtgcgggaagagctgagggtccacattccctgactcgctcctgtctcatgggacaagtccgctgcctcctgcaggggctgatggatgggcaccttcagttggctgttggaagccacaccggaagagggagaggagcagatggaaaaggcttggcgggaaagctgtgccgtcttattggtctctttccagggaacacgcaacgttccaggcaggcttcctgtgagagtttcccatgggacgggactcacatttctaaatgagatgtatccacgccctggccaatgtcctctctatcacccacctgtctccttagtgagttcaagcacatcagaaacactgttggaccatgtaggaatcctattccacacttcctcctgctccaccggaagcacacaatgacagccccgctgtctcatatccatattttaattttctgcaacttggatagattatgactacattttcctgctctattgtataaagtaggggggtggaagggaagagaaagtgagaggggcgtctgctgtggccatgcctcctgcctgctgggaaagagagaggaaggtaggaaggcagtgttcacagtttgggaaaaatagcaaaacaaagccaaacacctttcctcgcctttctgctattaaagagatgagaggttcgttctctgaagaagaacaggaagcagggatgaagtggaccggaagtgcaggaattacatggaattctatacccagtgtggagactgttccctcccgatccctggatgtgggaggacatgtcccaggcaggaagggaagggttttttctggagagaatggagagccagagaggaaagatgtccagataccaagacactgatattcggggttccccagggaaagaaccagcttgcgacgggatcacgtcacagggacacccactgggggaccatcccaccctgaaatggagcatctgcttagtttctaagtgtgaagcaacagaccagggccagcagacaactgaggaagcctcgtacaggaaagagagaccaacacaaataaactggaaaaaaagagctggaaggaaacatagaataataatgataactaatattatcagagtgataagagaggatattatgttcctgaaacaataatagcataatattaaaaaatcagataatataaagaaactcttagaaatttaagaaaaaaaaaaacaacaaaaaacaaaaccataatggcaaaggttagaaagtccagagaagagattaaagtaaatactgacaaagcctcccagaaagtagaataaaaagacagagatagacagctggagagacaagtataggagtgggaggccatgcccagcatttgataaataggaattctggaaagagaggacacaggcaagaggggagaagatgtcaaagaaacaatccaaaaagaacctcacaactaaaaaagaatgcatgtcacgtctccagactaaaagtgcccatcgaacacagagtacaatggatttacaaagacccacatcagggcacccatcctgaaattttagatcagaaggagcaaaaaggagttcccaaaggatcccattgttggggagcccaagggggtgtcacatacaatggataggatggtgggcttttccagagcaacgcctttggtattctgagagaaattttttttttgtatatttctatatccagtcaaactattcattagatacaaagctagaataaagactttttcagatatgccagtatccaaacattttacttcccatatgcgctttctctggattgattgcaggatgttctccagcgaaacaatggtgtaaaacaaaaaacaggaagactccggatccgggaaagagaggacccaatacagaacgagggagaaggaaagaccctgatggggatgcggcatcccgggttgagactctgcatgagaccaagtccaggctggagcaggaggttggaggagtctaagagggaggtcctggaaaaacaacagcagtagcagctgccacagcaaccaaaatcaaaccaaagaggaacgagaactacccgacgtagctggaaattaatattggtagacatctgagaatctgtaggaacttttgggagaaaagtgaagggtatgtagtaactaaataagtgaaagcaaggcaagtattccctttgggtaaaacaatgggttgtctaaaaaacgagctgcaaccacaggatactacttggattagtcacgataatgtcatgcttatgactacggctttaagccagaattatgctatcaccatactaagaaaatggaaaaggaaataaaatgtgggtggttataatctaaatctacatccttattttttttttctttgtgacaaagtctcgctctgtccaccgggctggagtgcagtagtgtgatctggactcttggactcactgcaacctccgcctttggggctcaggcaatcctcccacctcagcctccagagaagctgggactgcaggcatgtgccaccacacccgactaatttttgtgttttttgtagagatgggatctcactaggttgcccaggctggtctcaagctcctaagatcaagtgatcctcccacctcagcctcccaaagtgctggtattataggtgtgaaccactgtgcctggccgtcttcatccatttttaacaggaattcaacaacctaaaagtgaatcaatcaaggaataatgccctgtgtcaattatttatctatatggaggcaaatactagaagaaacagctaaaactgttgcaagtggcaggagttgcagggaggaagctgtttgtcataatcagccttgtggaaccatttgacttttaaatgatgtcatctattactttgatagaaacaaatattaatactttaaaaagtgaatgaaattgaactttgaaaaagcagaaataagcggcttattttaccttgacaacttagattttaacatacagtaggaaccgttccccaagagacagggagggagcagatactaaacctacgctgggtaaacccaggcatccgggtatcagcatcgggatgggttatctgggtctaacactaccctctgggctcttcaaggtccccaaagcaccagggggctgtgtgggtggcacaaagagaatcacagccaagagaaaaaaactcgggtctaaatccaacgagctaatcacatgcctggcatgggactaagaactttgcatgctttatctcactgaatcttcccaagaaggttgtggttagagccttataacatccttgctcaattagagaggaaagggaagcttggagacgttacaggaggtgcccacatttatcccttttaccaaggggcatgcctgggaaaagaacctgggtctgcccggcagcaaaagctgaactgtcaaccactcagcagtgcctttcatgatctttacactgacacaggttacacaggctatccagccatcccccagtcctttgtctctgagtcacttagcctctctgtacctacttcctcctctggaaagccagcgattctcgctccatctcacgcagagatgctgaggctcaaatatcatagtatatataaaaaatttaaatggcaatttgtacaaatgaaaatattattcttgatcacaggagggagacagggggccttgggatgcgacttggtctcctatatcaacttgaaagatgctgtcccttggtcatttgtggtcatttatgtgcccaagcccaaggaaagattttgagaagagagggctgggttctggagtgacattcagcatgtgggctgatgctgtcgggaccttgaacctaaatgtggctggctgcaaaggtgtcatcacctccactcagggcatctgtagtatttagttctgacatttattctttttaattttccctgaatcgcaaagtcctaggcgtgcatgatgttcagaggccttcagtgccagctcagcatttgggacaagacagtactgaacgcaactcctctccctttccccaagcgtctgcccaagtaggctttgggtcaatttttttttttttttttttttttttgagacggagtctcgctctggcacccaggctggagtgcaatggtgcgatctcggcttactgcaacctcagcctcccgggttcgctcaagcaattctcctgagtgagcctcccgagtagctgggattacaggcgcctgccaccacgcccggctaacttttgtatttttagtagagatggcatctcaccatgttggtcaggctggtctcgaactcctgacctcttgatccacccgcctctgcctcccaaagtgctgggattacaggcgtgggccggggacaattttttacttgccctgctggagagtgatttcgcggattcagccttgccatgcatttacttcgctgcccaaggctgccacctggtggagactgctcacctttcatttctgaacttggtttcaaagcgctttcacatttatttaaaaaaaaaacctgatactcttacaatctgtatgtaagttcagtattattatttccactttataatgagaaagtggggtcttagaggaaagaatctaaaagtacctggaactgcattatggtatcttttccctccattcggcaaaaccccaaaatgctgtcctcttagtgtgctgggtttgagcccagtttaagtcctggctcagcaactgtcccaaaatgaggtcttttcacagaactgaatttgatcattaccaggccctccgttattctgaacatttgtaattggtggaactattctgtgcagtgaatgtgttgaggtagttacagaaggaaagtgatggctgatactaccattccaacgtgtgtgtgtgtgtgtgtgtgtgtttgtgtgtgtgttaaggtttaatgggtttttgcaatccctagggcctgagtttaattacattttaaaatccaggcagcggtatctccctagactcctttgaatccatccatcgaacacctcacagacaagcgcacgaggagagcctccctccagggtgcaccatagcctggccattcattaggcatgtgatctcatcttcattcactgggaaaacagggataaaaggctgcatctatctcttgggttgatgggtgcagcaaaccatcatggcacatgtatacctatgtaacaaacctgcacattctgcatgtgtatcccagaacttaaagtataataataataaaacactttttagaaaattcaggacactctgggctttacatttatttatttatttatttaaaaaaagaattggctgggtgtggtggctcatgcctgtaatctcagccctttgggaggccaaggtgggtggatcatgaggtcaggcgttcgagaccggcctgactaacacggtgaaaccccatctctactaaaaatacaaaaattagccaggtgtgatggctggtgcctataattccacctgctcaggaggccgaggcagagaatcgcttgaacccaggaggcagaggttgcagtgagccgagattatgccattacactacagcctgggctacagagtgagactccatctccaagaaaaaaaaaaaaaagacttatttaatcttccatcaatgttctgacaaccaagagaaaattccttactgagatcacaggaatggctaaacccatcaaatcttcacttgaaagttctctggtttgtccatctggaatttgccctgactgaatgcactacccttaaattccttagtagaacttttattctaactaatcctcacacttcaggacttcagacgagtccctgacattttacccaggtaagaggtagaacttaagctgtgaattcagaaaaacatctgttaatttgctttctgtggccctacattagtcagctggtgtatacctcaaactcttccgcttcttgttaattacatttttagagtaaggggaaatcctaggtttagtattatttgatttatttcaaggtagaatgcattttggcctccaaattaattaccatcaataaacttatgcaaaattcactctcaaaaaaaaaaaagcagtgtctatctcaaaaggcgttgtgaagactcagttaaacaattcacataaagcactcagcaacaagcctacacatcatgtgaactttgtaggaatgaaccgttcttgtctattactgttaatgagcagccctaagggggtgtgacggagattgcattcatgagacattcattgcattcgttatgtgcatgccgggggtagccagtggagtgggtgtttcttttttaaaatgttcttttagggccgggcaaggtggctcacacctgtaatcccaacactttgggaggccaaggtggatggatcaacttgaggtcaggagtttgagaccagcctgggcaacatggcaaaaccccatctctattaaaaatacaaaaactagccaagcgtggtggtgcacacctgtaatcccagttactcgggaggctgaggcgggagaatcgcttgaacctgggaggcggaggctgcagtgagctgagattgtgccattgtactccagcctgggcaacagagtgagactgtgtctcaaaaaaaaaaaaaatgttcttttagtcgcagttcctaacctcagtgatattccgcaagtccatcttccccgggaggaggtgtgtgctgtaaaggggtgtaggcattttgggtcatcccacaaaaggagacactacaagcttatggagcaattggatacaggacaaggggctgtcgctctcaattaggaatcatctcttgaacaaacatttttgtaaagaagatacacaaatggccaacagcatgcggacatatgctcaacatcactagtctacagggaaacgcaaatcaaaaccacaatgagatacacctcacacccattgggatggtcatcaatttaataaagcaaaatagaaaataacaaatgttggagaggatgtggagaaactggaacccttgggcactgttggtagaaatgtaaaatggtgcagctgctatggaaaacagtagggatggctcctcaaaaaatgaaaaatagaagtaccctatgatctggcaataccacctataggtatataccctgaacaactgggaatagggtctcgaggagatatttagacatccatgttcataacagcattattcatgataggcaaaaggttttggaaataacccgtgccttttgatgtatgaatggatcaacaaaaggtgatctacacagacaataaaatgttatttagccttaaaaaggaaggcagccaagcgtggtggcccacttctgtaatcccagcactttggaaggccaaggcaggcagatcacctgagcccaggagtttgagaccagcctggccaacatggtgaaaccctgtctccataaacaaatacaaaaattagctgggtgaggtggcacacacctgtagtcccagctacttaggagggtgaagtaggaggatcacttgaacccagaaggtggaggttgcagtgagccaagattgcaccactgaactccagcctgggcgagagagaccctgtcttaaaaattaaaaaaaaaaaaaaaaaaaaaaaggaaggaaattctgatacacgctacaacatggatgaacctttttttttttttttttttttttttctgagacagagttttgctctgttgcccaggctggagtgcagtggtatgatctcggctcactgtaacctccacctcccaggttcaagagattttcctgcctcagcctcccaaatacctagaatcacagacacaaaacaccacatctggctaatttttgtatttttaatagagatggggttccgccatgttggccaggctagtctcaaactcctgacctcaggtgatccgcctgcctcggcctcccaaagtgctgggattacaggcatgagccaccacacacagccaacatggatgaaccttgaggccattatgctaggtaaagtaagccagacacaaaaggacaaatatatatgattccacttatatgaagtactagagtggttaaattcatggagacaaaaagtagtggttgccagtggctgaggaaaacggggaaggggaagttgtttaatgagtacagagtttcagtttagcagatgaaaagagctcttgggtgaatgacggtggggatggttatacaacattgtgagtgtactgaatgccgctgaactgcacacttaaaaatggcggagactacaaactgacttccgtgtatgctgctcgagtgaagggtgcaccaaattctcacaaatcacaactaaagaacttactcatgtaactaaataccacctgttccccaaaaacctatggaaatataaaaatattttccaaaatggttaagatagtaaatgtatgtgcattttacaattttttttaaaaaagaaactgtctcaaagtgacaatagcgtccctttgaaagatgctgctagaccaactaaaaatggtcaaatatacacgtatttggttataagaagctcattcctatctgcaagacctgtctaagttgactggtgcatttgtcatacttgtctaggcttttcacctttgtctcagttgacaaagaaatctttaaaatcaggagacctttaaaataaggttaggaaacatgtccacagagccagaaacacagccatggatcaaaggaatcacattattattattattattattattccttttttttttttttgagatggagtctccgcctgtcaccaggctggagtgcagtggcgtgatcttagctcactgcaacctccacctcccaggttcaagcaattctcctgcctcaccctcccaagtagctgggactacaggcatgtgccaccatgcctagctaatttttatatttttagtagagacagggtttcaccacgttggccaggataatctcaatctcttgaccacgtgatccacccgcctcggcctcccaaagtgttgggattacaggcgtgagccagcgcgccgggtcaggaatcacattattaaatggtgccgttagcttcataacattccatttatttatagtaattaatttataaatgacttctcctaatcaataaaatggcctaaggggtaacactttggaatttccagcttcaaatgatactttcaggtttcagagggaaattgagggagagggagttcctaccttgtagatgcaggacttcgcgttcagaaagaaaagctcaatggtagcattatccttcaggtatgaaatgctttctatatagaacctgaaagagaaaaatggtgcgtgaaccacagaaacagcaggtgcagaaaataaagtgctctcttgagctacatgatttgagatgaaagctggcattccccatcctaaataaacaaaggaaaaaggcaccatccatggtttttctatgattccctagggaggacaaactgtttttggagttttgatagtggcttagggtcacgcctaatgggcctcaccataaccaaagaactgggtctaccaccaatttgtaagaacaaattctaaaactaggcctctgatttctttgtcctatctgctttataattttacataatgttatttgttttcatcacattgcttgtttgtcctaaattgtcattgagttggattttcttttcttctccttttttttctttttttagacagggtctcgctctgttgtccaggctggagtgcagtggtgcatggcttactgcagccttgacctcccaggctcaagcaaccttcccgcctcagcttcctgagcagctgagactacagttgcataccaccacgcctaatttttttttttttttgtagatacggagtcttcctttgttgctcaggctgggctcaaattatctgcccacctcagcctcccgaaatgctggggtaatagatgtgagccactgtgcccagccaagttggatttttaaaagataatttcttcttaatcacagctttctttgaaatggttactactactcccgaaggtggtgaagtgtgatttgatttctgcacattcggagagctatgctaagtgctcttaacactgtgatatgaatgcatattaagccaaatgagaatcggatttcatctagatggagcttatagatattttcaagatgaaacatgctgccattatttaagtttacactaaatgtgcctttataatattgactttggagtttattaaattctttaatgagataatgcgcttgtactgtctaatgaccagccgcactgaaggactaggagttgaaaggaagagaggggaaaggttgaaatgcaacatcttggagggaagaaggttctgagcaggtgtagcaacccttagggtggactaggagggtgctgggtacctggggctcttggaaactgggttcaccaagaagaggcagaaggtgaggaaggtgaaatgagaagaaacaagtactacagttttctagaatagtgttataatctgagggccagaatcctctggagggagtcagagagcagtgatggagtccccagctctgtgtgactcagggcagtcacatcatcctgctgggcttctgttcttcagaccgtaaaagaagaagtggttctctacctaagaagtccactggtttttaaatattggaaactgactacaatgtaaacaacaacagcagcagcaaaaacaagagaccaacatcgtataaggtgaacaaactgatgcccttagcttcaagaagttctattcatttatagtaattaatttaaaaatgaattcttctaatcaatacaatcacctgaggggcaacaacttggaatgtccagcttcaaatgatacttttagattccactgggaaatggaagaggaggagagttcctacactggagatacaggacctcatgtgtctttttagaaaggaaagctcaatggtagcgttatccttcaggtatggtaaaagataaaaggatttatccataattggccaggcgcggtggctcacacctgtcatcccagcactttgggaggctgaggtggggggaatcacctgaggtcaggagttcgaaaccagcctggccaccatggtgaaacccctgtctctactaaaaatacaaaaattagccaggggtgggtgtgggtgcctgtagtcccagctacttgggaggctgaggcagaagaatcgcttgaacccaggagggggaggttgcagcgagccgagatggtgccactgcactccagcctgaacaacagagggagactctatctcaaaaaaaaaaaaaaaaaaagtatcttttaccatacctgaaggataataatgctactgttgcataaacatgaagataaaaacccacgtctgtaggctacatcaagcccatggcccaccagcttgcaacctcttgtctacacactaaataaataaataaagctttctatcatttttcaaatgtgtgcagaggctgctgtgatgaatacaattcaagtttttttgaaattggtgagtgaatttggagtaacttcagacattaaattttctcaatccacagatatcattagtacaattcttatcatctcaggttctacaaaatttggaggaattacgcagtggtcctcatacttgtaaagcctgaaaattaatggactggctgatctctgcccataacccctgcccctgccaagcacctgccccctgcttctggagcaggtgtcttatatcaccaaggtcttcatatagggcccaccatggtctcagaggcacagtaaagttaaacaacttttagttctttaagaatggagagcaaaattgcagtagcaaattttacatctcaaagcaaaataaatttgatatgatttgattttcttttttaaatttttttatttttataatttctttttattttgttattattttttattacactttaagttctagggtacacatgcacaacgtgcaggtttgttacgtatgtatacatatgccatgttggtgtgctgcacctgttaactcgtcatttacattaggtatgtctcctaatgctatccctccccctaccccccaccccacgacaggccccagtatgtgatgttccccaccctgtgtccaagtgttctcagtgttcaattgccacctatgagtaagaacatgtggtgtttggttttctgtccttgtgacagtttgctcagaatgatggtttccagcttcatccatgtccctacaaagcacatgaactcatccttttttgtggccgcatagtattccatggtgtatatgtgccacattttcttaatccagtctaccactgatggacatttgggttggttccaagtctttgctgttgtgaatagtgccacaataaacatacgtgtgcatgtgtctttatagcagcatgatttataatccttcaggtatatacccagtaatgggatggctgggtcaaatggtatttctaattctagatccttgaggaatcgccacactgtcttccacaatggttgaactagtttacagtcccaccaacagtgtaaaagtgttcctatttctccacatcctctccggcacctgttgtttcctgactttttaatgatttgattttcaaaaaataaatctatatcgtagctcatgcctgtaatcccagcactttgggaggccaagatgtgtggatcaactgaggtcaggagttcgagaccagcctggccaacatggtgaaagcctgtctctactaaaaatacaaaaaattagccaggcgtggtggcggacacccgtaatcccagctacttgggaggctgaggcaggagaatcgcttgaacctgggaggcggaggttgcagtcagctgagatcatgccattgcactccagcctgggcaacaaaagcgaaactccgtctcaaaaataaataaataaatctacatcctttgcaaagggcctctggcaaagggtaggcagaataataaaagaaactaaaggaaggaaaagaaggaaaagcgaggaaagggagagaaaggggaggcaaggaagagagaaagcaatcctaacaccagaatattaacagaagcctcctgaagttgacggtggcctttgtgctctaatgatgattttgagtctaaattcatataaggtctgaaataacttaattttcaaagtaatgccatatgtttcttaaaagaatctcatttgctttagttcttaaaaagtaaagagtaaagacatcctgcctcttccaccccaattttctcctgaatagtatattaagaaaatataacgcttcccttttcgtttccactctcatatgatggaaaactgaattgaggtggcaaattctacatctctgtgactgccttcatttccaccaagctctctgttgtctagccataaaaggggcagagaaggtacaggaaataacacgcatattctgagatgaagagaaaaaaaatcacctcctctcgacggaagtggaaagcagtttcctgttaacttttatcaccaagacgacagcctggaaaaccccgtgagctccgggcctgtcatatcattgttctgttaggggagggtatggagctcatcctgagctttccctccctgccagggaacggctgagtcaaaaacgcctgcagagaaacagagctcagacctctccacccgcacgcccagagaggcatggtgcacaccggtggcaccagggacaagagcctcctgggaagatggggagggctgagggtttggattcaaagtcaaaatttttttttcttttttttctttttgagatggggtcttgctctgtcactcaggctggagtgcagtgtgcaaccacagttcactgcagcctcgacctcctgggatcaagtgacctgtctgtctaagcctcccagatagctgggactacagatataagccaccatgctgactaattttttattttctgtcgagatggggtctcactatgttgcccaggctggtcttgaactcctgagctcaagtaattatcctaccctgacctcccaaagtactcaggttacaggccagcctcttcttcttttttttttttaatccagtttttggctgggcatagtttttggccgggcatagtttttggccgggcatgcctgtaatcccagcactttgggaggccgaggcaggcagatctgtctcaaaaaaaaagaaaaaaaaaaaaagtggcttctttttctgattttcaggagagcctcagcagtaggtggcaatgttgcatttccttaactaccagcatggagcagggagtgcttccagggttcacaaagaacattccaggtctctgggtaaccagggaaataaatgaaggctatgtctcggattcagagggtctgcatggacagttccgagtctggctgtgtattgaccatggctttatgatgcttggatgtctgtgaccttgctgggcctggagggactgctggtgccagggttagccaatttccagaccccaagacttccacatgtcaccatggatccagggtccacccctcccaccacctctcggctctcacacccagggccactatttccctgccctcaccaccctagggacacgtaccagacaactagggggcagcccccatgctgcagagcccgctgaaattatttaaactagccaatcccaagcctgctctcccagccttgcccgttcctccccaaagaaaccacaaaaaatgctcttgcccaattgtttcccggctccccaatgcctcccacatggccctgcgtggcatggtgtggccccttctcccaggaactgagtgacaatcttttcaatgtctgtcctctcctcatctgctggcctcaccacagctgaatcataatcagacctacattttaaacgggttttgggggcacacttagcaggactgaatcttagggcatctatttgagtctaaaggaacactctagatggagcgcagaccttgctaagaggtttcctgactccacaagcaacagcccacccaaactagctcagatgatcccgacccgagaatattttatcagagagtctgaaggagaacgaaataggtgctctgtgtttatgtgtttgagcttattaaatattaaacagcctctaaagcctcggggagtcccgtccccttctttgacaagtgaaagcctctggttgcaatagactgaacactgcctagtcagatggcaagggcccagccagatgacatcagccaggtctcctcctccattctccctgctctccctttcccttccccatccagccctgggcacttgggaatcactgaatatttacagcaagtgttaattaaatggaccagtgatttcattttgtaatgaacacaaatgtcacatttaaaatgcctactcttggtggcaaataagagccatgataatgaaagcaataagctgtgagtttctgcagccaagcctctgatgcttagaatctcaatgcctctaaaatcttaactgggacacctagctgaaatatagcaagttctggttagcaggaacctcattttagatccatgccatcattgttattgcgagtgacaggaagtagcagctgctgtctccatcagccagggaagataccaagaatccggcctgtggacttggctgtaaaatccttcctccccgatcggacttctcctctcttatttttttgctgcttgcttcagtttattgtctgtgaaactcaaattctgaagaggcaaatctaatctctgtttattttcttacaaggagttgagatgatcagaactacaggacacttggtagaagaaaatgtaattaaagaataatccagacatgtaggcttcattctgagcacaaagttgtgcctatgaaaagaccacacacacacacacacacacacacacacacatgacgcagacttccttgggttgtgtatattttccttatatttttttcttgacctatttctaaagcttgcctggtgaacaatatcagagagacattgttcccaagccttatagcactaaacaatggtttgcagttcaaggtgctcttggtcatatattgaccgctgctggctgcttataatgtgtgtgtgtgtgtgtgtgtgtgtgtgtgtgtgttgtgtggtgaggggagtgggaagaggtgaggctggacagttaagcagaagtcacatcatgcaagtcacgctaaagatgtccttttctgaggataatgggaagctggaaaaaaattatgagcaaggatcagatgagaattctagaaagatgctcagtgtcttcatataggggagtttggaaggggtcaaggccagacgcagagatgaacaaggagatcttgagtccaggagaggtttatggaagccctaattactattaggctgtgtatggagagtaagagatggatagggagctgtttaagatgcaggaataacagcgagtagtgactgagggaacaggaggaggcaagcgggagggagcggtgaggtcaaggttgactcccaagtctctggttttgggggctgcaggggtgatggtgcccatcacaaagacaaggaggtgacaacgaaaggggagcacatttggatgcagaaagacgacgacatcattagattccagctgcatctgtgaggaaatgccagtcagtggagatggcctggagctcgggagagaggtcaggactggggcagaggacggagagtctccagcaaagagactgcagtggcagctgtggatgggggtgaaatcacaccaggggaaggtgcagggagagaagacaagcaagacacgacctcgtggacaccagggctcaagggacagcagagcagagcagggaacctgccccgagccagggacagaggggacaaagaggaggtggcccaggagagtgtagtgccacagagccgggggaactgaaagggagcatgttcgaatgagcccagagccacagaagccacatgggagcagggcagaagcacgcctgtggagctaggggcgagagacctccagtgaccagggggtacgatggcaccagaagctggacgaccacagaatgaggaacgagaggcctgtggggagggggtgacagcaagtgcagacccatctctcggcggttgctgtgagcagagcagaaggggtagcagagggcactggctggaggaggctgtgcatcacagaggacgttttcttcagttagattgggacgtggtcacaaaggggaggaatccatggaggagaagatagagaaaaagagaggaaaggctcgagggagaagctctgtgaggtgacagaagggactgggattgaggtacacgtggatcagtgcgtgctggatgatgggctaagggtcttcctctgagacgctcatgcatttgcgtgtgtgcagtgagtggactgagaagccacaaaaacacaattaaagatacaattaagtttgtggataaagaagtaggactaggagctccctggtgctggcttttattttctctgcagaaacataagcagcaacatcttcttagagcaaaagccttgagtatctgggacctgaagcaagaggtaaaaccacagtggggaacagagaccctgagcaggcacccctggcagaactggctagagatatgatgatctgtgtggggttcatcacaataaccatgaaccaacctgaagttgcatgaacattttcctgaacacactcagaagctcgggggtagaaataaaaggtgtgtgtgtgtgtgtggcaggaccagtccaaccctgcgggtgggtgtgtgtgtgagagaaagggagagagagagaaagtgtgagcagcaaagggaggtgtggtccagggtcaggaagtagttggaagggtgcacaatggatttgcactgaattggccaaaaaataggacaggcagggctgataggatctcagaagctggaggaaatggacgcgaaattgcctgagaacagggtttatcagttttgttcgctgctctgtccttggctcctagagcagtgcttatgccaagggacatctgtgagcccataaatgaaggcatggatgatgatgcagaaacagcccaggaggagcagtgagcaggctgctgcatgctacagctgggatgatggtggatttgggcttgtaagtctcgggagtgacacagctcagggtgatgaccaggtgcaagtggaccctgaagttttctttctaggagacagaaaagcacagttcaaagaataccttccggcgggtctccacagtgtcagataatgcagaaaatggcaagaccttctcaagtgagaccaacagcagatgtctgaggtcctgaaaattcttgctttaccatttgagatggctcttcctcctccagtgtggtatttccaagatatccagtgtatcccttcagagtggcagcctgccaagacctgtgactgtgattgtccctgtgcaggggcactctgccaggggagctctgggttgggtagtgctggaaccaggctggcaggcctggcggtggctctgtcactcatggtggtgtgcacttgtcctgaacaccatctttgcaggaggatgctggttctgcaaacatggccaagcgtgggtcacaaagagggctggggtcgccgcatttgacttcgctgctcctggccctgcctatacagggaacagtggagacctctggccacaggtcttggcaggctgccacactgaagggatacacaggatctcttggaaatgccacattggaggaggatgttacttttcccctgtggagacagacagcatgcagtaggggaggacagacacaaggattggagtcagacctgaccgaacagatgagacctcatctcgccttcgtaacttattagccatgctggggaagaatttatggaccatcctgggcccccatctccttctttttaattcggaataatcagacctgcttccagggttgctgcaaagattaacaatcagccttagcaatggacaggtgctgaataatggatagttcccgcctctccagtctttatcctttttgggtaattattaagaccctgaagccacctgggatcattcctggtgatttgctggttgaaaaactggatggaccaggcccctcttaggctgaatgatgggtcaatgaaggcaggatctgagtcctcccttccactgtccccaaaacctcctgcagcctgatacttgcctcagggcctctgcagaggaaatgcttatagaggagatgctatctggcttcgtggatggagaggggttctgagttccaattcatgttatttaatatatttgggtcttatattttcctaatctgttgaatggaggtgatgattctgcctggtgttttgcatatgtattatatcagaagaatatataaatcccaaataatagcccaacctgggttactcagccatgcagtgttagtacctccattctctgactttctaaaatgtaccttcaggtagttagttatcttttccatgaccctctgtttctttttttttttttttgtgagatggggtcttgctctgttgcctaggctggagtgcagtggcacaatctctgctcactgtgatctctgcctccctggttcaagtgattctcctgcctcagcctcccaagtagctgggattacaggcatgcaccatcattcctagctaatttttgtatttttagtagagatggggtttcaccatgttggccgggctggtctcaacctcctaacttcagatgatccacccaccttgccctccgaaagtacaggcatgaaccaccatgcccagcctaccatggccctcttttatcaggtggctcgattctgctttgccaacgaaggctacctagacatgtggtatgtagatgtaatatatagacatttacaccaaaggagaaaggatttgaggaatctgggagtcaggctgcgtcaagatatgcaggtgccatggctggagtggggaggctgctcagagcccaaccgtgcttctgtttagaaacacactggaaaggtacccagctggacagaagttcttttatggactcaagcctatttcaagttctgggcttttgatgaagatgattctcttaccactcctttggagaaaactgcctgtgagcatccctaggcagatgtcaggttataaatagaggattcttcccaggatgaaaagcaaggtaaagagacggaattcacctatatagagaatctgcctcctctcttagagaaaacaaatgattggtgttttgttactgcacttcttggccagctaagaagtgggaactcagggtagtgagggtgctgggatcctctgtggctgggaccctggtgatgagccccaccccacccttggaggctgcttcaataggtcgactgactggtgagggcctgagttcaggtaataaggaggagagggcagtacagagggagattttggaagcagcagcagagaattaatgcacataaaaattctaggttgggaggccgaggcggatggatcacctgaggtcaggaattccagaccagcctgaccaacatggtgaaacacggtctctactaaaaatacaaaaattagctgggtatggtggtgggtgcctataatcccagctgctcaggaggctgaggcaggagaatctcttgaacttgggaggtggaggtcgcagtgagccgagatcatgccattacactccagcctgggtgccagagcgagaatccgtctcaaaaaaaaaaaaaaaaaaaaattaaaaaattccaggaagaagacagaagacttcaagatgtgtagcctatgtgactgagtggatgacgatgccacagacttgatgggaccatggaaggtcaagggaggagagagaagataataaatttggctttggacctgctgagtttgaagtactcaggtggggctctgcaggaaacaagtggaatgtgacacttccagaaagatctgcttccataggagctggagaaggagcacattctgccagatggcgtgtataaagacatagtggagaatggctgtccctaaatgcggatttggaaattcttctctctaaggagtgttctttgaggttcttgctttggccgaccatcaatggtgatggtggaagcgtctattatggctacggatcagaagtggatgttacatctgggtcttcagtcatcccattccccaattctctctattgctagcacctatttaacctctgcaatgctaggttacctgcttttatgcatagaagacaggcttgcagtgatttggaaagatctgtgtatcttagagactgacacttccaccaccaacgtcaaggtgccccaagctctcctgcaaggacgtccacaaataattcagacacttggaaaaaacacctactaggcagccaagcccaggattttctcctcttggctaatgttggtgaacatcaccagggaggtggggagagcctgatatatggtaaatgcactcatccacctgcgatgacaggttaatgacctgcttccatgcaactggagtcctgcctgataccacctgcccctcccagaggaattgttactatttgctttatatggttgctttgccataaatctgagaaactgtatacaccattaaagagaatatggcattgaaatcatccccatcagtaatggaaatagctaagatgagcttggatatgttcacagctgttaaacaaatcaaaaacgcattaagcgcaagttgaaatttactctgccagctgaggaaaagtcatacactcgagcctgttaagtggaccctttaactcttgtttgaagcccttctaatgccttgtgtggcttaaggatgcctatgtctggaactgcattcctgatcatgctctttaggaatgacagaattgcatatcatttgtatctcgctcctgaatttctgttagtatatttcaaagaacagagttgtatggcatgggtgtaagtgttagtgtccatgtaaagactgaggcatcagcacttaatgcttctgtaattgtgttgcaatcaaggttctggacagaaagaacctggtgcctccatagactgggtgtttcggagctgctggactgggggctcagattctgactttgccaccaattcagactttgcccctgaacccctgacctgcccagcctctggcttctcacaaccttttgcaaacggaagtggtaagtcctgttgtcttcataagacagctgcaaatattaactatttaaatcactatagcccacaaatcgttccctttgcaagcacaaaacaaaatttcttagactagatttctgaacagaaaaatgcctattgtttctgaaatgttattaagctgtatcctcccttggcaggaaatgcagatgggcctgtggtttgctgctgggtttcgaccactcctatttgggataaactacccaggtttcacgagattcaagtggcatcccctctaaaaggaaagaatacaaaggcttttgttatgtagtttcaaattgcccccagaaaagaatcccacggcctgtgctataagatactcattgtttgagatatgtgaccctccccaaaagtgcagaaaaaagtttttctcatcattccacacaagcatcctagtgcaaatgcataatacacacatccttgcacactcacaggcacaccctgcaccctcgcaccccgcctttccatctatgaggcatgcagctctactacaacctttatccctggcaatgaaccaagacaaacttgagctctctttccttggaatcactctgccctcccagacttccctgataaagaacacaaagaagcaaaagtatagacaccaggtgtacatacctgacacaaaagtataaaaccacgggtcctgactttttagggaagtcatgttccaatactcttcgatctagctgaagccagtttaagtgtcccctgaagaaaatagagacaaattggttaggggtttgcattttgcagaagtttttttggggttgaaggtatatatgaagcagaacgtgctggatcgtagataaatttgaaccttcaccttatttttaatttttttttagtttttatttttttgagactaagtcttgctctgtgacccaggctggagtgcagtggcatgatcttggctcactgcatcctctgcctcctgggtttaagcgattccctgcctcagcctcctgagtagctgggactacaagcatgagccaccatgcccggctaatttttgtatttttggtagagacggggtttcaccatgttggtcaggctggtctcaaactcctgacctcaggtgatccgcccacctcggcctcccaaagtgctgggattacaggcgtgagccactgtgcccggccaccttcaccttattactagcttttcagtattgaagaacccagtgggattaggtaggggataccgagtcagcagtggatactgtgtggtgtgaggggaagaataggaactggaaagtgaagggattgagacctgctgtttcccagggaaacactgaaacgaaaatgtaatcagaactctccttcttgtcctgaaccgcctttccaccacactcccaggtgccttttttcctgaaggactgaaagcacacttgaaaacatgttagcaatcctcacgacatcttgctggagtgaaaagcaaatcacacacagtgtctgaaaacgttaaacttaccgccaggggcagtggctcatgcctttaatcccagcactttggaaggctgaggcaagagatcctcagaggggaaccactttccaggcagaaagaccagcccgtgcaaaggccccggggtgagggaggaccccagcgtcttagtgtcctgtgagtggaaagccatgaggctagggagagccctgggggccatgtctcggaggctggtcttggaagagtggggcaaagccatggaacaaccaagctgaagaatcctctctttcctttccctcctctctgtatccaatgtcagcccatcatcctggagaagacagtcctataatcactttatggagtaaagtcacatggaacagacccaactgaccccactgcatttcccccgtagctaatgctgtgtggcatgtgtgcaagactgtggataatgagaaacaaaatctgtctgcatcattgtctaaaaacgcttgttcctctcagcacatgcttaaacctccaacaaaggaaagagagaaaacacacaagtgacttccaacccctttttgaggcttcactcaaactgcacctttcgcacaagaaaaaaaaaaaaaaatccccctccacaaagcccatacctgtggctatacggaagacttttggatctgccttagaatagtgaccacctgaagaactttggcctgtttttcctctttctaagaatctccagttggataaaaaaattccattaactttatctttttattaccttgctctgaatataggaaaagtaaaaaaaaaataatgaaagggttgggcgcagtggctcacgcctgtaatcccagcactttgggaggcgaaggcgagcggatcacttgaggtctggagtttggtatcagcctggccaacatggtgaaaccctgtctctactaaaaatacaaaaaattagctggacctggtggcaggtgcctataatcccagctactcgggaggctgaggtaggagaatcgcttgaacccgggagatggaggttgcagtgagctgagatcgcgccattgcactctagcctaggcgacagagactctgtctcaagaaaaaataaataaataggacgggcgtggtggctcacgcctgtacgcctgtaatccccacactttgggaggccaaggcagacagatcacgaggtcaggagatggagaccatcctggctaacacggtgaaaccctgtctctactaaaaaatacgaaaaattagccgggcatagtggcaggcgcctgtagtcccagctactcaggaggctgaagcaggagaatggcatgaacctgggaggtggagcttgcagtgagccgagatggcgccaccgcactccagcctgggtgacagagcgagactccgtctcataaataaataaataaatggaagagagtattgtaagtaaaataacaggagcaacttcttccagaaagctgggataaattctgttctgactagaacacaagatcaggaaacagaaggcctgggtgccaatgtcatctctgcccatgcctgataatgccccacaggttccatgatatttcaaacttctgttccttagctcatgctgttccttcgtcccagtaggcctttcccttccttcttccccagtgaggtccggcccatcccgcaggactcagctctcacgtctccgctccagaaagtcttcccacaccacacaccgggtgggatgggggggtcctcctccgacccttacagcacccaccctaggggctcacccatttctgcacttcccagtctacagaacttgctctctatgcattcattttccccagctgactttttaaaatttatttttattttttagatggagtcttgctctgttgcccaggctggagtgcagtggtgtgatctagtctcattgcaacctccgccctccgggttcaagtaattctcctgcctcagcctcctgagtagctgggactacaggcgcaggccgccatgcccagctatttttttgtattttagtagagacagggtttcaccgtgttgcccaggctggtcacaaactcctgaactcaggcaatccacctgcctcggcctcccaaagtcctgggatgacagaggtgaatgactgtgcccagcaccagttgactttctatatctggaaaatgccacgagatctacctcatgaggagaaagtgtgcatgtctggtcaactggaaggtgtcagacaaattatcttaagctgcaaccacttccttcctgcctctgaaaatgcccccaactctgtgggtcttctcttggggctcagcctcctgcgagtacaccatgtgtatggcatgcgcctggccttcactcatgctgcctctcctccttggaactggagaactgtctctccatccctttatctgaatgtttagccattgtgcaaggctgagttcaagtcttactttcagtgaagtcttccttgattgcctaagtctggggtttctttcaaacttctccagggcttctggtgtgtgtcatcttcaaggcatttggcataatcttgtacaattagttatttttaaaaaatatgacctaggctgggtgaggtagctcacacctgaaatcccagcactttgggaggctgaggcaggcggatcacgaggtcaggagttcgagaccagcctgaccaacatggtgaaaccccatctctactaaaaaaaaatacaaaaattagccaggcgtggtggcacatgcctgtaatcccagctactcaggaggctgaggcagaagaattgcttgaatccaggaggcagaggttgcagtgagctgagatggcactactgcactccagcctgggtgacagagcgagactccatctcaaaaaacaaaacaaacaaacaaaaaacatgacctatctctcaacgatcagttttcaacatttacagaaattatcccccaaaacctagcacagtgtatagcaactgttaggtgctcaaaagaagtatttgctcattgatttgaatgactgcctgcaagagcaagccatccaatgacaatgtaggcttaaatattcatcttttgtcttaccatattttatgataaacagtctgatgggaataaccttttcattattctcacaagacaaggctttcaatcacccacagactggaatgatacaaaaatacagtgatttttctctggccaccagctcaaagaataaggaggacctgagagagagagagagaatattccatttgtggaatattcaagattagtcaatggtccaggcttgagatatcctcataccactccactggcatatgagtgaccacacacactgcaagagattagacttaggtccctgggggtcaccattcacatgtgatgaacttcaaggtggggacatgtcgcatgaagggacacagacagatgtcatttggattccagtctgttgggtttacgcactgccaattcttcttcatccacagaggacaaacagacagatggattccccctctagaaaactttattccccacattaaactgtctaaaagaatgactttttaagccatgaatctgactggcaattcctttgttcccggccatctattggtttaacatttatcaagcaattaaatagactagaaaggaaagtaagaaaatgggccaggtacagtggctcatgcctgtaatcccagcactttgggaggccatggcaggtggatcacgaggtcaggagatcgagaccatcctggccaacatgctgaaaccccgtctctaccaaaaatacaaaaactagccaggtgtggtggcacgtgcctgtagtcccagcttcttgggaggctgaggcaggagaatcgcttgaacctggaaggcagaggttgcagtgagccgagattgcaccgctgcacttcagcctgacaacagagtggggccctgtctcactgacaacagagtggggccctgtctcaaaaaaaaaatggtcaggaagcaaagagaacatggaagctggaatgacacctatatgatcctacatggaatagttggcctctgaggacaaatgaatttccttcctccacttcccctgcttgaactcgtccactccaatcccatgaggggatcacgatgcatggccttgcgtagctccagtggctaatggagaggcagactttcccaaacctggagtcctcggattctctgaaggaaggaggtcagctgcctccactttaaaggcttgtagaagtctctcaatgaaggctgcttataaaggcagactgaagggacatgtgacttatccaagaccctgatgaaaactgcccactatttgggcaaaaactgaaagatggattaaaaagcaaactggaaaccataattctggggccaccacttttggctggagcacttgttacaatgttgttttctgctcatctctaagtcacacttcctgtactctacagggtcaagaattccacactgctaaaggcttttgctttcctatttaaccttttacagtcctgacatcaagtgcctccctcaaaccttttatgtttcttttgcattaggatggaatgggacgaaaagtcataaagaagcatttccttaatacagtttaactaagagatgccttatagcttggttttcatgattctcattgatttttcatttgagaatgcacttcattgcctttgccaataataatgcaaaaaaaaaaaaaaaaaaagcatcccagcagccactcagagtatttttgttattatgtgactgataactatctttaaagctgagcaagataacgctcatttggtttatggttgcagtaggtcaaactgtcaggtcagtaataaatatgcaattgcttccaggcaatagaaattggacgcattcatttaagatattgcttttagcttctacatataaaacaaatagatttttggttcaagtgttggcaccttcaatagagatggcctcagggagagctttgtttatagttactggtgggtggaggtgtgtgataagtctatctgaatccgtcactttccagacccagggggagaatgacactgcacagcttctagatgtttttattgtagacaggcaatttcatatggaatgagtttctacagaaatccaaagcaagagatgaagttcttatatgtttatctatttagagacagggtctcactctgttgcccaggctggagtgcagtggtgcaatcatagctcactgcagccttgaactgctgggctcaagcgatccttctgcctcagcctctggaatagctggaactactggcacataccattgcacttgggtaattaaaaaaaaaggttttttttgtttttgtttttttggtagagacagtgtctcgctttgttgtccgggctggtctcaaactcctggcttcaagcaatcctcctacttcagccttccaaagtgctgggattacaggtgttagtcaccacacgtggccaagtgtatgaaatgcttatagatgttgctggatggaggggaggagaggagctcttcaaatggaagaatgttgatatatttagtatccttgtcttatagtatgtgtgttcatcaaggacagaccaggcactttgggaggtcaaggtgcgctgattacctgaagccaggagttcgagaccagcctggctaacatggtgaaaccccgtctctactaaaaatacaaaaaattagctgggtgtggtggcggatgcctgtaatctcagctacttaggaggctgaggcatgagaatcacttgaacctgggagacagagtttgcagtgagccgagatggcaccactgcaccccagcctgggtgacacaacaagattccatctcaaaaaaaaaaaaaaaagggacagaccagtgatactgatttcactataaacctttaataatacaggaaggttaaagtagggtatatactggggaaaccagattactaaatcatgggctctccagcccaggataaattgttgtctccactatgttttagtaagcctattccaaattttctttttaaaaatgttttattttttagagacagagtctctttctgttgcccaggctggagtgcaatggtgcagtcatagctcgctgcagccttgaacccctgggctcaagtgatcttcccatctcagactcctgaatagctgggactacaggtgcacaccaccactcctggctaattaaacaaatttttttttttgtaaagtagaggttttgctgtgatgcccaggttggcctcaaacttctggcctcaagcaatcttcccacctcagcctcccaaagcactgggatggcaggcatgagctaccatacccagcccccaattttcttttctagcgcttctacaccacgttttgtgaatcacttcctaatctacaaacacaagctcaacaaggagtcaagggccagtgctttctggatctccagtggttaagagcagatgctaaataaatatttgttaagagaatgaatacagcagcttcacaatatgccccacagatccatattcttgtaggttcagggactgctgtgtagacacagctcccatcctaagcaaacagtctccatattaagaattcactccgctcacctgtgccaggttcccagctccctccggtcatttgcattgggaaggaaaggagggagaaagccgcatccctaagctttccttggagggcaccgttctttttgtttatcttagctgcacacagaaagagctatgctcaagcacttctctggtcactaaatataaggtactgttgtatgtttgccgttgtttccgacaacacagcatgggtcgtctgagaggtggtaatgaacaccgaatgccgcgttcccagaagcagttattacaagccaggcacggaggctgcagccactgactttctcctctctcactgtccagcagataatacgtggaaatcccaaacctatttccaaataaattgctttcccagagctgtgtcttgtggttgtttcttctgccactggaaaattgcttttctattttgtttatttttaaattgtagataagcttgtggccaggaatgctgaatgactgaacccttttcagaggccccagctgatgccagtcacagttgaaacaaacgcgaggacctgaggacagcacagacccaagctcgctcccgtgcaccagccttcctggcagtggttctaaagatgcatcttcaatgagtcaggactttttctttctttctttctttctttatttcttttttttgttgagacggagtctcgctctgtcgccaggctggagttcagtggcatgatcttggctcactgcaatctcccgcctcccgggttcaagcaattctcctgcctcagcctcccaactagttgggattacaggtggctgccaccacacccagctaattctttttttttttttttttgtatttttagtagagatggggtttcaccatgttggccaggatggtcttgatctcttgaccttgtgatctgcctacctcggcctcccaaagtgttaggattacaggtgtgaaccaccgtgctcagccaggccattttaaccttaatagtttgggtaaatcagactccccagacagcaccaatcaggcaattcaattaattaggatacagtctgctgaaagaaaagatccttaattgtttactgtctaggttcttaaactaacatcctggccgcagggtgtctgtgagtgttgtaaaatgtaagcaaaaatttattttgtatgtaaacttttatgaaggaaagggaatataacttcaaatctcaaaggcggtgtgatgaaatcagaggttaaaagctactcgttttcttttctttcttttttttttctttaagagatggggtcttgctctgttgcccaggcaggagagcagtggcgcaatcatagcttgctgcagccttcaatacttgggctcaagcaagtctcccgcctcagcctcccaacgtgttgggattacaggtgtgagtctcaagcccagcccatattattaattggtatgtgaaaataaattctaactatacttgtcttttaaatttggagtaatggctaaccaagtttcttttctttcttcctcatatttctaaacacttttaaaaggctttttttttcttaaaaaaaaacccccaaaaaatcaatcacaaaagatacttatttacagcatttaacaagcaattcttaaaatttatgacaggagattcaaattaaaatttaaatagattatgacaatcattaattcaacttgggtgtgtttgactgtttctgctgaatagcttaaaagttggttagttataggctatagcttctgataacgggatcttccattcccaccccaccccctggctcacaagctacttcttgattttaattagttttgttgttgagacgaggtctcactctgtcaccagggctggagtgcagtggtgcaataatagctcactgcagtcttgaactcctgggctcaagtgatcctcctgcctcagcctcctcagtagttgggactacaactgtgcaccaccatgcctggctaatttttaattttttttttttttgagacagattctaactctgtcacccaggctggagtgcgtggcgtgatcttggctcactgcaacctccacctcctgggttcaagcaatgctcgtgtgtcagcctcctaagtagctggaattacaagcatgtactaccacacccatttaatttctgtatttttagtggagacggggttttgccatgttgccagggtgatctcgaactcctgacctcaagttatctgcccacctcagcctcccaaagtgttggtattacaggtgtgagccacaatttttttttttttgttttgtggtagagatgggggtcttgctattgcccaggctcgtcttgaactcctcctggcttcaagggatcctcccactttggactcccaaattgctgaaattataggcatgagccactgcactcagcccacaattaagaaaaaaatgaaatttgagtcttaaaacagcaatagaaatatttcaaaaaaaaatgtaaaaatgagtttctctaagggatggatgccagtgtttgataaatgaaaatctcagttaccctatttgtacacctggaaacattaaacctgaacttccaagcttgttctcctactgttaggaatggaagctagaagggagatggtctgtaactttacaggcccctgggatgagtcgttgctagaccccaacattcaacgctgaagtagaatcagcttttcttctttgctctggagggagagagcacaggaaatactgcaacatgcccgctgtctagaacaggggttttcaaatttgcctgcaagctagaatcagctgagaagctgaggtcacacccaagctgattcaattggaatttctgggggtaggtcccaggcattggtattttataaagtgtcccaggtaattccaaagtgtaactaaggttgagatccctaactctagcaaaatataaatactttttttattttttgagatggagtctcgctctgttgcccaggctggagtgcagtggcatgacctcggctcactgcaatctctgcctcctgggttcaggtgattctcctgccacagcctcccaagtagctgggattacaggcatgtgacaccatacccggatgattttttgtatttttagtagaggtggggtttcaccgtgttagccaggatggtctcgatctcctgacctcatgatccgcccacctcggcctcccaaagtgctgggattacaggtgtgagccaccgcgcctggccaataattattttaacattggatttataactggctcttggttagtttcaggatgtattaaagggtgccaaaatgtctttgtttgcatgtatcaccacgattcagataatttatatagatgaccacctgtatctctttttctgaggacagagttagtaaaaataaaaggaggccagatgcaaacgaatcttgtacagaagagagcactcgtaaaaaattggggaaatctgaatcaagtctgtagtttagttagtaatataatgccaatgttcatttcttagttttgatgaaagtcacgtcgtttgcaagatgttgacatttgttgaagttgggtgaagggtataaaggaactctaatatgtttgcaattcttctttaagtctatttcaaaactaaagttaaaagattaaaaaaagaaagcagacttagcattaatgctgcaaaactgttgattgctaacaatattaaacattcttgggcataagttcttacactgtgacttagatgctttattaatgaatacaacttatggagtgagagaagcttagagaaatttccaatttcctgtctacattctgctttatatatattttctccagtttcatctagatcccacaaaatgtcaacagcagttaattctgaaagagtctctgacaatatatgacctagagtcacacgttctattatttagaaattctttttttttttttttggagacagtgttttactctgttgctcagggtggagtgcagtggcacactctcggctcactgcaaactctgcctcccgggttcaagcgattcttctgcctcagcctcccaaacagctaggattatgggcacatgccaccatgcctgactgatttttgtatttttagtagagacggggtttcaccatgttggccaggctggtctcgaactcctgacctcaagtgatctgtccacctcagcctcccaaagtgctgggattacaggtgtgagccaccatgctcagcctactattagaaattctactctcaggaacaatcatgctgctggtaagagtatcttgcacttgtacggcacttcacagtttataagtgctttccacgtgatagccttgttttatttgcattaggaaatagacaaatacatgtgatacaccacaggctgtcataaagaatggaactacgattgcattttactgtaaaacacacagtgtagcacctgtataaagcacagacacacacatgctcacaatacacatgcagaattagaaaacacggttataaaacaattttgctgtagtgtcccgtgatacagagcaaggccaggggatgtagtactgtaaggctagcgcttactacctaggaatcaccaagccagagcaggtgaacacccaagggcactattttgcaggggcagcttttgttcttctttcctaccaggaaaaggagaaaagttcagatgaacaaagaggcactcccaatgtctgttggccctggcattgtaccgccaggactgacagcccttgagtcacggcctcaccactgcccagccttgcaggagccagctcttcacctcctctgggctcctgacacctgccctttcccctggtgcaccaggcacatctgctagttctttttcagaaatcttttgccagctccagtggttttctagtgacctccagctggctggccgccactccttctgtggctggagagaccctcccacctagactctggggcaggtgatggaaatggctgcactttctctggatcatgccagaaggatggctcactcctcttcatcactgccccccacagagcctccacatagccagctccactactagagggggcaagacacttttatccagcctggcttctacgcacgcacacacgcacgcacacacgcatgcacgcacatgctttcctggtcagcacagagagccaggagaactcagacatggagtgtaccagcttagctggatggggaagctgaacttgggtgtgtgcaccccctgctgtgacgtgtggttttggtgctctcaaccctcctgggagaagagtgactttctacctaggtccgattcctgccagtcagtgctgttagggcagtgatctgaaatgttctgcagactcacatcatcttccccttcagcccaggatcacacgttcgtttttcaattcttgtttattcaaaagggaagcctaatcaggcctcctctagagttcacgggatcttttagtaaacttacgtgggaaatgtgaacaatggggctatgattaattgaaacttagggtttccttctgattagtgaaaatagtctcaacagcaatttaagtggtttacagtgattctcaggagaaaggggagagaataatctacatttgtaaaagtaattgttctacatgtgcatttgtttaaaagcttttaaaaaaattgcagtgctgggtccttccccgcacagccctgaacctttcccagctgggcttacttggccctgcctgcaattcctcctgcccaccgacggccactcccacctgcattccagttccctgcaggctccaggacgaggggcccaccttgctcctcccagctttcttgaggaagatgtggctttgctcctgctgcctgctctctgaacacaccacagcctgaaatgtccctgatttacagggtgaccagatggtccggtttgcccaagacagtcccaacgacacccccttttgttcagtgtctcaatttggataataagtcataagaccaccccttccacttgcatctcaccaaggccaagtgtagccatgtgcagggacacctggttgcctctctcactggcccatgtggatgcccacctgttcttgcttcagtggcaccacctgattcccagggcctcggctcccctgtactgtcttgcctggccactaacctaacactgatctattagtagtttaggaaatcatctctgtatttctgaagatctggaagacagagagagagagagagagtctgtgtgtgtgtttgtgactgtacgtgtgtgcacagaggaaagagaattatgaactattttcttagaatagctcatttttatctagaaatctatacaggtattcagtatactcttttgataacagtaccttaaaaagaaaatggaaattttagtaaagattttccttacttgtattacacaacaccactttatagagccaaactgaaaagacccttgaaagcaaatattcttctcatcagatcagtgatctgaattttttattttcatagtcgctttatttcagtttagacactgaaactgcacaggttattttcattttgaatttatcatcaaattcacttcctgttattgttatcccaacagtagagagaaatgtttcatttccagaagttttcatttaacttaaatagaaaacaaactcacatagatccacttaaaaaaaaataaacatttcagtctgaacacaaacctgcttgattattagaactagtttacctaataattttataatattagtatcaccctaattatatcctttggctgtaccaggcatgaccacaaggcctttgaaattcagatgatgaacttggactgaccccagaccatgggacccaagtggtctgcagctgatttcgctgctaacagctggagtggagcagtttcgggttctgcactgactctcccttcgggctgtgagggctcaaggcagtacttacgtttcatctgtgaatgctattccaaagtactccttttccttcagattgaagtgagaagccacaaggtcaagaagctccttggccaacagcttgggctgcaagaagaatacaatggaagaagggtaagtgatgagagactgcttttcctaaaatatgcaatctcaggtttccataattttttcaatgaaatgtcacaaagctcaagtattttgaagcaaatgatttttataaacccaaacaaatagacaatgacactgatgagcacacagccaagtcaagggtcatcaacagatagagaccttctgttttgtttcctagaagggtttttttttttttaattgagatggagtctcgctctgtcatccaggctggagtgcagtggcatgatcttcgctcactgcaacctctgcctcccgggttcaagcgattctcatgcctcagcctctgggattataggcatatgccaccacgcatggcttttttttttttttttggttttaggaaagatggggtttcaccatgttggccaggctggtctctaactcctggcttcaagtgatccacctgcctcagcctcccaaagtgctgtgattacagacgtgcgccatcacacctggctaatttttgtatttttagtaatcccagctacttgggaggctgaggaaggagaatcgcttgaaactgcaaggcagaggttgcagtgagccaagatcacgccactgcactccagcctgggtgacagagtgagactctgcctcaaaaaaaaaaaaaaagatatctgccagtctaaagaagcacaccagagcgttaggcataaagtcatggtagatgtttgtattgttaacatgttattcaccttggtctgttactactgaagtgaccacagaacaccaggcactgaagtgggggagggaggaaaggctgtctgatgcggaaacagggccggaagagaagagttatttctaaactagcttccaggtcatgcatttgaaaatacattgcctctatgaaaattactccattccaagcacactcaccagatattaggaaagttatttcattatctgttggtttttttttttttttttgagatggagtctcgctctgtcaccaggctggtgtgcagtagtgcgatcttggctcattgcaacctctgcctcctgggttcaagtgattctcttgcctcagcctcccgagtagctgggactacaggtgcgtgccaccatgcccaacgaatttttgtatttttagtagagacagggtttcaccatgttgtccaggatggtctcgatctcttgacctcgtgatctgcctgcctcggcctcccagtgttgggattacaggcatgagccactgcacctggccgacagttggtttcttatttcactttttgggtactgccatggactgaattatatctccccaaaatgcatgcgttaaagctctgacatccagtggtatttggaaatgggacctttgggagacaattaggtttaaatgagtttatgagggtggggcccccaagatgggattcgtgtccttataagaagagacaccagagagcctgcttcctctctctgccatgtggggccaaaatgcaaaggtggccctcaccaggagctaaccatgctggcaccctgatattgaaatgactgtttaatacaacagacatttatttattgaatgcctactatgtacagggcactgcccacatgctgtaggagacagaaaaataagcaaggtgcagcacaggcccatagggaccttagacttttaacagggacacggagtaagagctagcgctgagtttaaaaagccaaagaagatgctccacccttttctgtctcactcctgggctcctgggtggcagcctcagggcctagatgaccatcaattcactgatgaaaaccacttaaactgaaagaatgggtttgaagcttcctccccagcagacaggaatggacaggagaacccaacgtgataaatcaataccacctcatagtctatacttccattcatactgaattttgaaaaagtgaaaaagcaatctctataaccaacagggaattcaaggtgatacgtcagaccctccctcactcctggtggaacgtctactctgcgagaatgcagtggagtaaacgtggcacatctcagaaggtcgctgatgaattacgaagtagaatgcaagatgggtgctcttgaagcttccggtaaatgctgtgtttgccatgggctgtggccagcactagctccacccccaggaagtattcggctgcccaataacaaaggctttgctggatcacttgtgactatgaggtagtgtggctgctttttaaattgcaaggtagtggccgggcgccatggctcacgcctgtaatcccaacactttgggaggccgaggtgggcagattgcgtgaggtcaggagtttgagaccagcctggccaacatggcaaaaccttgtctctactaaaaataaaacaattagccaggcgtggtggcgtgtgcttgtaattccagctactcgggaggctgaggcagagctcttgaacctgggaggtggaggttgcagtgagtagagatcacgtcactgcactccagccttggcaacagagcgagactgtctcaaaataaaaataaataagttgcaatatacatatgctcctcgaattatgatggggctacatcgtggtaagctcattggaagttgaaaatattgtaaatcgaaaatacatttaatacaccttacccaccaaacatcacagcttagcctagcctaccttaaaggtgctctaaacactgccactggcctacagttgggcaaaatcatctaatgtcaagcctgttttatcatagagtgttgaatggctcatgtactttattgaattcagtacactgtagactatcagttgtttactcttgtgactgtatggctgagcagcgctgccagagcgtattgtaccgcgtactgctagcctgggaaaagatcaacattcaaaattggaagtacagtttctactaaaagtacattgcttttgcaccagtgtaaagtagaaaaatcataagtcagaccatcataggttagggacagtctgtgatataatttacctgtccaaatgattgctaccgctttcaaagtagtcactgtatttctctgatgcttgctatttcttgaaacatttttgataatcttttgggtttgcccttgaggcttgtgtcagatttgtcaacgcgttttcactggtgataaatcttcctgtgctcgagaatggatttgattttttttttcaaatgccaaaagtcacttaaagtcaagtctagtgaacagagatagaggaggaggaatgggtgattatgcctggtcaacccagtttcataaaatgaagtgtgactacaaagtaattattgtgggttcttggggattatggtgagaggtctggtccaaacttgaaaacaataaaaataagattttgttctttttgagattttaactttaaggctgggcacagtggctcttgcctataatcccagcactttgggaggctgaggcaggaggatcctttaagcccagaggcgatatagcaagaccccatctctacaaaaaaaaatttaaaaattagccaggcatgatggcatgcacttgggactagtcctagctattcaggaagctcagaccggaggattgcttgagtccaggaaattgaggctgcagtgagctatgatcatgccactgcactccagcctgggcgatagagtgagaccctgtttcaaaaaaaaaaaaaaaaaaaaaaaaaaagaaagaaagggaaagagagagagaaaaaaaagaaagaaagaaagagagacagaaacagagagcaagagaaagaaagagagagagaaaaaaaagagagctaaactttaaagcctacatctcaacagatttgatcagagatacataagtttgcccagaaagagaaagaatgattcccagtgctggcatagtttatctagaacatatgttcatcactccatagaatgattgggcctgaatggaagggggtaagtggaggcagggtgggaggtgcagttggggaagggagatgaacccaggaagcaaacgtgatcttagccaataggtgttgaatatttgggtcccttaccgggtggtaaggccttttatgtggcagaaatggaggcttggggttactttagctgatcatgttacattgaactctcctaattccatgcctcccaaggaacacctacatcctggatatgtccctcatatatgaactcattatcatccagaatagagattatcattcttttgccaaagaagattctgagactgagagataccaggcaggctgtcctgggtctcacagccaagctgggattcaaaacaaggttgagatacacagcatggaatattatttcgccctaaaaaggaatgaaatcctgacgtggatggaacctgaagacattatgctaagtgaaagaagccagacacaaaaagacaaatattgtatgattgcacttagatgaggtaattaaacaggcaaattcatagagacaacagaatagaggttgtcacgggctgaggtggtggcagatggggggttattgcttaatggttacagcatttctgtactggatgatgaaaaagtgttggaaatattagtgattgttacatgacattgtgtatgcatttgatgccactgaattgcacatacgaaaatggttaaaatggtgtttgatgttacatgtattttgacacaattaaaaaaaaaggaaaaagggggaaaggaggtctgatagtttcaaagcccacatgtgtaatccctctgccactctacctctgttgaccctgcttccagggtgagagcctaaggatcgtgcctcaagggccctggctgagtgagggctacatgactcacttgaaaccagtgcactgacattatggatttatacatcagtactttcaacctggttaatgtgagtcttcccctgagaatgaaaaatcaggtttctgagcctgcagaataaagagatggcttaacacactgaagaattcaccagagtaatggataccaccatggaagccttctggagactgagtttttgccttaccatggtgatatgtctctctgatttagcctgtcacactacaataagaaaacaagttttcttggtgactcataaactgaagtcaaggaaaaggctctgagcagtagctgcctggctggaacaaacttcatcttttcaaataaactttttcaacaattgtacctatctggatttatatcttttgttaaaaaatttaaaaggtcagtcccattactttacacaacagttattatagaccatatgtatcaatttccaggaagaaaagcctacatttattacttgcaatttacaaatggagaagtaaaggccgtgaagagggagaaaatagatcccagaagatgttgaggttacaactcctgactcttagctgcttttaaagccacacacattttttctgctgtcatggtgactggcaacagcccagaaggtggctgctctgtcaatgagagtgagagttgatggatgggcatgtagtgagagtgagaaatacacatcattgtttcactgtttaagtcacagagacattgggggttgtttgtcattgcagcataacctagcctatcctgattgattcaggcactgagtcttttattttctgtacagttgatttaaaacaatttgtggcatcagctccttgatttcctgatcttgcaaatgaagacaatatcccccgctgatgtgacagtgattaatatactacattgttctgaaagtttcttaaactccttcagagaaagttgctgggcaagcagaaagcaatctgctcttatgtgctttgaagggatgtttacagaatcccgctgagtataatttgccaattactggtgctgtaaacatttgtggagctttgcagggatcggactgggagcaaggccagaaaggcagctagtagcccaatcgcattctattggacaatctgggcaggagcccagaggccacgtgagcaaggcagcctgtgctccctgggtttgtcagaattagcctcttgtgggccatcagccgtcctggccctaagaggtcattacatctaagactggctttctcttagcccataattagctttgttcaatcaaatagtttctctcttttctttttgtatctcaaaatctttttccattgtccctcttagcttttatttctcctgatacctgacaaataaaacctccttgcaaacatccctccttaacatatacttctcagtggcaccactcacagagctaataggacagtctttccaacaccaactgggcttagaaacctgggcttcagccatgtgctttagcaaggaaaggaaagcactggttctaaatacttagggaagaaaggagaggagctctcagtcagtgctttgtggctccaggacccagatctgagttcttgagaacactggatgattccagtgggaactgttcacgttcccagcatattacagggttccagatcaggtcctgactacttcctggcctgcttcttccaggcaggacacgactaactagaatgatcaaaacagcacttaacgtgttgcagggctgtaaagcgctctaggcacactgatatggtttggctgtgtccccatccaaatctcaccttgaattgtaataatccccaggtgtcaagggcgaggccaggtggagataactgaatcatgggtgtggttcccccatctattctgatggtaatgaataagtctcacaagatctgacggttttataaacgggagttcccctgcacaagctctcttgcctgccgccatgtaagatgtgcctttgcttctcctttgccttccgccgtgattgtgaggccatgtggaactgtgagttcactaaacctctttcctttataaattacccagtctcaggtatgtctttattagcagcatgagaacagactaatacacacacccacatgacaacatcctttcaggtgacttccatgagcccttcaggtaaattctggggaaaggaattcaaggatgaggtagcacccaggcacctcaccaattcctcacagaatactatattccacagtatactatactacatacagtatcaagctctaaatgctagcctggtatttaccatcacttatatattatgccaccaacttaaacttgacatgtgtctatccagatagatgatcttagacaaattacgcaagctctctgggcctcagttttctcatctgtacaatgatggactactgtaccataaaaagaattcctatactaagacattatttatgttattattattattgtttttagatacagggacttattctgttgcccaggctggagtgcagtggtgccataatatctcactgcagcctccaatcctgggatcagtgatcctccagcttcagtctcctgagtagggggggactacaggtatgtaccaccatggctggctaattaaaaaaaaatttttttttgtaaagatggattctttctatgttgcccaggctggtcttgaactcctggcctcaagtgaccctttttctttggcttcccaaagtgctgggatgacaagtgtgacccaatgcacccagcctttattccttatgttattattaaatttagcttcttcctttcctacaaacgatcctgccttcctaagagtgttattcacccattcgaaaaaacttgaacaccatctgcatccttcatgatctcttgaatctagtcagttaatatatcctgtctttcttatataatttcaggtaagttactaaacctctctgtgcctcagtttcctctcagctattaaatgaggataatgactatacccaggtcacaaggctgttttgagaattaaataaattagtctgatctatatgaagtacttagaatatgcctggcatggaacgttacttgtattcattatttcagatcctaatcataaattatttaaaaaattccatgtatggccaggcacggtggctcacgcctataatcccaggactttgggaagccgaggtgggcagatcacctgaggccaggagtttgagactagcctggccaacacggtgaaaccctgtctctactaaaaatacaaaaaaattagctgggcgtggtggctcatgcctgtaatcccagctactcgagaggctgaggcacgagaatcgcttgaacctaggagatggaggttgcagtgagccgagatcgcaccactaccctccagcctgggtgacagagtgagactctgtctcaaacaaaacaaaacaaaacaaaacaaaatccccactccatatagtatcaagttctaaatgctagcctggtatttaagaccaccctatgaacccagccccagtttacctatccaacctcacttttgcccagttccctacaaaaatatccatttctgttcaatctatttgattgaactaaagaaaacactgatctcatttttatttccaaatctttgtacattccattctccccctcccccttcccatttaaattttatcctgctcaaagcccacttcctccatgaagccctccctgaccatcctgcctacaaatgctctctccctcctctggatttctacagcactcaacacaggcagcttagtcacacttggcacatgtgctcttgtgttgtggtaaactttgtgtgacatgatttgttacactctatagcaggttgaatggtggtccccaaaaacatatgtacccatcccagtcactggaacctgtgagtattacctttcatcacaaaagacgtgatccttgggaggaggaactaatcctggtgggctctaagtgccattatattgtctccttttttttttttttttttctgagatggggtctggagtgcgggctggagtacagtggcacgatctcaggctggagtgcagtggcatgatctcagctcactgcaacctccacctcccaggttcaagcaattctcatgcctcagccacccaagtagctgggattataggcatgtgccaccacacccagctaatttttttgtgtttttagtagagatgacgtttcaacatgttggccaggctggtctcgaactcctgagcgcaagggatccacctgccttggcctcccaaggtcctgggatatattgcctccttataagagagatacagagggttttttaaaaacagacatacaggagagaagacagaggcagagacctgagtgatgagtgatgaagacacaggcgaggaaccccagtcactagaagctggaagaggtggggaagcgattgtcccctccagctgcctccagaaatttgggagagtgagtttctgttattttccagccatcaggtttgtggttatttgttatggcagacacaggaaactcatacaccctcagatggaaaccccgaagacctcgtttccgtgtaattgaagggaactcagcactggttggttgtgacatgagtgatctcagtgcgaagcctgcattgacattggtgttctctctccactgtccctgtggcactctgggctgggaaggcaggcgggccttggtctcagccgaccttgggtcactccatggtgaagcaggccccttaagcttcttcttgttaacctattcccttggggcatctcacagattctaagtcaaaagagttgccacttctgagttaattgtatctcaaaaaaaaaaaaaaaattcaaacagcaaacaagcagtaaccatcaggtgactcccatctgtgctttgggaggaaccacggtctcctctgaagagtgacactctcagctcctgctcttcgccaagggtgttttttgacaatccctttgtcactgcagagcccccagtgactgctaagctgccagggtttggacacgcatggccggatggcacagccacagccgccgctctgtgcccagcactgcctgcccatccactctgcccgggaccccgggacctgctggatgggtggctccctgccctttaggagtgggtgcagctgtgggatggcagacaggggctgtctgggagtgactgtgaaacgtggcccgtctgcccccatctctctggacaggaggggccggggttagcttttcggaaaacccagagggaaagagcaggggaaggagcgcagctttgaataaatgagcctgagcaagctgccgggtctgaagcctgggctgtcactgtgtgtccctctccatccccatgggggctctgagcccagcaatggctcagcggctgctcattattcccggggaggggaagctgctgcggggggtgcatgaggtgactctgtgcagctctgtccactgtgtggccagcaggtctgggcggcgactcccctccttgtcgccctgctgcttagctgggaaggctggtttccttcctgcctctccagcacagccctgggttctgtggcaggggacacagggaggctacttcctgtaggcagacgggtgtgaagaacaatggagttgcactgtcttggctctcaggcacccagaacaggtaggagagaccccgaagccaagatcagagacccgcctgccagaggtggcatctctttacccagaggtccctgcccagcctgaaccgggatccattcgtgcacatgagacaaatcctttacctctagtctaggagtgacagtggcatcacatcgctgcagcagaacagcaaagctgccaacaacactgcccacctgtccccgcctgcagctgctacttcacatgaattcatgcagccagccctagaaaccagaaacacctgaagtagacaccaggattgcccccatgtgatagagggaactgagatacagccagagaagcaactcgccaaattcacacagcgaatcagtgggagaactgaaccgcggcacacaggtgggcatgggtcacccaggattataggaagagccagagagaccatctgcccagcccacttcatgacggcagcagaaaggaaagcctagaggaggccagaaacctgtccaggacgagggtgggcaccttggttaccagcataggtgaggtggccccgaagtgcccgccacacctccatcctttgcccccgctaatgttacacttaggggacagagcaggtctcgaagatccgaagcaggaaggaaagaaacaaagtacatcaaggaaaggggtaaaagtggtcactgacagaaatggaaacgatatatatatatatacatacacacacacatatgtacacacatagatctatatgtatgtatctatttgtgatgtacaacatgatgttttcatgtatatgcacatgtgggctgacccatcaagctaataaacatatccatcacctatcatacttacgatttttgtagcgagaacatttccaaactactctcagcaattttcaagcattgaagacatcgttattagctacaataaccacgatgtacaatagatctcctaaacaaagctttgcttgcttttaaattctggggttcagatctagcaaataacagcctctcctgaagtcaaaagccaagccaccttttctaaatgcaatagaattttgccagacagtaagttcctggaagggagggatcacatttgatcgacatttgtggacttacaccccaatacagtccctgacacacagtaggtgcctaatgaaagtttcctattggtagaatgggacagaataaagggtggcatatgcagttgttctaccacgagacaggatggaacctggacaccctcttgagctggtttgaaggagagatctgctaggcagagactgcggtgctgcacagagccagatgggaccaggtgtcgcatgctcactgatgccagagagccactgggtttcaatcagatcacacagctccaggcagccatgaaggggcctgtgacagatacttgtgtccccaggaaaggatatgtcatgtccctattcccaaaccctatatctgtgccctcttcttcctcacccaactcctccccaaaccaacaaagtcacagctccctttaatagctccttctctctcccctccttctctctctccttccaagtgactctgccatttaacccaggggtgaggtctccctgggagcaatgcttttagtctccccatttgtccctctccttcccctttatgcttttattccctgggtgtcatcttcttatttccacatagtttcttccatattttcctaagatgcagtctggtccctgtgttctctgaaaagttgggactgatacccatgtgggagggaggctttctcatccatgcatttgaatgatgcccaatgggaaggctttgacaggcgtacataatgattgctcctctagaaatgcaaagtgctcacaagccagccagccggctggggagcctgctctattcatgatccccgggggactctgggaggcgggcaggtgttcattagggaggcctcctgatgaatagagcaacccccagactccagcctgctcagggcaatgtcaccaggactgtgagtctagcgtggctccccttggcaagcctctctgcattaatgaaatgataactgtttcggtaaggagaaaacagaaaaagacaggcagtgctcaacctgcctctgccagataggactgccaagtctgcagcccaaattctgagatatttatagaaaatatggggatgataaacgaagcaacatcttgggattccaagctccatcttccatggccatctggtctgccacttccatttttttgttgttgttgttaaaagaaagcctgccctgcagactctgtgatgaccccatcttgtcctgcagtgagtaataaatcactatttctgataaaagctgcccgtgcactcactgggaggtgaggtatgttctataagatcaaatgacacattggcagattggtacctttccacggggccaaatgacaccaggaccaactcaaactagatatcttcatgacactgcacactgaattattccatttgctcgatgttcaaggaagagcagagaagagtgtctgtcaaccaagaacacagggaccagccacttgctacttttccagtgtaacggacggaaggtgtggctcgtatgacatctgctatcctcagctgtggctggcattcgaagactgtgtctctattgccatcagactggaaagggaaagcttgccttttagcaggatggtggtgagagccaagttcagagggggttaaaaaataataatatatcacttccaagattaagttacagaaaaaatattagtacagtcaaccctgcatatccacaggttctgcatctgtatattcaaccaaccatggatcaaaaatacttaaaaacaaaaaaaccaggctgggtgcggtgtctcccgcctgtaatcccagcactaagggagaccaaggagggtgaatcatgaggtcaggagttcaagaccagcctggccaacatggtgaaaccctatctgtactaaaaatacaaaaaaaaaaaaaaaaaaaaaattagctgagcatggtggcacgtgcctatgatcccagctactcaggaggctgaggcagaattgcttgaacccagcaggtggaggttgcagtgagctgagattgcactactacactccagcccgggtgacagagcaagactctatctcaaaacaaaaaataataaataaataaagataaaaataaaaaccaatacaccaataataaataacacaacaatatagtataacaactatatagcattacatcacactaagtattaagagtaacagctgggtacggtggctcacacctgtaatcccagccctttgggaggctgaggtgtgtggaacacttgaggtcatgaatttgagaccagcctgaccaaaatggggaaaccccgtctctactaaaaatacaaaaaaattagctgggcctggtggtgcatgcctgtaatcaaagctactcaggaggctgaggcaggagaatcgcttgaacccgggaggcagaggttgtagtgagccgagattgtgccattgcactccagcctaggtgacagagcaagactctgtctcaaaaaaaaaaaaaaaaaaaaaagagtaatcaagagatgatttcaagtatacaggaggatgtgtctaggttatatgcaaatgacatcacactttgcagtcatttttccctcattcctgggggacactttccaagactcccagtagatacctgaaaccatgggtaacaccaaaccctatatatactgctttttgtcctatacatacatacctatgataaagtgtaatttttaaagtaggcagagtaagagattaacaaccataaccaataataaaatacaacaattctaacagatgccagcatcactacacttgcactttgaggccattatgaaatcaagtaaggttgacttgaacacaagtgctgccatcctgagacagttgatcagatcactgagatggctactaactgactaaaggtggggagcgtcaacactaggggtccccaaaccccgggccgcagaccagtactggtccgtggcctgttagaaactgggttgcacagcagtgggcaagcgagcattaccacctaagcagcagtattagattctcccgggaacccgaaccctactgtgaactgtgcatgcgagggatctaggttgtatgctccttatgagaatctaactagtgcctgatgatgtgaggtggaacagtttcatcctgaaaccatccttgcccctccccaccctggtccatggaaaaactgtcttccatgaaactggtcccttgtgccaaaaagcttggggatcactggtctatacagtgtggcaatgccagacaaagggatgattcttgtcctgggcagggtggagcaggacagcatgagatctcctcatgctactcagaatggcacccaatttaaaacctacagatggtttatttctggaatcttgtattgaatcatttcagactgtggataactgaaacgtggaaagtaacaccgcagataagaaggaactactgcatctaacggacttgagcatctgatgattttggtatcttagcagggtcctgcaaccaatgccctgtggatgccaagggataactgtgctgtgattctcctaaaacgtgtctgtttcatggaatctgggtggtgaatttgtaatcggccttcagggctctgaaagccagttctacccgatgtgtaccttgatcagcatctgcctcactttgaacattgcaacaataacctctacctcccaaagctgtcacgaggactcaataaatgatcattcacaagggacctggtacatgagaggtgctcagtaaatgagggttccccctttcttcttaatcagtaactgaatccctattaaaattatcccctcctcactttgacaaagaccttctctgatcagaatctaaatacccttcagggtgagctgtcatccttcatctcgggaaccatgaataaatcatcactacacggtgaggggaatagaacgcaggccacttcccttggaattaaacttatttgagcagccttgccctacacagcatactttcttattcccagtgtctgctcagaaatacccgctgcatctactataggatttctcctccttgcacctgtctctgcctattggttctttggggttaaaattccatttattggccagaagaaaaagaagtccctctccggccccagtgatacgcccagagacatggcactggcttttcatttaagttggaagttccctaagtgctctcccctgtgaatcctctccctaaagcgttacctccccatggctcttgtggatgactggcaggtgcatgttagagagatacattttgctcagctgatgatgtcgttttcgatacaattaaaaagacacccttactgggctagaagagtaatgaaaaagtacagtaccgatactgctctcccgggaggctaaagagggaagatcaactctgggctgaaaaatatttattcctaaacagcattttcatgaaagtcaggcgagcaaggatgtaaaagccacacagccccttcccttctggcatgtaattaatggatgaaaacagacacgtgtcctcgggtccaaagaaaacttgagtctgtaacaccctccatcctggactgaaaatattaatttattctatattctacatacttccaaaggtttagaggaggtttacggaattcaaaatagcacagaatagggggattaggaacttaagtaagacaaagtccattgaagacggtgaggcatttatgagacaaatgaatttctactgcagggcacagaattggactctgtggagggagatctcgcgaggttacacaagcttcgttagcagacaaaagaaacgggttagctttttccaagaagtacacataaggggtatcaggcatcatggcttcaacacagtttcagagaaaaccagaaatgtggctggcatgaaatgtctcatggtctagcccccagcaaagcccagcacacaagcacgatctgcgccgttcccacagcctggggcagatttcaagcccatctcccgaaacccgacaggatattctgggtgagacctgatgttagacatttacataagcgaatttggcctgaaattttggaggcgatgttttattaggtttttaacgcatgctaatgtcggccattaggcagcttggcactgacattttgtcttgattctgaagccaaaccacataataaatatgaagtcagtctcaattcaggcaaagcgaaacagcctcctgcagactgataagccaagaggtaggaatgttcagaaaatcacggtcaagaaagcaaaagcagatgagctgagccaagggccctgggatctgagagaggggttcggaggttccggcagtctgtaagtctgccaggaagcaaggaatgggctagatctccaagcctacccccaggagattggagggtgaggcccgcacgccaggaggagtgggagaggaggagggagaaggggcccctctgctcctgcctgcttcggggagccctgctctttaatgctgggctcaactgctgtctggctgctccgagccccttgggctcgaagcccctcccctgtctctactgcccaaataccatttatgcaagaccccgctctgtagcccctctgcagagagagctgccttgctcagctgctcatggcggggctctcagagtgctccaagctccagcaggcctcgtctgaggcactgtcctaccacatttccatctttttttctaaatccatgccttttcaaggatggcaacatcttgaaagcagggatggtattatccacatctctttttttcttatttctgtacattgaagtggtacaagtgcagttttgctacatggatatactatgcagtggcaaagtctgggcttttagtgtatccatcacccaaatagcatccgttgtacccattaggtcatttctcatccctcaccccctcccacactttcatgtcaccaatgtctattattccacactccacgtccacgtgtgcactttaagtgagaacatgtgtatttggctttttgtttttgagctatttcacttaatgacttccagttccatccacgttgctgcaaaaaacatgatttcattctttttgatggctgaatactattccattgtatatgtataccatgttttcttctttctttctttcttttttttttttttgagacggagtttcactcttgttgcccaggctggagtgcaatggcaccatcttggctcactgcaacctccgcctcctgggttcaagcaattctcctgcctcatactctcgagtagctgggattataggcatgtgccaccatgcctggctaattttgtatttttagtagagacagggtttctccatgttggtcaggctgctcttgaacttctgacctcaggtgatccgcccgccttggcctcgcaaagtgctgggattacaggcgtgagccactgcaccaggccaccacgttttctttatccaagtgtccattgatggacacttaagtggattccatgtctttactattgtgaatagtgctgtgataaacatacaagtgcaggtatctttttgatataatgatttatcttcctttgagtagatacccagtaatgggactgctgggtcaaatggttctttggtttttagttctctgagaaatctccatactgttttccatagacgttgcatgaatttgcattcctaccaacagtgtataagcattcccctttctccacatccaagcctcacccaaatggtgagtgttaaatgatggcctggatggatcaatgaatgaaggagtgaatggtgaggtggaataggattttagcaggagaagctttcacattgataaacaaaacgaaaaacattcttccggcagggcatggtggctcacacctctaatcccagcactttgggggtccgaggcaggaagactccttgaggccaggaattcgagaccagcctgggcaacaaagtgagaccccatctccacaaaaaataaaaaaattagctgggtgtggtgccgtgtgcctgtggtcccagcacaggagtttgaggctgctgtgagccatgattgtgccactgcactccagcctgggcaacagagtgaggtcccatctcaaaaaaaggcaaaaagcaaaaaccagtgttcccttgagttctgttcccacgtccaagcccttctcaatcttcacaggagccttcagtgacttcatatgtcctgctggttctaactcctgctcaattcaatgcttcctaatgctagggatgccttctctctcagtaggtttcagggctgtctttcaccactggaaacctctatttgtagatatgggtgcagcctaggtccatcacctttagccccaaccacccttagtaagtggagctgaacatgtgcagggaagacccatctgtgggaattcaggagagccaggagaaaggcatggatccccatctttgcttctgtcacctgcctgactcttcttgccataagtgtttcaccaaaataaatcgggggcctggccaggccactggaaacactgaccttgaagacttttcaggaaatgatttgcatgcagtgcagaagacctctgaccccttcctgtcgctggcacctgatcggatcctagcagtgacctcacctggggatttgactgtgtgcttccccacatgccctagctctctctctctctcttcctttctcttagccttacatgttctctctggaggagataacgcgctttacattcataacagtgtgtcagtctgcagagagagaaatcatctaaggccatgacctcactgccacaagtgtcactgactgccaggcagagcatccatcgggcagggcgctgtccctcctcggccctccttccctccatttgcaggaggaagggtcactaccatccaggtcacaggcacaaaagagattttgttgtctgggctgctgcttttccagcccctctgacagactccagaaggagtcaaggaattgggaaggcgacagcgttagaacaagaaggtgaaaaaacagcaagcatgcatctttctcccagagcttctccaaagccaaactatagactctgaatgagccctgagccaagatgagaggtcaaggttcttgtcctgactgtgggccacagagttctatggttttaacagagaaggtgggatccatagcccacttccagtggctccctttaaccagtgctgccccctgcagaaccagcacaaggcgacacgttaatgtaaccccagcattgccattgaaggctttatgggaggccttgccctacttaccagagaaagcaaagcgggaggtgtagagaaatgggaagcctgaccatgtatgttcatgttccatgtcacgcagcatccctgtgtgtgtgtatgtgtgcacaggagtacttggtgtcataagttttgcttattattattagagacagagtctcgctctgtcacccaggcaggagttcaatggcacattctcggctcactgcaacctctgcctcccgggttcaagtgattctcatgcctcagcctcccaagtagctgggattacaggcacccaccaccaggcctggctaatttttgtatttttggtagagacagggttttgccatgttggccaggctggtcttgagctcctgacctcaagtgatccacctgccttggcctcccaaagtgctaggattataggtgtgagccaccatgcctggccaattttgctttttagaaatcactccagacctgacacttcttagctagacaaagaggcacacacacacagagaggcaggacgctcacttctacagtccctgtggagttttagaccaaacgcaatgcctctgaccttctttggatgacatcaactttaccggtcttcatctggggacctgggcatcaaatcccagcctgaagatcccaggattggccaggtatggtggtgtatacctgaggtctcagcactttgggaagttgaggcaggaggattgcttgagcgtaggagtttgaggcctgcagtgagctatgattgcaccactgcactctaccctaggtgacagagcaaggtcctgtctctaaaacaaataaaataagaacttaagattgctgttaggaaacaagaaggctttgaagtcacagacttggactggcattaaggttttctgaactgttgtgggatcaggacccagtagcttcacttcccagagtttcagcttcttttctgtaaagtggacatcatatctccaactttctggacaccatggagttaaataagatggtgtatgggacatgtaactcagttcttgacacataattattacttactgcttgttaattccttccacacgtccactgtgcatttcccttccccatgccaacctcttaacaacatcctcattacatccttatcctgcttcctttttgggtaggagatctcccagttgccattgtctgggaacacccaggcattcaccgggggagaggctgagctactccaaaatggagacagtgctgggtggactcctgcctctatcagaattcatccaggccaagagctcagggcttttttagccaaacaacagcaatctcctgctggcacgtaatcttcaagactttcacttcctctgtcagagtggagggaaaaatcaaacagaacaaaagcaaaatgaaaaccctggcctggacttccattctaatgtgcatgagtgaggtgggctctgatgatcaattacaccagcagaaccaatgaattacaccaagagaaccgagttgccggcccagctcaccgggggtgaactcagacactgcttttcctgcctgctttcggctgctccctctcggccactcttccaagctgcatcccaagctgtcctttctagctgcttgattgaagtgcctttcccgtgtgtccacagcaataccagcatcaaggattgtccactgccctcttaggattccttcctccaaacagaccctcgtgcttcgtccagagtgagaggtttcagaacaggaagcaggaggtctgtgcggaaatgtcacctggatcttctaaattagtgatttcagccttgcgagcacattagaatcagcggggcagtttaaaaagccagagatgcctggggcaccctcgggattccgacttgattggtcttgggtgggtcgaggaatctgtggattcttttttctttttctttatttagagaaagggtctcactctgtcactcaggctgaagtacagtggtacaattatagctcacagcaaccttgaactcttgggatcctgctaggaagctgggaatggcctagatctccaagcacacccctaggggactagagggtgaggcctgcaggccagggggtaggtgggagtgatcctcccacctcagcctccgaagtagctgggactagaggtgaatgccaccacacccggctaatttttaaattttttatagagacagggtcttgctatgttgcccagactggtcttgaactcctagcctcaagcaatcctcccacctcagcctcctaaagtgggaatcggttgattctaatgagtgcaactaggaatgagcatctggaaagaatcactgtgttgtggggaaatgcatatttgcgatgtaattagaatgctgatgcctttccgtgtacagtctgccttcacacatatgtctccctggattcagaacagtatttatcgagcacccactcgtgctgggtagggtgatgggtgccatggatctgccataggaagccatggtccctgactgtattagactgttctcacattgccaataaagacatacctgagactgggtaatttataaagaaaaagaggtttaatggactcacagttccatatggctggggaggcctcacaatcatggtggaagagcaagagaagtcttacatggtggcaggcaagagagagcttgtgcaggggaactcccatttataaaaccatcagatctcatgagatttacttactaccatgagaacagtatgggggaaaccgtccccaggatgcaattatctccacctgtccctgtccttgacacatgggaattattacaattcaaggtgagatttgggtgggaacacagccaaaccatatcaccaaccttcaggagctcacagagtggccacataactcctgacattcatggggcatctgccctgtgcccggtggttaagggcccagatttgggagctccttactgactgtgtggcttcaggcaggttaaatgaacctgtcaatacaatatcagtacctgcttcattggagcgttgtgaggatcaaaagccttctaacagagaaagcccttagaacaatgcctagcatctcgtaagtctttacaagagcccactaatctatacagaattgcagttaatcatctcaacaacactatgaggcagatgttattgttatgatcattcccatattaaaggtcacccggctatgacatagtggagctgggcctcaaagccaggtagtctgacccagaggcagggtctgggcgcttaaaagttaagtccaaagtgggtgcagaaggagacatgtcctcctccttgggaatgtgtaagctgatttgaaaaacaccaagcaggccaggcgcagtggctcacgcctgtaatcccaggactttgggaggccacgggggaggtgggtggatcacctgagatcaggagtacaaaaccagcctggccaacatggcgaaaccctgtctctactaaaaatataaaaattagctgggcacggtggtgggtgactgtaattccagctacttgggaggctgaggcaggagaatcgcttgaacttgggaggtggaggttgcagtgggctgagattgtacccttgcactccagcctgggcaacagagtaagactccatctcagaaaacaacaacaacaacaaaacaaaacaaaaaccaccaccaacaacaaaacaaaacaaaaccaaaccaaaaaaacaagcagccaggcagcctaaccagttctcctaagaaaccggtctctggacacaaattagtcccgtcttccctaaaataaaacccggcctgcagacatgagcacagtcctttgtgctcttctccaggagggagaaaaatggtgagatatcaagccccttcccccggaggcttcttggagttcctctaagtattaatctctgaatagtcaaaggataccagaatttgaaagcctgacgttagaaagaaaacttttgaagaactgacttcatccctcggggcagagggaagacgaaattgatgcgtctgaaatttctggtccagagagtcatcttcagcattacaaagcacgtcaggagaacaaggcacggggctccacagggggtgaacagggaactgagaccagcctgtgttgccatgggacacatttccaggaaggctattaacagtgggtgatttaaatgagcgagagacagaggcacatggctttttaagctgacagggttaacatttcccctcttgactacacaagacctcattcttacctccgaaattcttctctgcccagtttttccctttgtcccactttagcaaatggacttccagacaatcagataattccccgtgatagcagcgtgcacggaaaacatgtcatgatgatatcatctatctaagacccaagagtgaggctgccagggggtggccggagatggaggtcattaggatgcatagaaagaaatatgctttcttatccttttcaaaatgcattcattcagcacagcggcaagtgtaatggttaagaggagggctttgatggccgccgaacttggctttgagcccagttacttcactcgtggagctgtgtgaacctcagcaacctacttaactctttgtgcctcagtttcctcaacagtagcatggagataacaacagtttatcctacggttgtcctcaagaattagtgaaaacttacaagggtaatggttgtatgcctggcatgtaaacagtcatcattttatatgtggttatatacctttacatatagttctatagtccttatatattattactggaatctacaacccccagggccacggaccagtacaggaaccgggctccacagcaggcggtgagtcgcaggagagtgagtgaagcttcatctgtatttatagcagctccccatcgcgcattattgcctgagttccacctcccttcagatcagtggtggcattagatactcataggagtatgaaccctattgtgaactgtgcatgcgagctatctgggttgtgtgctccatcaggtgtctaatgcctgatgatgtgtcactgtctcccatcacccccagatgggacagtctagttgcaagaaaataagttcagggctcccactgataggacattatggtaagttgtagaattatttcattagatactacaatataataatagaaataaagtgcacaagaaatgtaatgtgcttgaatcatccccaaaccatccccctccccctttcaccagtctggaaaaattgtcttccttcaaacaggtccctggtgccaaaaaggttggggaccattgtattattatttttattcattaattcactaagtatttagagagtgtctactatgagcctggcactaaacacttcagcagagaattcaagattttgtttttgagatggagtcttactctgttgcccaggctggagtgcagtggcacgatctcagctcactgcagcctctgcctcccgggttcaagggattctcctgcttcagcctcctgagtagctgggactacacgtgtgagctaccacacctggctaatttctgtatttgtagtagagacggggttttgccatgttggccaggctggtcttgaactcctgacctcaggtgatccacctgctttggcctcccaaagtgctgggattacaggtgtgagccaaagcaccgggccaggattttggttattctttaagggatggacatcagtctgtcttggaagaaactctcatagcactcatctgacattttggtcacaccacagcccaaagcatttttatgtcatttccttgatcttggtagttttcctgggaaggaaaaagaggtggtacagaaattgacaattctttggggggcgcggggaggaaacagagaaacagaaatgcgaagtggcttgtttggagccacccgttacccctagtagagctggaataggtctcacatggtcttgacagagccagttatagcacttcccagagtgttaattacatcgggtccttgttcctccacaactgaagaagtcacataccccaaaatgagtttgtggcccaggagggagggtttttcatggcaaggagggcctggaaagactgactaaccaggggtcttcactccagggttcctcagtggttcttttttttttttttttttttgagacggagtctcgctctgtcgccaaggctggagtgcagtggcacgatctgggctcactgcaagctctgcctcctgggttcacgccattctcctgcctcagcctccccagtagctgggactacaggcacccgccaccacgcccggctaattttttgtatttttagtagagacggggtttcaccgtgttagccaggacggtctcgagctcctgacctcatgatctgcctgcctcagcctctcaaagtgctgggattacaggcatgagccaccgcacccggccggttcctcagtggttcttaagcaaatgtgcccacatctcacatgggaacacatggtgaggatggtgaggcatttcccaaacttacttgacgcagacccctctccagcacatttttggaaatactggctccagaaatgctttcctcaagggggttgctctttgagacaaccacccaaaattacaaataccagtttaaactgccctaactgctgcctttctccctcccttaatatggtcagtgagctgcaaagaaacttctcccaaagcctactgggccgagcccagcaaggttcaggggccctgacacttggattctggagtcctgattgggcctcgagtgctggcctctcccatgacaagccctgagaagccaagaattccagccaagattcctgaccttgtttaatgaaactgtttagagctttccacagatcagaaagctggcagtggggagactacagcagttacaaaagatcacggggtcacatttgcagccactgtactttttctaacagttggccagatgaggcagcttctaatttcttatccactcaggcaatgtcattactcaaggtccatctcatctctttgtgggcaccagtatgttcacaggtacactgactgacagtgcaaccttgcattcaacaagaagatgtgaatattgtaccatcatgcactacgcccagctttcctccatccaatcccaatcccactcctcttctgcaagttgtacccttaacacacacatctctggttgcacagaactgttgggttcgatattttctatcttcccttcatttcctcactctcttcttcctgcttcctgttctgatgacatgacagcaatcaggaatctggtggctactatggtgacctgcccaatgaagacctcttaaggggatggaggaagaaagcaggcttagctcttctagaaccttcctttccatgaaaaacagggcacaccttttcttctctaatcatctccctatttaacacatcacaggaaagattgctgaattacaacgtgctatctctttatttagttatttagaggtaggatcttgctctgttgcccaggcctgagtgcagtggcgtgatcatagctcactgaagcctctacctcctgggctcaagccatcctgcctcaggcttcccagtagctgggactacagacgtgcaccaccatgcagagctaatttttttttttttttttttttttagaaatggggatctccctgtgttgcccaggctgttcacaaactcatgggcctaaatgatcctcctgccttgccctcccaatgtgttgggattacaggcatgaactaccacgcccagccacaatgtgccatttatgatctccttttgtaaacttgtctcttgctgctctgcttctcagtttgttgcattgcttcctctctgttctgttttcttccccctccctcccttttttttttgagattgagtctcgctctgttgcccaggctggagtgtagtggcacgatcttgccccactgcaacctctgcctcatgggttcaagcaattctggtgcctcagcctcccaagtagctgggattacaggcatgtgccaccacgcccagctaattgttgtatttttagtagagacggggtttcaccatgttggccaggctagcctcaaacttctaacctcaagtgatacgcctgcctcagcctcccaaagtgctgagattacaggcgtgagccaccgcgcctgcctatgttctgtttgctacataccttacaatatggaccttagactgtaagttcctgggagatggggacattgcccgttttctttattatacagtctaaaatactgaccttaaccaggacattgaataaaaaccatccaatgatgattaagataaatgcaatgattaatatgactttagggcttggctggaagaataatttccttttttttttttttttttttttagagatagggtcttgctctgtcactcaggctggagtacagtggtggatcttggcttactacagccttgaactcttgggctcaagtgatcctcccacctcagtcttcttagtagctggtactacaggtgcatgccaccacacctagctaattaaaatttttgtttgtttgttttttagagatggggtcttgctgtcctgcccaggctgctcttgaactcttggccttcagcaatcctcccaccttggcctctcaaagttctagaattacaggtgtgagccaccacatccagccaggaccaccatttctaaaggcattttgggaaaatcaccatttatttaattatccacctgaacaggagactaaagaaattatagtttttgagaaaatgctttctgagtgatcctcctctgtggtcatctctgccaacaggattcctgccataaaacgtgcaccagagtaatgcagagggcatctgtagatgtagttgtaaagtcctaaggttttcactgagaccccagttaagttggctttgggtaccattggcgtcctcctgttttctttctcctttcagcttgtacaacactgagagcttaagacacatggacttttccagattgccacatggtcatgtgaaagacacaccggctccaggctcagcaagccaggcccacatcatagctcacggcatacaggctcctggttcaggaaaggaagggggccttgagccaccagccatgtcccgcagtgcttgagattgggaggagtggactcctaacaccagagtgatgactcaggtctgagccggcgtgtgctgccccagctggaggcccgactttccctggagaaacactgagcctgctgtcttcagagccagagcagagcagaccattcctgtgaagcatggacttcccaggtgcagaaagcagaggcccatcccaggcagcacagtgtgtccctataaaaatgacggagtgaggcccatggctgtctcaggatgctctgtggtgggtggctttgcacacattgctgccttaatacctcacaattgcttaaagaggtcatttgctcgaggtcactgttagggactgaactatgtgccttcctaaaattcattcccaaagtccttactcccagcatacctcagaatgtgctgtatttggagataggatctttaggaggtaattcaggttacatgaggtcatatgggtgggactgagtccttataggactgggtccttctgggaaggggaagagaaccagggatactccagtatacaggaaaggtcaagtgaggacacagggagaaggcggatgtccacaagccaaggagagaggcctcaggagacaccaaacctgccgagactctgatcctggacttctagcctcaagaactgtgagaaataaatgttggtgtttaagccacccagtctatgggattttgttctggcagtaggagctgcctaatatggtgacagttaaaaagtggtctaaggaccatgtgggttggctcatgtctgtaatcccagcactttgggaggccaaggtgggtggatcacttgaggtcaggagttcaaaaccagtctggccaacatggtgaaaccccgtctctactaaaaatatgaaaattagctggtgtggtggcacatgcctgtaatcccagctattagggacgctgaggcatgagaatcgcttgaacccagggggtggaggttgcagtgagctgagattgcaccactgcactccagtgtgggcaaaaagagtgagactctgtctcaaaaaaaaaaaaaaaaaaaaaaaaaaaaagtggtctaggcccaggtgcaatggctcatgcctataatcccagcactttgggaggccaaggtgggaggatcacttgagccaggagttcgacaccagcctgagcaacacagtgagacctcatctctacagaaaataaaagaattagacaggcatggtggtgcatgtctgccgtccaagctactagggaggctgaggtgggaggatggcttgagcccaggaggttgaacctgcagtgagccgtgatcatgccattgcactccagcctgggtgacagagtgagacccccatctaaataagtaagtagatgaaattaaaaagtggtctaatgttacagttcatgcttgggagtagtagagacttcatacattaacttttgtcttgtttcaacaatctcaggccaaggtttaagattctggatgcctgcaccattagctactattttaaaataaagaatttgactggcttttgtccctgattttggggagacagacaggaaacccttggaatttcctgagtaataggattatctttgttattcacgaaccctttggatcacccctgagtttacgctaacgagaatgacttggaatggggactgatcagcagaaagaccaaacatgtgatttgagccatgtgtgaccagcttgacctcctaacctctagggaggagaaggagactgaagattgggtccaatcacatggccaaggattcagtcaatcatgcctacataatgaaaccccaataaaaactcaggatgctgagactcagtggagccttcccgttggtgaaaagaatcaatgtgccaggagagtgttgcactgtaactccaggaggagacagcacagatattctgcatgtgggaccctcccaggccttatccaatatgtctcctcatttggtgggccctggctagcctcctatataatataaccttcatcatgagtatggcactttccggagttctggcaagtcattctaacaaattattgagctggaggaggtcacaggaaccctcatatttgcagccagttgatcaaagtaaaggtagtatggggacccccaaccttgcagctggcatccaaactgagagctatcttgttggggactctgctcttaaacctgtgaaatctgcattaattccaggtggttagtgccagaattgcaccgcgatattacaactatccttcctcttgcccacccactcagcacgtaacactgcaataccttgttcctctcacaacagggctttgtcagtcacagagaggctattaagcagctggaattatttctgaatgattccaaacacttgaaggcagaggggtttggggtcaacaaacccccaaggttggttgaactttaggaatccaaacaattatcccaagaataatttggtgattctgtgacccatttctatgctctccttcctgtcttctgagtgtcgtctagtccatacacgtgggtttgcttaaaatagttcagctgtcccttttgtctcaaataaatgaggaaacagatcatgaacttttgtctctgctagccattcattcgtgcatgagcccagtcaataacactgagccagccttctgatggtcccagcccccactgattggacacccatcttccagagatcaggtggttggtttccttatctctaaatctcaccaaaatcctgcaaggtacttataattcccattttagtaacgagaaagttgaggttcataaaggtaaaaacatttcccaaggccacagaccatctacatgagatgagacagaattcaaaccggatctgactttgcacaaagtgcgagcttttcccgcattggtggctcttaagtgctggtatattttctgttggtcagcggcaaaatgagaaaaataggataaatgttatgtaaactttcaataaagctaaatgtgtcttatttaaaagactgtccttattcaaggctgcagtgagctatgatcacgccactgcactctagcctgggtgacaaagcaaaaccctgcctctaaaaaaaataaataaaaataaaagacagtgctttattctgatttcatatccttttttggtgtggtgtttcttattatgtaaatgaaggctaaagtagatgataatatttttcatatactgacttggcaaatacaaaaaaatgactgcagccccacctgcctttcatctgtaaattttctggtctctgaaatcaaaaagtctgggaactgctgcatcacgctgcctctacctgtgagcctctgagggaagctccagaaaggtgtacaatctgcactcttccctgtgttcaactgctacagccttaatccaacatgcagtaccaagtatgcaggctccagacagcctatgctgcatcggattctggcttcatcgctgggacccactcccagcctctgactcagtatattgggggtgccgaccgggaacttgcatttccacatctcaagtgacactgaggctgtttgtctaggaccacactttgagaaccgctgatttcaatcagtcaccttgattctgctccctgtgtgagtgtgagtgactgcttcagacatgggaataatatggaccagctgtggtctggggtggagtccggaatcgaggagtggggagggacatctggggaataatttcctctatgataaaaagagtcacgatgggaagaaagtctcttttctgcttttgttttggagatatagtctcgctctgtcacccaggctggagttcagtggcacgatcttggctcactgcaacctccgcctgcccggttcaagcagctctcctgcctcagcctcctgagtggctggaattagaggcggccaccaccatgcctggctaagttttgtatttttagtagagatgggatttcaccatgttggccaggctggtctcgaactcctgacctcaggtgatctacctgtctcagcctcccaaagtgctgggaattacaggcgtgagccactgcacccagcccctttcctgcttttgaacattattgtgcaaggaggtggtgcctgggctgctggggcatcccagcagcagtgtaaccactccctgcagagaggacacaagtcaaggagcctctagaacttacctcgaattaactgcatttaattccaccaattaaagagaaactgtgtggaaagattataatttttttcttgctcatgaatgtaatttggtgagaatactgtagttgtactaagggctaagagtttagaaatctttctaagatttatgcattgtatgtaggagagtgtgtgtgtgttatatgaatgcgtatgtgagtgtgtattcaagtgtgtgcatgtttgtgtatgtgtgtacatgagtatatgtatgtgagtgtgtgtgtgtgaatatgtgtgtgcggttgacagacccaccaaacttaacattgaaggctttagacatcacatagtcattggtttatatgttaaaccaatgtttaatgttaatctcccaaaggtgagtgaaaatcggtgatttacccacacttctctaactctgttactcatctgtggttaaatgaaatggagtactgaggtcattatccttttggaggattattacagttctaaaacacctttgtatcaatatggtctactgatattttttgttatttataaaagattgacactattttaagaagaagggccaaagtaaaggaatgccgataaagaattttgataataccaacatccggcccactttattgtagtaacatatcttaagatctatcgacaatttaaaatttaagaatcactgtacttactgatctattgctaccctaaaaggactgcatgtgatattttaaaatcctcttccctaaaagaaagaaattcttgatcagtttgaagtggcactttggcatttcctggagaatgtgtttctccagggaatggtcaaagatcactgggattctagcaggccctgctagtcgcatgctcttctgagtctcgcacagttgacgagaatatgctggaatgcctctaaacatgtgtcccaccgtgcgctacaaaatcacacactgcagtctctaggaaggatacagcccctattgggaagcaacagttagtacatgaacttgtggcaatttcgtgtatgagtaatgggctggaaagaccagtcactgtctggttgataagggatacagtgtgccttcagtacagaccttcccacagatcaaaaccaatatgatccattcggatatagttgtgcttcagtatcattttaatataaagccttaaggatggggtcatttacatgatactgggacgcaaccattgaaatcatgttttctattttatccccaagaatgatgactgatttgacatcactggagcacaaaacctagtccacttatttagatggtaatctgaactcagtatgaacacatgtgcatatatattctgcctgtcatcctatgaccttgacacatgagttatatatggcgttggagggatgagcagtaatcaccagtgttcatgaaaagatcaggggatgatgtgttggagatctggaaggttgggcagttaagacattttttgatggactgtcaacccatcacttttcaagtgaactgatactgaactctacgactactccatgaagccttgcatgaaatcgtatagaagaccagattattagggataatagcaccataaattatgtagcacttaatagtctcttaaatgctttcctcaaaagccaaggtagttaacattcccattttacacacgaggtagcaaaggccagtgacttgcctgggttaccatagctactaagcagtctggccgaggcctctgatcccagcctaagagatgcccatgttgtgccagacagtcttgggggcgcttcagatgttctagtgaatttaaccctaatcacaagtctatgaggcaggtactagtttcaatttacagagaaaattagagcagcaagacaggaggcagccagtgttctccgtttacagatgaagaaactgaaggttaaggaggttgtgcaaatggccaaggtcacgaagctgtcaagcatcagagtcaggttttgaagccaacccaaccggccccagagcctgtgctctcagcgtgctggaacctgctggtcctctgcattcaggtggcctggttttgaatcagttctcccatttgctgtacaactctgaataagttactttacttctctgtgccccaatttcctcatctgaaaaaatgggaataataacagttacctacctcatagagttgtggggctgaaaagatgactcagcacatattaaacgcttagaacagagtctggtacaaaaataagcgttcaattagctaatatgatgattaatcactaagctatataatttcccaaagcatttgaaatatggtgtataaaattcaggttcaatctattaggttggtgccaaagtaattgtggtttttgccattacttttaatgcaattactttcgcaccaactaatacattgaacttttcaggaatgtgtttgcttattagcataaaggatgcttacattttctatcatctggtttctacctaaagcagagatttgcaaacccacaggagtctgctgagatccccgcagagcctccctgtcagtgggcttgggggtgaaggtgatggggttcagaccttctccatgtgctgatattggacaaagaattttgcagcaaaaagaagtttgagaatcgttggtctacaagactctatagtagggtcacatggtggcttctgtccattactatggatgcaactccctgcaattgtaaagttcaaggccccagctccgctgggcagagtgtggtgactgtaatggcatagggcctgcccagagagtaggtggtttgggcacaactgtactcctcacctctctgatacactgtctctcgtaaacagctcacagtcatatcatggaggaactcgagagtcaaagagagcaatccaatagtatgggctgttgatggctcctgagcaggggtaagtcatgaaggagcctggaaggatggatactctggttgtgtcatataggacaaacggggatggccaggaacatggaactaggcagggtggcaaggagctgctctggtgacaatgggcacacagaggatgctgagtccagggtggcaaatgtctacactggggcatgtattggagaggagaaggaaagttgttcccttaccagtgaaaaaacaggcaagacttaaggatgtcattgatgggcacagaaaaaaatttcctggcttctaaagcctggccaatttggagaactgtgggcttgctttcaaagcaggtgcaagaacaagatgacccgggttggaggaggagtaggaatgatgggcttcggttgccatgaggtgctggggctgccaccgaggtgttcagtcacaaagacctagtgggcggccccaggggtgggacaggggctctggcaaaatatggaaatcttccacatggctttgacagctgaactctcagctctgtgctgggcaagccaggaagccacaaacagagattcaagggcgatagggaaggcccgctggggtagaagactcagagaaaaatacagagcagctgagatttccccagaccgttcgcttcctccctccaccaccagggatacctggccaggctgcactcctctctcaggggaggggctcgctcgctccctccctccttccctccctcccttcctcccttcctcccttccttccttccactggatgggacaagttgcagcagaggctgccagatgagtaaatctgcctcctcatgtcctcctggatccccttacaagaaaggacagggtccagcgggtgggatgtgtggacaagggaagccattccaggcacagcagagctgaggaagaacactcagcccattttaggaaacggaagaaccagccactcctggactcgtaaaaagttctgcaaccaaaataatcattgaccacctctagacaggaactcctaacccaaataaacggatgcttagatctgcatagcacagcggtagacaaataataaatatttaccaaacaagcaagaacttgaattaagcaatgtgcccaaaatcaaactgtgagttatggattaataaaaacgatgacagccacagatttgttaccccttgggtccctgtgaccccatccttatgctctacatagaggtgtgtgcacacgtgtgtgcctttcccctgtaaatacagtcgtttgcattttgcagaactgcattgtgagttgagtttgttttaatctccccaatcccttcttatcccccattagcagaaagacagaaactaggagcatgtagtttaatgtcctatcctgaggctcccatctgcacagagtctcctatggggcaccatagagaggacatggaaaggattttgtgaagatatcacggaaaaaataactcagtagtaaaagaaacaaccacctgcaatgttctggagggctaagtcttctctccctttttttctctctccctttacgtttgagccacatgaaattgtccccttagcaggacaaagtctgccaaatattggcaatttcaaatggtttcaatgaatacattttacaacaggttaaaattggcatcaaagggacaaggagcacagacatggaggtggtccaggaagaagggggaggggggcaggggcgcaaagaaggggtgttgccaggcaactggcagcgtggacccattaggctggggagatggggatggtctcttctcctctcctcaaccagcacctgggtgtgagtgtgtgtgtgtacgtgtgtgtgtgtgtgtgtgtgtgtgtgtgtaaacgcggcagggggttccctagatgatcgcatcaatctgctgtatcctgatgctcagccctctctcacagcctcttggggagactggaattcccctttgttctaaccagggcagaaagaaagcttaccgacttttctacaaaggccttggctgaagaaggaagatggatcgtgtctcctccctccttaccaagggggaaacgacttagctgcttgtgctccccaagagtatgttttatggactatttcttattcctctccatcactcaatgcgttttttattacaaatagatttaccattgcgttatctgtctgtgctctatatcttaccatgtctttcttcaccatgtgcttttcaaatgttaaatattatcagccacccctgggggctgggaagacatctgttttgctcatttggtggagtgcccagctttgcagagaggagcctaataaatgatgatgggatcgcagtgaggtgtgaggtcagcccaaagtggggctgcctgaacccctttggctcttgtttcaggaggtggcctggtggcctgggaggtcccggacagaaggttcataacactgagtccctctgtctgctcccagcttctgcacacgccttcccagcccttggctgtgacagaaactcctggtggattcagaccagacaggagcagatggcagacctggagcacgcctcggtagatggcccagcaggcagaccacaatgagcccacctgcccacactactcagttgggaagacacggaatcaactccatattctctgcttggcaacatgcactttgggggggattcctgctttacttggtagaaaacaatctcctgcattttttttttttttttgatacggagttcgctcttgttgcccaggctagagtgcaatggtgcgatcttggctcactgcaacctccatctcccacgttcaagggattctcctgcctcagcctcccgagtagctgggatacaggcatgcaccaccatgcccggctaattttgtatttttagtagagacgggctttcaccatgttggtcaggctggtctcaaagtcccgacctcaggtgacccacccgcctcggcctcccaaagtgttgggattacaggtgtgagccacagcacctggccatctcttgcatttttgcagaatatcattaaccacagaagttgctaaggctgggctatgagggtgaatataaacatgggtgtgcacctgtgcatagagaatccaagtttaggccgggcgcagtggctcatacctgtaatcccagcatttgggaggccgaggtgggtggatcacctgagatcaggagttcgagaccagcctggccaacatggtgaaatcccgcctctactaaaaataaaaaaataagctgtgggtggtggcaggtgcctgtaatcccagctacttgggaggctgaggcaggagaagcacttgaacccaggaggctgaggcaggagaattgcttgaacccaggaggtggaggttgcaataagccagtaagccgagattacaccactgcaccccagcctgggtgacagagtgaggctccatctcaaaaaaaaagagaaccaagtttattcacctattttaggtaagattattacagttctagatttttaaaaagtcatacatttttttttctagcccataatagcccagactatttacttgccctcagtgctattttactgacagcccatattaatgtactcgacctttaagatgggatatcaccagcatcgctgtcagacagaggaaagtgacaggaaggcgaccattatttcatccactgctgtggaagtgtcttccacacctgctagcccgagacttacgcaggacgcacaagtccttcatgaggatgtgtcacatgtttcaggctttcccagataggttaggaagtgagttcacaggaatgaaatgacctgggtaagcccatcttccattgcagacctgagataaggttcgaagtctttggttgccatcgtttatggctctggtgtcaggggctggcagaggagcatattccaggtgaactattaatagatcatatcttgtgaatcttgggtttttattatatatactggttatggtgcagtgaaaagagaatgggctatactatcagaggacctatgctcgagctacctatacttcactagctacgtgaccttgagcaagttatttaatctttctgaatttctgtttgcttggcacctactttacacagttactgtgaggattaaataagatatgctccatataaattctataaagaattgtaggccaggtgtagtggctcatgcctgtaatcccagcactttgggaggccaaggcgggtggatcacctgagatcaggagtttcagagaagcctggccaacacagtgaaatcccgtctttacaaacacacaaaaattagccgggcatgatggcgggtgcctgtaatcccagcaactctggaggctgaggtgggaaaatcacttgaacccgggaggcagaggttgccgtgagcagagatcacgtcactgcactccagcctgggcgacagagtgagacttcgtctcaaaacaaaacaaaaaaagaaaaagaaaaagaaaaagaattgtaaaatgtagtcattattgtgccaaacatccagtattatatctgggtaaccccaaacaattcgattgccttcataatattttctctagcttaaattgttttctatcttctatagcaggaatccccaacccctgggccatggactggtaccagtctatggcctgttaggaatggggctgcacagcaggagatgagcagcgagagaagcttcacctatacttatagcctctccccattgcttgcattactgcctgagccccacctcctgtcagatcagcagcagcattagattctcgcaggagtccaaaccctacggtgaactatacacgtgagggatctagtttgcacactccttataagaatctaggccaggcgtggtggctcacacctgtaatcccagcattttgggaggccgaggcgggtggatcatgaggtcaggagattgagactgtcctggccaacatggtgaaaccctgtctctactaaaaatacaaaaattagttgggtgtggtggcgcctgcctgtaatcccagccactcaggaggctgaggcaggagaatcgcttgaactcaggaggcgaaggttacagtgagctgagattgcaccacttcactccagcctggtgacaaagcaagactctgtctcaaaaattaaaaaaaaaaaaaagattctaatgcctgatgcccatcactcacatgtgggaccatctagttgcaggaaaacaagctcagggctcccactgatttgacattatggtgagctgtagaattatttcattatatgttacaatgtagtaatcatggaaataaagtgcacaataaatgtaatatgcttgaatcatcctgaaaccatacctcccacaccccatctgtggaaaaattgtctttcatgaaaccagtccctggtgccaaaaggtttgggcctactgctctagaaatagccatccaaaagaaatacaacgtgagccacaaaagttagcccaatataagattttaatttttttttttttgagatggagtcttgctctgttgctgggctggagtgcagtggcgtgacctcgactcactgcaacttccacctcccaggttcaagtgattcccttgcctcagcctcccgagtagctgggactacaggcgcacgccaccatgcctggtagagacagggtttcagcatgttggccaggatggtcttgatctcctgacctcatgatctgcccacctcagcctcccaaagtgctgggattacaggcatgagccaccacacctggaccaagattttaatttttttagccatatttaaaaagtttaaaggtgaaatttattgtatatttattttatcttaatatatccaaaatattatcattttaacacggactcaccaaggcaaaaattatttacaagacattttacttaagtttcataggaagtcttcacaagctggtgtgtgatttatacttgctcacagctggcgtgtgatttatgcttgcacacagctggcgtgtgatttatacttgcatacatctccatttgcactggccacattttgctcaatggccacatgtggctggtggctactgtaccacgaggtgcagcttagatctttccaaatgcttctgtcttggttatgaggagattatgtctcctcataatctcaggattatgagccctgggtaagacatggcaataatctaactgttatctttaattcccttagaaaacacagactagtcacagtttgctccacttcttggaatcatagggacgctttgttcctctatttgcacacagtggacagttgtaaatgtcttgccaatggccactaagggactgggtcagaggggagagatgtggaaatcctagggcagcttggaacttggaaaggagactcacatcatgcggcagctccctggagaaagcaaggtgcgaggttcactgtggcagaattgaggggatggagagcactcctatgtgtaaagctcttatcatcaaagggaagaagggccgggcgtgttggcagtggctcacgcctgccatcttaacactttgagaaggaaaggaccaaggcaggagaatcacttgggatctggagttggagaccagcctgggcagcagagggagaccctgtctctctaaaaatttaaaaaattagcaatgcacatctgttagccccagctactggagaggctgagatgggaggatcacttgagcccagaaggttgaggttgcagtgagctgtaatcgcaccactgcaccacagctggttgatagagcgagaccctgcctgaaaaaaaagtgggggccaggtgtggtggttcacacctgtaatcccagcactttgtgggaggctgttgtgggtgggtcacctgaggtcaggaattccagaccagcctcgtcaacacggcgcaaccctgtctctactaaaaatacaaaagtagctgggcatggtgatgcaggcctgtagtcccagctactcgggaggctgagacaggagatcgtttgaacccaggaagtggaggttgcagtgagccaagattgcaccactgcactctagcctgggcgatagagcaagactctctcaaaaaaaaaaaaaaaaaaaaaaaacccaaaaagtggggatggggaagaaattcggccaaccattcatctaaagtgatggggagaagcactgaaacgaagcctgtctagcagtagaaggtcaggtcggtttttctggcactgggcaggctccctgtgagacaggatatctacagtctcacaagcctcaagagaaccaaataaggaagggccacacctcagccattccattctagtgaaaatccactctatttttatgaaggtcaagagaaagagtccagaatctttcctactaacggcttcctgtaccccatctagcaactctcactgtccggaaattcttacttaaatcattctcactatggctaaagcacacttccctttctctgctctcaacatactcccccaaatatacattcgggtcagagaataaatgaagaaaataattttcaaggagcaaggatatgacaacgagacttagggagttcggctgaccataaaacatgctccgccccccatatctggctatagcgtcctccagaaggttccaagactgcgatgagggtggctcctctcattttgatgaaggctttttttctttttttcaggtgggggacaaagtcttgctctgtcgcccaggctggagtgcagtggtgtgatcttggctcactgcaacctccgcctcccaggttcaagtgattctcctgtctcatcttcccaagtagctgggattacaggcgtgcacaaccacaccgagctatttttttttttttttttgtatttttagtagaggcagggtttcaccatgttggccaggctggtctcgaactcctgacctcaagtgatccactctccttggcctcccaaagtgctgggattacaggtgtaagccactgcatccggcctgataaaggctttttttaaagtacatttccaactggtggaaacaattttggaagacagagcagaagatgctgtctgtgggctgaactgcagggcaatctgtctatgcaacctgcatgtgtccacaaccaaggctgcaggcatgctctggggctgaatgctcacgtcaccttccagctgctcttaagtggaatttcaggacttaaggagctacctggtaaagacgtgggtgtcaggaaattgcctgtggatttagggatgagcgtctcaaatattaattcctagtatgtcactcttgactgtttgccctcccctactgtgagtaacgtatgatctactcagagcaatagaggatttggaagcacagatttcacttggtaatctcaaagtgctatatggaataagcatgaaacattaggatgacaggcattttttctctgcaacccaaagaagggaaatgttatgctcggagtggccgagtttacagtgctgcatgaaattatctgtgtggttgtctgcttactgcatcctcctggcaagaggcaaatggggagtcggtttggatgccgtcagctttctcgcccaacactgatgccatagaagctcctctgtgtctgaagatctgaggtatagcctttgatgagtatgctatcctcatagtgggtaaaaactaacctccccaatctgccccatcttattaatatctttcagtcagccaccctcatgcacacccatttacttctctgggggagagaaacacttgctctaaacctgactctccatgttacaaaccttgtcaggtcaatgtaggtgtctttcccacccatccccatttctacagctccaggtcaaaagatcaggaaaggcattgctttgtctaaggcttattacaaatgttctgaaattattcttaacaatatcagtctcagtgtttaatatattttgatgactaaagtataaatgaacctgaaggctaccactctctgaatgtaaaatatgaaatagtttaggtcaaatgttttattaaaaacctagaggtgggtccagatgagctagagaatccagattccctttagaaaggatactgcccaacagatagaatcctgggcaacagaattttgcagaggagaaaaaaaagagtgatagatttaagctgcctttcattcagtagttttaattttgtttctccaagttttgctaaagcccattctgcaattaatttagaacctttccatatatataaatataaatatatatatgtatttagcttaccacacacaaatactatctatctatctatctatctatctatctatctatctatctatctatgtatacatagatacacgcactatcaatgcctagataaatagtgcgtgtatctatctatgtataggtagtgtgtatatctctcagtgtgtagatagattgtgtgtgtatctatgtataggtagatagtgtgtgtatctatagatggattttgtgcaagtgtgtgtgtgtgtgtgtgtgtgtgtgtgtgtgtgtgtgtgtgttaagctaaatcctctgtgaagcaactggtactctggcaagaagtctttgggggaagtcatgtcaagacatcttaggtttgtccattctttcattcaacaagtctttatttagtgacattatgtgcctgaccctgggctaggtactggggatacaccatgatggagacacagatctagccctcaaactgttgggggctccaggaagtgataacaagtacacaaccaatcacagcgaggtgtggccatgtcataagaaagaaacgcagtacagactaggcggagggggtcagggaaagccttggtggagggtgtcttccaatttgtgatgtaaagacctaagagagaccagccaggtccagggcgcgggggtgtgggaaggagcgtgttctaggaagagagaataacacaggaagcctgttctataaagcagtggaaagaacatgaacttctctcgttcgcctaattcaacattttcttgattttatagggttgaggacaactgttcccaaactgcacacatcagtaattaaatctatttttttctgaaagcaggctggccaagagatagtttctaaactgccatttgaggtctcatttcctattccagaaggtggcttctttctaaacctccaagctttgattcaggaaaagcatgtaaaatacaccagaccactcgcctataaactcttcgcactgagtcttggcaatttgaagcttcaaatgtttctcagttaacgattctgctaattaacgagatctcactcaatttgatggtttccctttattgcctcattcttccaaattcaaaccacaaatttgacttttaatgactttaggccatagagtctagcctaaaacagccgtaatctaaaatgcaggagaaccctatatatagggatatgttaatcacagcatttacttgtaatagtggtaaaatttttttttttaaatcccttaaatatactcaaatggggaaatgattagataataatggtatatcaatttctagaatttatgcagctgttcaggagaatgacaatttacagtattaccataacttagaaaatgttagcgaaagacaatggtaagtggaaaaggaaaaataagatatgtagaattatacatgtactatgattacagccatgcaagaaatataaatatgaaaaatgctggaaagaaatccaccaaaaagggaacaacacttgaattagtgtcatgtgcttatgagcctttttcctattttctgtttcctatattgcatttataaagcctttatcatttgaatcctattaaaagtattcactcaaagtcagcagtttgaacattttcaattccaagcagcatgtacaaggcaacgcaagacgaaagtgtctgcatgcgagtttccccttcgaagtagcatcacttcccccatgagcagatggcatcctctcaactcactgatgaactgcagcttcctcacaacaaaatgtgatagagaatgagacacaatgctctaggacttggagatagacatctaagaataaacagcaagcaaatgtaataaaaattggcattgaacaacagatctggaatggtaaacttttaaagtcagagttggagacaccattctttagagctttgggtcaaacaatggtctgtttaagaacaagttgaaaaaggtgagggtctatgattccaattacttctccaattttgctgacactgatgtgttcttagttggaattgattgatttcctgcatctcagtttctccagatgctcacaagtgatgccaatgtcaactcatgagatggggtaagaagggggtcgcttagcacttagaaagaggaccgagtacagagattgttcctctttaatctcaactggaaaagaaaagaacaaacctttaggccaggcacagtggctcatgtctataatcccagcactttgggaggccgaggcaggcagatcacctgaggtcaggagttccagaccagtctgaccagcatggagaaaccccgtctcaactaaaaatataaaaaattagccaggaatggtggcacatgcctgtaatcccagctacttgggaggctgaggcaggagaatcgcttgaacctgggaggcagaggttgcagtgagctgagatcgtgccactgcacttcagtctgggcaacaagagcgagactctgtctcaaaacaaaacaaaacaaaaaaacaaacaaaaagaaccaaacctttttctatcccctctgagcaaggaagactaaatcaattttagttacagcaagagttacttaggttacattgtagttaactccttccaggcagaaagaatagctaagggcattgtggaatttccttttctagaaatttgtaacaatagggtagatgtacatctggccttggatgccttaggctggtgtacagatacaaccaaaatagcacacacacaaaacaccctggtgggtcctagtcattctctcacagatattaacagagatttaaaaacagtttaccaaatcccccttcatccccagctggatcaaggtctgaaaccacatcagtcaccaaagaaactcagaaagttgaccaaaagcgatttacctgtactaggagttccagcttcctgtcatcaagaagatgtacttgacatcggcggccctccgtcatctaagagggaagagaaatggtagtcactgagagtctagcagccagacaaagggttagagggtcgccgacgctgcactctgccaggcatattcctctgggcaaaacttcctctgggagtcggcactgtataatgccaggagttggaaggatcagttcattcattcattcaaaaatatctattgaggccgggcgcggtggctcacgcctgtaatcccagtactttaggaggccaaggtgggcggatcacctgaggtcaggagtttgagaccaacctggagcctgactaacatggagaaaccccgtctctactaaaaatacaaaattagccgggcgtggtggtgcatacctgtaatcccagctacttgggaggctgaggcaggagaatcgcttgaacccaggaggtggaggttgcagtgagccgagatcgcgccactgcactccagcctgggcaacaagagcaaaactccctttcaaaaaaaagaaaatatcaattgagcactttctatatgccaggcacttttctgggagctgggtgtaccacagcacacaagacaaagttcccatcctcatggagcttatattctaataagggagatgtaaaataaattagcaaatatatatataacatattctcaggggtggtgggtgttgttcattcttcacttattcttccattcaataattgtacccgcatgcattagggacacagctcaggatccaatctctgtctcctcttcatttatcccacttgctggtaaccagaaagcagatgaccacccacctggcaatgaatttgatttctgtgttagttaatcggccccctccttgtgtatgacctgattccctacagcgctgtcaccaataatagaaaagcactggcgatatgaacccacaggcaaatccaaccccgtcccttgtgcctttcaggactgaaatctctgagtggtataacaggaagcctgggagacccaagtctagtgttggtcctgctgcttacaaggggctgcaggactctggacaagttaccgttcgtctccatgcccctgtctcatatccaaaaataaatgggccgagcccagtggggtgctggtgaatatttaacaactggctttctggaaggaaaaagcctgatttgtagcatttgctggagcctggcatcaccctcaaaggaaatcctttgaagaacaagccttctcatggatgtcaactggtgactgtcctaaccataaactgtcttgctgcactctaaatacctttactgcgtccgatttcaagccactgtcatgacaacactgctagtaattccaacatacagacacgatagacaaacatagcctcaagctcatagaaaacagttaagtgccataaaaataattaggaagggatagatttttattatctttgtttgttaacaccatgtgtttaagcatgtgtacataatttcattttaacaatggctatgctttataattggcaccccacattcctgaaaatgtagcaattggctctcccaggctagtatgaaatagctccaacgctcctctctggaccagatgacacataagtttccttccttgtatttctttagaggaaatcctttagagaactcaatgcctattttatatgactgtatagtccccattaaatacagttcttttcccctgtatttagtggctaaccggccgctttaagcagatctaaagaaaggatgcgcatcagtagatcctggccctgtctccttgtccagccatgagggtccttctcataaatctttcctcaaggaaagataaaaaagacagtctcagatgagacacaatcttgcctttacacacttagcacagtgcctggccctaagggagctcttgttttaatttaatttttttttagacagagtcttgctctgttgtccaggctggggtgcagtggtatgatcttaactcactgcaacctccacttcccaggctctagcgatactcccacctcagcctcctgagtagctgggactacagagcagtctcgtttctctcatgcgccacgggacgtaccaactctccaggctaagaataacgctgacatttctcaaggcctgttaggtttggaactgctatcctgatgagaatgagcgtctctgcaaatggaagcaggtggcagcacagtcgcgggccgaaggtgcctactgcactcacggctcagtcccacccagtggccagccaccctgcgtccttcgtgaccctctcctcgaccctgagctcctggagaccaggagttatggactggattgtgttcccctaaaactcatatggtgaagccctaacccccaatgtatttgcaggtacggcaagattaaacaaataacaagaaaagatagtctcttctcttctggttcaacagggattattcacttatcaccaacatatccaaagctgtcatgaaatcctatgagaaaattatcttattccttcctcaaaagaagtcatcccatatttccatcaagtcgggttttccttgttttgggatctaaaacaacatagcatgtcctgcttacatgggggctaatctcaatgtctcttgattctgagttataacaatgacttagcagcccccagctctgagaaaaatcaagaaaagtttcacatactcctaaacactccaacgaacagattaaacacagaggaaaaacttcaatccaaagccttgccattccgcacatacaagtcaaagcaggcagctgtggacatttgatgagtctatgcaaagtccttattcacccgttgaacccctaacttcaggtgttaattgtcttagtgggaaaatgggctcaagtcctattagaatccatcaaccttgcacagagtaagcatcttcactgattgacttaatttttaaaaatccatcagcttcctttcaatcattccctaagttcaatgaaagccattacaattttaaattagactaaaatagctgctgctttaccaaaatgtataaatgattccttcatcaaaaaagtacactagaaatgttaatttcaagtttcagtagggcagataatagcaattgcacaggtactttagataaaaatttcgagctacgctgattcagttctcattggaaagaacctaaggtcaatagagtaaaagttttaagaaggaaaatggtatcacattcagaaagttatgttaaattctttcaaaagtttaatcatagatttgagaaaagtctcgacagagaataggggagagttttaagaaagaaatgctgtttgttttctgcatctataaaacagttctgagcttcgttttatcataaaaggttaagggtataaacatgctcttgagttactcaatcacagtctaataaattttatgaaaacaaattggtatctgaaagacattattggatcaaataaagttttaatcgcagtaataaagaagatgaaatgtatcattttctcgaaatatttccaagctcacaaagttcacactcacacttaaaggtcttccctgaggttctcattttcatctgaaaaaaataatcctcattacataaaacaatctcaccttatctgctcagcaatttaaggaagtaactatttatcatgatgttagtatccaccctaggtcttccaatttctttcctcttctcaacagtaattcctaggaaatttacaaacatgctccgtattttaatgcctccctgtagaaagcaaaatgtctctgcaaacagcacagagaagtgtctaaacagactcacctttgaatcatcatgtttttgaaggtacagctttcttttgacagcactgctgtggtttatttttcaaaagggagcacctgcctgttgttccatattcaagtaagattagagtatcctgttcttatcatcagttcagaaaacttcaccattctgggtgtgtacatagaaagaattgacatctgtagctttgtctggcttgccaggcactctgaagttttcttttcaatactaacaattgtgaaataatactgctttcccttgttttgttctgttttgtttttttttttgtttcttttttttttcatttccagctgttcagacactacgggagccctggcatcaccctcaaaggaaatcctttagagaacaaggcttctcatagatgtcaactggcaaccattccaataatcaactgccttgctaccatacaattctagcccaagcagaggcctgccaagtgccctgtgattctaaaggaaatacgaaaaagtgttcttttgaaagtgaagtgtctgccccaatttatccaactttgctgctaaggtacactctgacatgaagactgtgcagaaacatgtaaacacatttatgatactagcttcagtgaccacagcagactatcactgatatgtatcctggcctggcgtggtggctcacgcctgtaatcctagccctttgggaggccgaggcaggtggattgcctcagctcaggagttagggaccaacctgggcaacatggcaaaaccctgtctctactaaaaatacaaaaaaaaaaaaattagccgggcatggtggtgcacgcctgtagtcccagctacttgggaggctgaggcactagaattgcttgaacccaggaggtggtggttgcagtgagccaagattgcgccactgtattctaccctgggtgacagagtgtgaccctgtctcaaaaaataaaaataaaaaacaaatgatacgtatcctaattgtcatgcacgtggacagggattaagaggcaaaaaaatatatatataggagtagatgtgcaacgctttaggcttctgggtggtttacaccactccacctcacccaaatatgacttaatatgttactttttttttcagttaaaaaaagtgtaaaaaagaaactttatctagaaagatgagtgaccctatttggagaggtgcagagtacccagatcagagttggaatttaatttttctggtttaggcttagattggaaacagtcataagacagcaacttcagaacattctgctgcccacaccacacagggacacggaaagtaatagaatttaacgtttggcaaagtcttttctctctctctctttctttctctctctctctctttgtgagatggagtctcattttgttgcccaggctggagtgcagtggcatgatctcggctcactgcaacctccacctcccgggttcaagcgattctcctgcctcagcctcccgagtagctgggattacaggtgcctgccaacacgctcctgtaatttttgtatttttagtagagacggggtttcaccacgttggccaggctggtctcgaactcctggcctcacgtgatcttcccgccttggcctcccaaagtgctaggattataggcatgagccaccacaccccgccatagcaaagccatttcttaaagacagtgcaaacatcttgagtcaaaaaaaaaaaaaaaagaaaaaaagaaaagaaaaccaaatatgtcttactgagaatagttgctctttgaattcaaaaaaaagtcaaccctatttgcatgtattgcttcctatcacccttttctcaacataccacctttctttcctctgtgtctttttggtttagccacttgttgatgtcctctgtctcccttttctttcttgccctttgcaaaataatttcttcttccttctttctttcttttttttttttttttgagccagtgtctccctctgtcactcaggctggagtgaagtggcacgatcatggctcactgcaacttctgcctcctgagttcatgcgattctcctgcctcagcctcccgagtagctgggattataggcacccgccaccatgccaggctaattttttgcatttttggtagagatggggtttcaccatgttggccaggctggtctcgaactcctgacctcaggtgatccacccgccttggcctcccaaaatgatgcaattacaggtgtgagccaccgcacctggcctgcaaaataatttctatgccatggtatatgcctgtgcaggaggagctgagaagaaagaatcctagttccactgtttagaatgtttttgtttcatttgggtttttatttatttttttgagaaagggtcttgctctgttgtccaggctggtgtgcaatggtgtgatcttggctcactgcagcctcaacctcctgggctcaattgatcctcctgccttggcctcccagacaagcactggaattacaggagtgatccaacatgaccagcttacctcatctttttaagccttgttccttgtctgtacaagagggataaaatagcgtctacctcttaggaatcctgcaatgattaaattaagtaatgtttggaaatttcttagtgctgtacctggtacgaagtatatactcatcataacgttagctgttaattattatcagttgtatggttttggaaataatatgtgttgaacccatagtccttgtaggacaggaggtagatactatcaggcttactttattttatttattttatttgttttattttattttattttattttattttattttattttattttattttatttatttttatagacagggttttgctctgtctcctaggctggagtgcgttggtgctatcatagctcactgcagcttcaacctcccaggctcaagcgatcctcccacctcagcctcctgagtatctgggactacaggcacacaccaccatgcccagctaactgtgtttattttttgtagagacacgtctcactatgtaaattcttggactccagtgaccctccccaccttagcctcccaaagtgctgggattacaagcatgagccaccgtgcctggcctagagcatttttatagaaatgtaatgcagttgtgcaaattgatcctgaacccagaaaaaaacatgtgttttttaaaacaaaaagtaaaaaaatagtcaattgacacctgtattctcttagtttcctgaggctaatttacactgaaactatttcagggaagacactgtggggcggggctgagggaaggtacggtgagggaggagagctgtttagtgagatgttcacaggcctgccaaaacatttttttagtctagttaccaattgcctactcgttgacatccccgtgaaaagcaagccaccacgttgtttctgatattcatttttgagacaataaatttacaagacattaaaatcagcaatattaatgactcactagaattgcacaaaacaaacaaccttccaagatatgcttcagttaggaaaattaccaatactccccaaaccacctgaaatgctatcctttaaaacttagtcatcagacagaaaatttagatttcaaaagccaaggccctaccagtgacttaccgctgacagcacgtcttccccgagcacagtcccttaaaccacaggacaccctgaggatgtcggatgcgggacagcagcccctcatgatctgacctctgacccaggctgttgtgtggctcagaaggaaattccaaggccatgactacaacttcccggcacaagtcattgttggtgctcccgggtactgggtcacctcaagagacacatccttctctccacttcagtttccttcacagaaaagtgaagactcaaagtccaatctaggtacccaaacattgcaagaccacaaaatctcaatcatcataaagcacatcacagccaggaggagatgaatgaatgtcacgcagttacagcaacctcaagaaatttacgggaaatacacacatggaaagaaaggacttcaggcaatttaaaatctgttaaaacattaatccctgccctgtaatcccagcgctttgggaggccgaggtgggcagatcacttgaggtcaagatcagcttggccaacatggtgaaacctcttctctactaaaaatacaaaaattagctaggtatgttggcacctgtaatcccaactactggggaggatgaggcaggagaatcacttgaacctgggaggcggaggttgcagtgagctgagatccagccattgcactccagcctgggcaacagagtgaaactctgtctcaaaaaacaaacaatcaaaaaaattagatacatacagatagtgtaatggttactacagtggagtcagttaatatgtctatcatctcacatggttactttttttgtgggactagagcagctaaaatctatttatgtaacaaaaaaccctaacacaatacaattttaactttagtcctcatgttgtacattacatctctagacttgttcatcctccttatctactgtggttctgtatgtatctacacatctatgggtatccaatagcgttatgatgtaaacttcaaatatacacaatcatattttttgtttgtttttttgttttatgtttttgaaacagggtctcactccgtggtcccagctggagttcagtggcatgatcacagctcactgcaacctctgccttcctggggctcaagagattctcccacctcagcctcccaagtagctgggattacagacgcaaatctccacacagggttaatttttgtattttttgtagatatggggactcgccatgttgtccaggctgctcttgaactcctgggctcaagtgatcttcccaccacagcctcccaaagttctgggattacagatgtgagccaccactttcagcccatatagatatatatgtaatatatataaaataatatatattatatattattataatgtatatgatataattatgatatataatacataataaatatataatatataatataatatataataaatatatataatataatatataataaataacatataatataatatataataaataacatataatataatatataatatataatataatatgatatataataaatatataatataatatataataaataatacataatataatatataatatataataaataatacataatataatatataatgtaatatataataaataatatataatatacaataaataatatatataatataatatataataaataatatatatataataaatactatatatgtttattaattcacctatctgggcatggtggctcacccctgtaatcccagctacctaggaggctaaggcagaaggattgcttgagcccaggagttcgagaccagcctgggcaacatagtgagaccccatctcaaaaataaaattcatcaattccctgtccacacttcacttataccagggaaataacacttattacaaaagtgggcaagtgggatctacccaaaacctttaaaggccaaaggttgattgtaattttttaataaaatttttaatacaaatttttattttataaaaattttatataaccatttttattatcattgtaatatgatttttatgataacttttccctctggtttatctcaagcttacttttgttcggttctcaagtgataccatattgaagtaagatgacgatggaaggaaaggagacacaggcatgagacaccagaagcctcattcagagaggatgaccttgttcctattttgctctatgacctctggcaaacgattccacctgtctttattgtgactctcctggatttaaaaaaacatacgcaggtgtggccaggcacggcggctcactactgtaatgccagcactttgggaagcagaggcaggaggatcatttgagctcaggagtttgagacctgcctgggcaacatggcaaaacccaaaaacaacaatatgaaaattagcagggcatggcggtgtgtgcctatagtcccagctactcgggaggctgaggtgggaggattgcctgagcccaagaggcagaagttgcagtgaactgagatcaggccactgcactcccgcctgggcaaccgagtgagatcctgtctcaaaaaacaaaaaacaaaacacatgcaggtgtgtccttcaggttcttggtggctggatacagctgcagcttatacaccagatggaagttattaagtgagtggctctattagaaacaaattaacatgacaatattgatgtaatagaaaatggaaatagcaatgcattcttcaaagctcaaccctctgcgggtttgcacttcaagtcataacccgggctggcgttttacttgcggatctttggaaagctcatcctagggacgctgctgctgctgctcatgcagcaaaaggaaattcggttttctctgatcatgcaaaagagaagtccgggtgtggggacccagcggtctatgtgattcaagccacaagtcctccaggccgagcaatgaaccatctccacatgaatgctacagggcagcgtgtcagaaaacattaataatcagtctctgggcctaaagtgtagacgatgaggcgtggacccaggcaggtaagaggctggtacaacaggaagctctcctgagggcgttatggcatctcgctgaagaggaactcctacccacagctcagttgtgtgatgtggggaggtgggtgcactttccaccttccaaccaaacaagctactggcgtgaatgatggacaggtgcgacagatgtggaaggccaagattccgctggggcgggtccacaatcaccctcctcacgcctggcagccaacgctctgactacaatgacaagggcagatggacgctgaaagacgcaatggcatgggccccagaattaggtcctgcaccatggacaccatactggggagcacagggcagaagccgctcacaggtggcgggcaggtgtacaaagaactccaggctcctggggggcagcagcgctttctgggtgacatccaactagctggacccctaaaatttggaggaacctgtttcctcctaggttctgccactgttagagtgttttctgaaaacgggattttctttacctccatttcgagtacattatcaggattttaacccactattctaccggaaatacacacaattaggaagatttattcacaagccctcatttacaacacaactgcaggttttacttttcatccaagcctggaaacacggatatctttggttctgcaactggagcaaccggagtctctgaagagctacagagccttaatcctactgagcactggattgtattattattattaatcattattattaggagaggggctggggaagggaatagagcctaatccttacaaaggaaagggagctgggaatctggatcagagagggagtgctgtgcagtctgaacagaggcagaggctaatgggaacagagatgggtggcagagagcagcccttgggcagatctggacagaggcctgaaggccccagaggccagtcctgctgtgggtgcagagtgagattcttccttctttacatattgctgctagcatctgtgaaagacgactgtctgaacatggataacaggctctctgacatcggcctcacctcaccagatccctttttttcaaatactctccttcccatcgctcctctcagtttcaagagtgggccacctgggacttttagagtctgttcctccaaggaccatcctctcccttgccgtggggcctggcccatgctgttacctttgcttggaggcacatttttcactcaaagtccaaagcccatcgctgtggtctcctctacgccatgcattcagcccggtgctggggacacaggtgacccaaggagccgtggtcctgtttcttgctgattactggcttgagagaaagatgccacacaccttctcctcctgagaggcaggtccacagcactatctggcagctaccctgggctgtcacgctccgtcctcccctcccctcccctcctgctaggacacctaacatcaagaccgtgctgggttgccgccactgccatcatgccagctcctgggtctcagtgaggctgaggacactccagaacgggaggcaagcccatgtgggagatgactggacccatcttcattcaacgttcagttattgagttctataacaatagaactcaactcagcacaatttacattgacatatcacgccttaggcgggaaggagagcagctcgaggggaaagctgccattgtgaagaagccatccagccttctgttccacaaaatccagcatagcatcatggtgcaggaccgtcagcccacaccagctaactgcatcctcagcatgcttgtgagccagccaaatgccaatgaagaccccattatggggctccaccagatgttcctatgaaaggacataatggatgcttgggttcgccctgatgacagacatgttcaggcctgccctgcacgacttcactgacctcctcccagccaggcactcacgctgtttctttctccctcctcttcccaatactattcacgcttctgcagacacaccagatactatacacaaatgcacggggctgtgtgggggcggacacggtgcactgttgccaccaaggtgtcctgcatgatgtctggacaccggaccagcggcctctgacaggaagagtttgtgttgtgacagtgcatgccttggaatggttgttcctttttaaaaaaaatctgacaagttgctctagtaacccaaagaagtgaaggagaaaccagctaccccactggacagatactgatttgtgcagaatccgtttcaatgcctcatgaaacaataaaaccacgaacatcttccttaaaaaaataaagaccacctcaccttccccttccccaggtttagctttgtacaaaagactgaggaagccgctgactctgccgggttctccctgctctgccactccaggccttctccagacctggcctgcagagaagggcacgggggacagccagggggctctaaacagctgttagatcctcttgcatctcgcagactcagtggactgctggggatgccaagcgtgggaaggaggctccaggcacacatcccactcctgtcctccagctacctggggacccagaggtctgagccacacactgtgcctcccttgctaccctccctgagccacaccgccggggcttacggtgggtcagagccaggctccagagctcggccacccggggctgtggcttatcctggcttcaccacttcctagctgagtgtgatcctccagaagttacttcaccaacgtggcctccttccgtaatctataaaacagagatgacagcaattcctacctcgtagagttgtgatgaggaacgctgcacataaaaagtgcagaacgctgaatgctgaaccactgactgccgcctacacacagtggagtcaggccctgatctgatttgctgctccctgctcctataggaaggcccgggggcgctgcaggtctctgtcccctcatgccaggtctcctgtggctctggatgggtgaggaggctaattctgggcaggtggcattgggatggctgtcttcagggactgagcaagtgccaggccttcacaaaatgaagctctgggggcactggtcatttgttgaggagggtacttcgttcagacaggacgcttagaagcccagctctttttcccagtaactggttcccagggccatcctgtggcacccgcactcattacgttgagagcagatgtaagaaatacaggagctggcctaagaaaggaggtttaggaatacccatgcacgatgtgtgggaaaatgtccaggttcttacgcatgcacgtaattcttattcacagcacatgcgttcacgcagacgttctgcaagggcagctgggagaggtgtaaaccccaaagaaacagaacatgcaagaagtggccagaaagtacacacctacctaacatccaactgttccctgggggaacagtgaggaaagatggaaaataacacctgttctttgccacatggagctctggcttcagtatgagtgacagaggttgtttatatttttgtctgttcgtttgtttgtttggagtagaatgagaggcttttttcaaagggaaaggcaagtatctaccttttcttttgttttgatgactgtacttggaatttttagagtagaaaaggatagttagatggagcctgggcacagtgactcacagcactttgggaggcggaggggggcagatcagctgaggccaggagttcaagaccagcccagccaacacggtgaaacgtcatctctactacaaatacaaaaattagccgggcatggtggtgaacgcctatagtcctagctacttgggaggctgaggcagaagaatcacttgaacccaggaggtggaagttgcagtgagcctagatcacaccactgcactccagcatgggtgaaaagagagagacactgtctcaaaaaaaataaaataaaataaaaaaataaaagaatagttagatggagaccccagacagacagtttttaaaagcctagaaaaaaagataaggctgaaaaaaaaaaaagataagtttgactctctggatctaaaaaaatatagttcatatgggatggtgactttaaacgtaaaattttgatcacatgataaaattaaatgaggaagtgaagattgagacatgaagaacacaggatgtgtgctggagaactcgcaaaggagactagattgtagtagaacaaagtgtgtatgaggaatatttccagcatttttcgtgcactacaagtttacagggagagagttggaaagctgacactgacatttatttatttaaattagttaatttatttttgagacggagtctcgctctttcgcccaggctggagtgcaatggtacgatctcagctcactgcaacctctgtctcccaggttcaagtgattcttgtgcctcagcctcccgagcagctgagattacaggcaccagccaccatgccccactaatttttgtatttttagtagagatggagtttcaccatgttggccaggctggtctccaactcctgacctctggtgatctgtccaccttggcctcccaaagtgctgagattacaggctgagccaccgtacctagtcatgacactgatatttaaaacaaggaaagtctaaggacaataaaagaacctttaaagatatgttcaaagcaagaagagcaaggaagggaatggaaatattgtttgaagcaagtagatgctggttgggtgtggtggttcatgcctgtaatcccagcactttgggaggccgaggcagatggatcaccagaggtcaggagttgagaccagcctggccaacatggtgaaacctcgtctctactaaaaatacaaaaattagctgggcttgttggcacacgtctgtagtctcggctgcttgggaggctgaggcaggagaatcgcttgaacctgccaggcgcaggttgtggtgagccgagattgcacgactgcactccagcctgggtgacagagtgagacactgtctcaaaaaaaaaaaaaaaaaaaaaaagaggaattgctgaacaattcagcttctgtttgtttcactcttctcaatcaagagggaaatgaaaggaatataaatgaactgcactctctccccaaaataaatcccaggtagtttataaagttaaattttaaaaccaggtagatgattatttaccatgtttctctaagcctaaaagcaatgaatgagccaaaaaggaaaaaactatggatttgactaccataaagatcattctaaacaataaattatactccacaaggccccataagcaaaagtaaaaagttaatgtaaatttcaggaaggtattgtaacaactataatgggaattactatattaaagataaaatcatttagttagtagataattacaacttaattagaagaccactaacaccttccaggaaatagaatgcaaacagctaaaaagtccagatccttggactctgtcatttctcttctaggaattttccccatcgaaacaagagaaatagaataaagaattattcacagtaatgttcaccacaatgtgttcactcaagtgcttatagcatctttattatgtgccagggatcttattaggtatataatgatgaatgtgattttgctcctatacttaaggaacttctatgttctgtagaggaaatacccaagttaacaggctgttgcagagtgatcagtgtgactacaggggtgagtataagatgctatgggatggggacggggggacaccctaactcacacctggtggatccgtcaataccccagggaaggagtgatatctgcagaacacagcaacatgaggtaagaagggatgaaatgggagagaacatagaatgttctggaaatgtcacccaggcaaagagctgaaggacaccgtggcggatgagaaggaagcagtgagaaatacagctggacaccgtctttatgaaaacaaagaagggggagctaatcgtctgagtgaggatggctaaatcgcttgaaataggaaatagccactgagcactgttttcaagtcaatttcatcatgaggccaaaatgaggggagtctggagacagggctgcaacagcaagatccacaagcacttggaaaactgcaaagtgatattaaagtagaacttgtcttcctcaatccatgtatttccccccagtgatttgtaaagggacatagcaggcatgcatatcagatttacagagggcaaagaggttcggatggtagcttcaaatgtcaaagttggggtcatattgtttacagttttgtgtcgtactcttcacgcacgtgctagaagcccagcatcggaataagggaattaagaggtgccctgcattctactgtggttaaactgcttctggaaatctgtattcaattgtgggtaccatattttatacaagaaaatgaaagaaatgggagagagaccaaagaaggataactagaccgggtgaaggtccagaaaccagtacttcccaggactgagggaaaagctgcatcggtggcctacatatcacaagctctagtggtagcgtgaccatacaacctactggccataccagatacttgtgaggcaaaagggaggctattattgattatatagagagaacaggtataaactaggactgtcctgggcttacccaaatgggggttcgggggaacttgctaatctgatgtgtataaagtgaaggtgggttaactttgctttggtgggcaaaaaatagacccaatgaggggaaattccagaagatacattcggattcaatggaaggaagaacttttgaacaagcatcattgctcaaaatggaatgggttgccccgttatcactgcaaatcatcaggaagggaccagagactttagcaagggaagttgtagaaaggattacagaactcagggacagacggactctaagatcccttcccttcctctccaataagttgtgatgtataaggcatggatatataggcacagctagaaacaaagagttccaagaaaatatattcattctgatagctgatgtatttacttgtgatgtttccttggtacaatattacatgtggtttggtgaaacaaatttttacaacgttcactcagtgcttcagaaagcttacaaaaattttagtacagactgataggcacaaacgcatttttctactttttgatgctaccaatttttctcatataaatgtgtggtcgaacatcccctatttaaaatgtaattctgtgcagaagagttaccggcatctgttgctggtttggtagagaattcacgtgctcagtaaccaagaaccttaataacactttctggtaacatgaatttgcctactttgtttcagtgtccagtttaatctgtcgttttaaatgaaattttaaaaaaattttgcttatgttgtgatcaatggaaggagacacagtattatttacaactatgggtcttattatacaataagttttcacagttgtaaacattttattgatactaaaacaataatacgtgtgattaaaatagaatgatgtgactgccataataggcacacaataaatattttatatgaataataaatatatatttaaatagcatatatctttatatatataatttcaagggcaattatgtaatataggtactatataaattaatttgcattcagtgaaatatgttttaatttgcctattctgtagaaatatgccccaaaagccagtctcaggaacacatgcattatttgtcattcacatacctatgtgacaagcagaatcaatgtggatctgccctcagtgatgggtgaagccacatagataagagttggggaatgggctctccttgtcataaacaatcttctttgtatactactatagtcataatctccattgcctcccagggaggtgtggagcagaaaatagtattctagaccacctgcaagttttccaaattccacccttgggtctttggtggctcttgacatacagtaggaaaatggccacctatgaggttagtatgtcctgccaggccacctgctttgctaaacctgtgttggatacaaagcactcctgtactaagtgcctaaatccaaggtccacatgctcagatgccaagtcctgccacgtttagcaggaagcactccacaccgacagctgactccagtgacacccttaaatcagatcaaacctctagtggcatcggagcaagacacatctgagaaacagggacgctcgagaactagagaaccaccagtcctacacggaggtcccagttccatgaggtcaaaaagaagtccccaaccctccccattccaatacagagctgcagggagagcttggggacccgtagtgcttccatagggggaagtttccacagtgactttgacatccacacggagcagtccatctgggctagaggctaccgcctttctgtttacataaccaagtactttggaaagggttctgctggaatgtcgctggcagggacttcttggtcttgcatgagctgtgctggcagatccctccttccattcttcctgggggaggttttgacactggctggctgccccatgaaccatcccagacacttcatggagatctgcccctgggcgcctggtccagtgtcaggagctcccaggaggggataagtcctagagctgctccccatgtaagcctgggcatggaaggtcaggcctgagaggggtggaaagagcgagggagaggactcccaaacccaaaagtctccccacccccatcctcatcaagcctcttggtggaaatgctgtcacagacagtaacgtagcaccttacagtgcaatggccccggcaaacgagagtctaaatatatccagggtgcatatcattagtgagcagttacagaaataaagatgttatgttgtatctgttagtcaaatcaaaaattctaattggacacagaacaatttctcaaagctttcagcaggaggtaattactgtgttgactacttgtagcaaaaaaaaaaaaaaaaaaaaagctgaaatagagcctagtgtttgggctgtttccatgaaagaaggaaggagagagatgtttttgcctggatctgagctgcttaaaagctggctgggctcctgatctttgcactttcctggtttaaccagtgacactgctgcaagcagctcaccatgtcacaccaaaccctttgataaccaaagtgcagtgtatttttagcaaaaccttcagaaaagacctggaaataaagccaggcatggtggctcacacctgtaatcccagcactttgggaggccgaggcgggcagatcacctgaggttaggagtttgaaaccagcctggctaacatggcaaaacgttgtctctactaaaaatacaaaaattagccaggcatgctggtgagcacctgtaatcccagctactcgggaggctgaggcagaagaatcacttgaacccgggaggcggaggttgcagtgagccgagatcacgctactgcactccagcctgggcgacacagcgagactccatcacaaaacatagaaagaaaagaaagagagagagagagagaaagagagaaggagagaaagagagagggagggagggaaggaaggaaggaaggaaggaaggaaggaacctggaaatgagtctgtgactagataatagtattggaaagccagaattttaaatcaggacagacagatgaggcagggacagtgatgacattttatatccttcctcatgtctagtcctgagcatcacacaaatgattgactaaaagtataaaagtacagagttacaattcctgattgtggtgatggtttcccaggtatagtcacatatcaagacatatccaacagtatattttaaataagcatagtttattgtatgtcaatgatatattaataaatctatttaaatatgagatttagcactttgtgaggccaaggctggaggattgcttgaagccaagagtttgagaccagcctgggcaacacagtgagaccccatctctaaaaaaaaatacaaaaattagccgggtgtggtggtaatcccagtgctttggcctggagttcaaaaccagcctaggcaacacagcaagaccccatctctcaaaaacaaacaaaaaaaatcttttaaaaaacgtagccaggcatggagacatgggcctgtagtccctggtactcaggaggctgaggtgggagaatcacttgagcccaggagtttgagtctgcagtgagccatgatggcaccattgtactccatcctgggcagcagggtgataccccatctccccacaaataaataaaataaaataaaagagagacatttcttccaagttatcaaaaagacaccatcaggagcatgacattgaggattcaatttgtacaatggcacatctcaacagaacttttcacacaatgaggaattcttttctttccttcctcttcctcctccttcttctttctcttccttttcctgctcctcctcttcctcccttctcccttctccctcctcctctcccttctcccccctccccctccccctccttccccttcttcctcctcctcctcccttcctcctcctcctcctcctccttcttcttcttcttgagatgggtctcactatttgacccaggctgctctcaaactcctggcctcaagcgattctcctacctcagcctcccaagttgctgggattacaggtgtgagccaccacgcttggctgtttttcatacattatattcttattatttgaagtttggtgcttatgcattttcccagatgtcatcatactcagttctgaaccctggagttggcagtcttttgtgctttaagcatcgtttgtacatgggtgagcttcaactctgtgtctccactgtggtgtcccctgacccaggtttgtagagaattatgctcaaaactgccctctccacacctcacttggtcccttgttaaacatcccaagctcagcgagtcccagacggaattcctgatctcacttttccccagatcacagcttcccctcccaggtaatggtagctctgcctcgtcatctccattttgtgctcttttggccccaaattctggactcttctctttatcacatatcccacactgaaccctcagaaaatcctgttggttctgtcttcagaatatccagaacctgaacacttttcatcaccgtcatcatcatcattgtcatcatttgtctggattcttgcaaatgtgcttccaactctgcccaccttgcaatctcacccacacggcacccaaaccatttctgcatggcctccgtgggaccaggggctccccagctccacaatggggagagccccccagggtagagccttaaaggcccatgtgactcccaccagtcctcaccctgcaccacatggctctgggacctctcctgggtgcaacctctcttgttccctgccacacttctgcctcagtgcctttgatgaattctgccctctgcttggaatactcaccacgtccagacacccacctggcttacctcctcacatcctttcagtctttgctcaatgatcacctttcccgaggtctacaagacccctgtgtttaaaagagcaacttagcacacttcccttcctctgctttgtttttctttgtagtaattaccagcttctagcatcctctgtcacttacttatggatcatgtggattgtctgccccttcctcttcgaatgcaagctccccaggggcaagacttggttggtttttctcactgccacattcctggaatgttcaaggcataccaataggtatgtgttgaatgattgaatgggtgggtgcatgaatgaattaatgaatgaacttgtggcactcaaatacttctgccatttgccagctggggtttgccagggtagcattttttatacgaaaaaaaggagggctgggtgtggtggttcacacctgtaatcccagagctttgagaggctgaagtgggaggatcgcttgaggtcagagttcaagaccagccaaggcaatctagtgagacccccatctctaaaaaaaaaaaaaaaaaaaaattagctgggcatggtggtgcatgcctgtagttccaggtactggggaggctgaggtgggaggatcacttgagcccaggagttcaaggctacagtgagctatgattgcaccactgcactccaatctgagtgacagagcaagaatgggccagagagagacagagagagaaagagagttgtcacactatccttattctcttcccatttgacatagaaacaggcagagagagaaagcagagctccctagcagagagaagagctgaccataggtaggggccctgggctggagcaggaaacagtccctagagatctgcgcagacaagtcaaaaaaggagaaatcacaacgtgacaatgagttcctcagttacatttctgagcacctgccaaatgccagggataacgctgggtgctgtgctgtcaacgacaaagaagatacggtcctacccctaaaaagcgacggtgggaggcatgtgaacaggtcgtcactgtccataggatcgaactgcgactgccttccagcacgcatgcttctggagaatagaggagaggaactcgcttctgcttggaggaacaggagcagggaacactggaggctccaagtaaagaatgagtaggtgcgtcccaggcaggaaagggatgggaggggaatggcaatgtgaagggagcaattgcaaaggctgaagtccagatgaggtcaaatgtgcttggggagaggcaagggtgtgtgtgtgtgtgtgtgtgtgtgtgtgtgtgtgtgtgtgtgtgtgtgatggttaacataagaaaagaagtttaagaaataagaagcctctagattgtgacgggctttttcttccatgctaaggactgtggtctacgaagaatgcagggtgctgaggtgggggttgtggatgtggtcaggggtataggaagctggccaaaggataagctgtgatgattttataatgactcaggaaagagagcccctaaactatgacaatggcagtcagcacctcaccctaaaagaatgtgggaagacaatgtatggaccgaggcattggagaaatttgattggaaagattagctgaagaacagctgactccgagcaacgcagaaagaggaagctcgaggcaggcatggtgagtcacatcatgggacaatgaggtctgagccttggaggaggaagaggaagaggagtaatgagaaaaccacaggtgggaccagtaatcacaaagggaaacagcaaagcatttgtaagctctggaatcctacccagtgaggctgctttggggaatagtatttagggaacactggtaagtagccaaacccagaatcagccatttcaaaaccagatggacggacaggctccttcaggaaagttctgctgggaaggcacaggacagatgccatgtgccctcttcatcctcactgcccagccagcagggcaagccacgatacttgagttcctccaccccatctttcctacaaatgaacactggtgtattgacttttatctacatccaatacaaaaccaaaagccacagtataattttttggtttttttttttttttttgagacacactcgctctgtcacccaggctggagtgcagtggcactatcacggctcactgcaacctctgccttctgggctcaagcaatcctcccacctcagtctcccaagtagccgggactactggtgcatgccaccacacctggctaatttttgtattttttgtagagacggggttttgccttgttggccaggctggtctcgaacttctgtcctcaagtgatcctctcgcctcggtctcccaaagtgctgggattacaggcataagccactgcacccagccagtttatggaattttttagttgagttttgtcagttctctaggagcgtggtcagtttcattggcaagaagcaaaggaggatctagctgcttaagaaacaaagctctgccaggtgcgttggctcacggctgtaatcctagcactttgggaggctgaggcgggtggattacctgaggtcaggagttcaagaccagcctggccaacatgctgaaaccccgtctctactaaaaatacaaaaaaattagctgggtgtagtggtgcgtggctgtaatcccagctactcgggaggctaaggcaggataacttcttgaacctgggaggcggaggttgtggtgagttgacattgcaccactgcactccagcctgggtgacagggtgagactttgtctcaaaaaacaaacaaacaaaaaaaaccaagaaacaaagcactgtgtttttgcatactattctcgtattctctgagtatttggatatctttcccagttggaagttgcagatctctgcatggcacaaaatctctatcgactaatttacaactttaggaacaggaaggcaaatgaactaaattgttgtggatgacaaaagccatattttccacaataaagtaaggaaggaaccacaaacaaataccagcttataatttctccatcaaatgacagacacactccgccctgtctaggcaaaagatggccatacgctgtcccttagggctcactgaaaatatatcctagtcttggatgcagatataatgttctataaatactctccctgtttgcatatttgcctaatgtttttcttctgctgcctgtgtgtgcctgtttaatcagtctccagaagacagatgatctctcgttctgactttatttaacatttagaaggttattaagtgcttaaaattttttcgatgaacattatgcaaattgacacgttgacttctcgaactacaaggaaactatcccaatattttcacggtggttgagtggttgatgcaatggaaaagaaacacacacacacacacactcacacacacgctcacacacactctcacacactctcacacacacactcacacactcacacacacacacacacactcacacacacactcacacacacacacacacacacacacacacacactccctaaaaggcatcctgtatattcaggatctaggcttatttctgccattaacttgttgcattaatgacttgggtggaatataataaataaaaataggagttgaaaatcttcctaattaatggcaataaatgggaagtagacaaagaacattatggggtgattacagtgttgccttttttgttcagaaaaggatgcaattgccattcattgagataatcttggtaattcttacatcttttctagaattttcaagataaaagctttttctgatcttttttgaaaattaaagaatttcagaaattcttagaaattggtaatataatccactgggtcaaaggcaaagtcatctgtcttttcttccttcccttccccccaccgaccttctctaccttaatgttccaggactcgctggagacccagatgtagtagagccctgggctctctcatctgctcccagtgatagaccctaattccttttcacagctagaagactctattacatcctgccacctgccatcttcacaaatcttccctgttcccaacaaggtaagaatggctagggtcatgactttatctgcagaaccctttctggaaggctaggtgacacttgtgaaatatcagagctaacatttgtccacgtatactactttctgtctataaaattgatttcagtattataagtgaggatgcaccatttatttcagtagcacctccacttctacagccagctggcttcttctacctcgatgggatcatatccccccaaagttagcatcgttgagccttccagtaatataagtaaacaaggttggagagggggaaatgcaaagacaaaatctcttattctagagaagtctccttgcctaatgcagtagctcatgcctgtaatcccagggcttggggaggccaaggcaggaggatcgtttgaggccaggaattcgagaccagcctgggaaacatagcaagatcccatctctccagaaaaaagagtctcccatactttttgagagttaggcgtttcacagatattaactaatttgctcctccgaatgtcacttataaataaagcaaccaaggctcagagagactcagtaattcacccaaggccacataagcagtggcagagctggttagatgaccaaacccagggcaagatggcgccatcctcccctctctgtttgccatgccaggttgcaccacacagatccacatcaggaggcagggacaccagccttggcgcagcagctgagaccagggcgaggtccctcaatgcctgtaagctcttcctcatttgcaaaaatgatctagataccccctttcattcctaaagcaccatctctctaaaatgtttgattggctggataacccccagatcacatatgcacgtggtttgtagactgcaccaggcattgactgtgatgggcagccctgcagccgtggctgcagcccttgctaacagtagcccttgttacaactgccttctgtacatggttctcccctcctgccaagacctgcaggctacatctgtgctactggtcactctgcagttcttctgttacaaaacactcaagcagcccaataaaaggggattgagaaggccgaacactgctccccattgtgctccatcagtgtctacttcatgtcctcatcaccctcccatctctccttctctctctctctctctctgggcaacagagaaataaatatcagatacttagcagggctggccagtgggagtcgggagatgggcaagccagcgctagactctccggctattggtaggtatgtcgtctagctctggaggacccacactgtctggcttcctagtttgggttttatcacatctatatacttcttcccaggcatgtggcgagagcgtaatggtacattttctggttatgaatggcacagcctggcaactcgccgattattatttccattccctgtgatgcattatcaatctaattccccattacctgccgtttttgttttttttcccatgcgttccccatacagcaaggacaaagaaaggcaaaaaccctgcaaagaaggctgcatcaccaatgaacaggctaatcccacaggaaattgtggagtggtagcttcaagtgtgcagggagaggttttggctaatttgaagtgcaaaatatcattaaaaggtttgggattctgcattaggaccaggactccggactttaaggttggtaatgcattactaactgaggaagaggggccataccacagcacagactaagaaaagttttgacacaggtgggcctaacaagcgacactgtgctttagaccactggggttttccagatttctttcttttttttcctttatttttatttttttagagacaggttctccctctgttgcccaggctggagcgcaatggtgcaatcatagctcactgtaacctccaactcctgaactcaaacaatcctcccattttagcctcctggagcagctgggaacacaggcacacgccaccatgcttggctggtttttcaggtttctgaagtctaaacagatccatgttggagtgcggtctgctacactcactcagcgatttgcttatacaaccagggtccggggagtgctcaacatgagcagcgagttaatgtagtgagtgtatgcaagcaaaacatacgcagtagccacggattggcaaataattgctaagaaggcaggagcaaaaaggaacatgtgaatgtaagtcagagtttggggcaaagggtatggatgtaccaatgctcctgaccacagacaacacgtttcttcttgtattgcatcattgaatggctggagctctacctttaaaacaaaaagccagaaaacatcacacagtgtagagatcgcccttcctaacaagctagagcctacaaggaacttctctgaattagaattaattatgctggtacatctgtagagaggttttgatttgactcaaactgagactaccactcatttcttcttgattatttggtagtaataaggcccctgaactgaaccggatcccccatagtcctctattactttccaacaactgtgacttttattcttagcagtgacttccatcttcaagtggaagatgaacaatgtttctctttgggaggaaaatgcccaatttccactgatacagttaagaactgaggccgggggcggtggctcacgcctgtaatcccagcactttgggaggctgaggtgggcggatcacatggtgaggagatcgagaccatactggccaacatggtgaaaccccgtctctactaaaaatacaaaaattagctgggcgtagtggcacgtgcctgtattcccagctacttgggaggctgaggcagggtggcagaggttgccgtgagccgagattgcaccactgcactccagcctggtgacagagcaagactccatctgaaaacaaaacaaaaccaaaacaaaaaacaaacataactgaacgcacacacacactcattagccccccaaataagcattagtgcaatgtactaaacagtagcaccagctctgaccatcttctgtaaacgtaagagaggaacagtgatagggatttttaaaataatgccactggtggtagagctggttacttccaatgtaagggtgtgtctaaattattccttataagagaaggatgtgctgattccatgagacaacggaaagggtggcagctgatggatttagggaactaaaatgaaactgctgtgaagagaatttttgataagctggatttatgctgattcagaaaactttttgcagaagagagcattgaaaccgtctggcctttgtgtgcaatcgtgactccaaagcccaaagttccaagagctattgtaccaactctggagatgaaattttctgggaaaaacaacaactaaaaatggaaaatactactgatgtacttcagtctgattatggctggaatgaacacctcaagataaaatccagcacgcccttccccacaagatcagattttttagcagccacttttccaagattctctgactctgattttgctattggaggaaaaacccaaatatctacataccctccacaattgatgcaatgatcccttttcttccttttcttacatcaatgcctaacttttcagagacatccaacatctttttgttgttgttcctttcatgacatttccagagagaaacggacagcgcagaatcagaaatgggtaaggtggggtgaaccgataaaaatgcagtgtcctggggaggtcatgagggcacatgggcctgagttacttgctgattctattaaggtaagagaactcctgttttagctcaaggggaatatagtttttagggtttagactgaggaatcattagaagatcattaccctattgctttcttatgaggtcccagaaattgcttctaagatgctgagattttgcacaacaaataaaccaaaaaagagaaattctgccacaaatgttatcatatcaggtgctaccccaaaaataagacatatgaattgaagttactcctgacactggactcagacattctaatactctgtggagagtagtttaaaagaacttcaaaagctggttaactgttagcatgtctatttctcattttgacatattgaactaggaattcttcaaaagttatactgttccttttcttaaaatatgcaaaaatatctaagaacaaagctttagattgtaaattgctccattatactttcattcagtatgatgcgtcaggctaaacgcaagtcttatgaggggtaagtatatggcttgctggacacgtgaattgaactacaagcatgctgcacgcacgtgcggatgcaaacacacacgcaccagcataaacaatgtaaacacaagtggtatattcatgcagtaaaggcagtaacgatctttgatggtagtctcacccaacacttacttaaagacaaaggtagcctggcaagtcccctcaatatgagatctcctgaaccttccatatccctttctttcacatcacaaaccaatctcactttttgcatccactccttaaggttgactcaagagctctttccttggcaactcttgcatatctgctattccacagagctctctccccaagttccagaaccaagcaaggagtcactggatgtctttccctttgacctcaggctataacttcgctgtgacaataacatcgagagctgtgcacatctgggatgctgttctcatggattatgaaatcagcaactcactgaacctcaaggggtctcagtttccccaatgacgagatcatgctaatggcaccagccacctgccaggttatcaggggacttgataacaatgtctgcaaattacaaagagaacccgtgccataaataacaagtcttattaataaaattagttcaagacaagtgccaaaaacaatatagcaatagcagcggcagatcacacttggtcagaacaaaagagggtggagagattttctgatccttattcctactaaaacaattcccctttaatgaaagaataagaatttaattttttctccctaaaacattacttctacccacacaacttcatacaccagtcattacttctttctaacttatctggaggcaacattgtattcactggctggacaatatagcgttgatttcaaagcatgtccaaatattgcctccaattaaattaattgcagctatttaacttctcaggaccaagtggattcaaacctatttgtcacacgaccctcattcctgctgtgccctaaataaacccaaacttcctttgcaacagaatggatctaacagaagacagtgtacaaactggatcatctcctaaccttctaggttgcaagagacaagtaacactttgagaaccaaaccagatttctgttgatttgaggctttggtcttctggccctgtccaagtccaagtcacactcaaacataaatggggcttaatgctacgaatgggcttgatacaatttaaagaccaaaaacaaaacaatgaaatgtgtcttcctctccctgactgctgcccccaatgcaaaagcactttgctgcacatttgaaggacggcatacccagctaagtttcatgaagtctaagggacaggttactgtatccagttcctaaggtacttccccagggtcagcagtggcttcccaggatgaagtcagcagtttgtcccgggctctctgagcggtgctttcccacagatcagtgatgctgttggaaaaggacgacttacggatgcagaggtggaaggggggtaccagcagctgaaccctcaatcaggtccaggcagatgtattcccgatagaacaggctgtcaccactgaccagctcagacttagaaatgtgcctgtctaggttttcagagcaacccctttcatcactatctgtgaggaggattcgaactgaaagaagccagaaacagcagtagcagcgtctccactgggatgctccattcataggggagccagagccgcatccattcatggtggggtcagggagtcctttgcgggcattggttctcgtttctcagcaagctgcacttcccggggggctggcatggctgcatcgttcagaatgaggatgtctattaagaagccgtcgccagagctattattagcacagccatcccttggaaatttcgcagaatacgcctgaatgtacgaacagttactctgctaacagggtactggagaaaaaggcaccaagtcgctcgttacgcacaggcagcccacgcagctttctcggtgcagcaccgggaatcttttctgaattcaacgtgcaccaacatttgagcagctgcctccaatatagaagcactgcatttagccaattttaaatgagcacgtactaaagggggttcccttctgttctcctccccttccgagcgtccgttttctctgcatcaaacttgctgcagccatttggaacgtaaaaagcagtccatcttagcagccccgggcaccggcgatcggctgctggcccccgccacccttgtctgaaacgccctgtcctgcacccaaaggaaagggctcccctggcactctcagaaaatggttttaaaaaaagcctacacagctctgcctaaagccatgtcctttcctatctccccgggtagattcagacagcgtgggactgaggtgcccaaggaaagtaggtgtgtgtgtgccgaggggagggttgcagaagaaagcacagtatgtgccccacgtgggatttgcatttaaaaactgtaacatacgcgaaataaacgactccaggcccccagtaaagaagcagcggcgcgtcccttttccccggcccagcgtgaaaacacggaaggcgaagggctgccgtcagtcgcctccctgccaccgcgaccgggaaacaaagacacattaccttttattttttgcgcttccaagggatccgaggaacttctggctgcaagcggctggtaccccggaacgggcgtcccattcgcccgggcgaaggcccttggcctactaggcggccttggcgcccgcagctggcgagcccccgccccgtccccgccgccgcccccgccgcgggccctcggcgtcagcccatagcccgctcgcgcctctcgcgccgagcctggcccggcgccagtgagccccgccgccggcccgcccctcgcccgcgcccggcccgccgcatggtgcgcccagcgcgccccgagccagtccccggcgcgctgctaggtcgggtgctaggcggccaccgcgcgccaccgccgccgccaccgcccgccgcccgatcctggacaacaatgcgcgcccccgcccccccagaaagccagggacgcccccagtcgccgccagagctggctcggcttcccagcccctctccgtggcacccgcaggcgagacaaagttcgctcccggtgaggctgcgcgcgtccaaagcgtgcgggatgcccagcacggaggtccccaagcgggggacccctggctcccccacaaaacccacccaaagccaccgctcgaggccctctcctaccctgagagcccggagacagcagctcccttggctgaaggcacagctcttacccctcgatctagtccaattgtattgaattttaatctcccctcaactcttcaatggaagttgctgcaggataaccgaggcatgtggctattgtcaaggcttcgcgacaatgactgggagagggagacttccattgcgagagacccggggtaggaaaacgggctgacacgttgtctttccaaaaaagagaaacaaactctgggaagattccccaccaagaacaataactcaattcacagggtatgtctaaatgtttattgcttgaggagctcaatttgctcttagacacattttttttcatgaattgtcaaaacacggtgataaaataaaaggggatgctggcaagagcctccacttagcaaaagccgacttgtttctgggtaaagtctttctctagaatttccaacctgcacccatccactcttcaggggagagactggttttcctcccaccatggttgatctagtacttggtagatctagaaacatcattttccggagaccggtaggctctgaggacttacaaacttcgtaataaaaagaaatcactcacatcctgtcttccaactgactgaaaattatacctttttccagtcacaggtcctgtgttgttttctaaacaacactggtaaaaattttcaacagttcaaaaggcctcaccatcaatagaaagggaattgggcatacagttagcattggagaaaaaagttgaacgctggtgttaaggactacctgttttgtgtttgtttgtttgtttgttatagagacagagtttcactctgtcacccaggctggagtgtgatggtgtgatcacggctcactgtaacctccccgtcctgggctcaagtgatcttcctgcctcagcctcctaagtaactgggactacaggcacaccccaccacacgctgctaatttttgtattttttgtagagacgggatcttgtcatgttgcccaggctggtcttaactacctgtgttatttcaagctgactggagacttgatgatctgaagccaggttcgaatgggattctcaggtacctctctaaagtctgtgaggcgtattccaatgcaaaaccccattttttgataatgcaattggagcccatctccttgtgttctgaggtcctcagagggcatattgtttctttgcacgcagactagttctagtcctgatttgttttgactgcaacacctagtaatggacaatgaggaaatgttcagacctacaacatttttttttctttttttgagacagagtctgtctctgttactcaggctatagtgcagtggcacaatctcggctcactgcagcctcccctcctgggttcaagcgattcttctgccttagcctcccgagtagctgggattacaggcacccaccaccatgcccggctaattttttagtagaggcggggttttgccatgttggccaggctggtcttgaactcctgacctcaggtgatccacccaccttggccacagtgttgggattacaggcgtgagccaccgcacccagctcagacatacatttctcttccaatattttgtttccatccttagaggagttgttgaattttatccacatctacacctcctgctttccgccttggccactgtcatattctgtatgtcctaaactgaacttgcctcactggccaatcctgcctccaggctccctctcctagtaaacagcatgctccctcctcctccccaaagccagaaacagggatagagagctcatttccctccctcctttctctcattcctcacctgatcatggagcctgtcctcataactacctcatgaaaagtcatgagggcagccccttatcccaacagtgcctgaagctgagtgagcaactgctgggcgccaggcatactcaggccacatcatctttcaccaggatgtctccagcagccctgtgaatgggtgctgatcttatctctctcagatgcattctccactccagctggagcgattctcctaaatcccagatctgatcccgtaactttcgctaaaaacctgttcagggcttccctggctttggggacaaaaagtccatattccttctgatggctataaggaccccctggtcatccagtcttatcttttgccacccagccccaccagaaatcgtgtcaccccctaccctccagctacagaaccctcttccagggctccgtatgttccaggtggtcacgcatccgcggatcacccagtagcccaggctggagaaagagctcagctcacatcactgctctgcttaaagactgcgggtggcttctcactgctcctgccacatcctctttgtcttcatcacatattattcacatttcctgcttcctctccctggaaggccaggccctgctccctaccccactctttgggtagctggctcctggtcgtctttcaggttcttactcaaatgctgcctcttagataaccttcggtgaccagcacatggggaatgttttcccccaggtacttaatatatcaccatcctgtttatttttttcttaacacttagccaccatcaggattcacagacctgtgtgaagggcacagactgaagccattctgcctgggcttgaatcttgcctggccacccactagctgtgcaagcttaggcaagtttcttaacctctctgtgcctcagttgagaacactcatctatgaaatggggacaataatattgcctaccttgtagggctgttatgaggattaaacgagttaatatatgtaaagcacttagaacagggtctggctgaataagcataaaccttttggggctttttaaaaaagttgtatttaagttcaggggtacacgtgcaggtttgttgcataggtaaactagcgtcatggaggtttgttgtacaaattattttgtcactgaggtattaagcctattacccattagttatttttccatatcttccccctcctctcaccctctatcctgtgataagccccattgtgtgttgttcccctctatgtgtccatgtgttctcatcgtttagctcccatttataaatgagaacatgcagaatttggtttcttcctatgttagtttgctaaggataatggcctacagctccatccatgtccctgcaaaggatatgatctcattctttttttatggctgcatagtattccatggtgtgtatgtgccatgttttcactgtatccccacaaccagaactagtacctggcacaagatctctttacccctcccaaaaccttttgtgcttgggggcctggactgggaacaaataagaattgaaggaagaaaagctgtattcgaagaatttgaaatactaacagaaataggtcgtgatgactaaaacaccaaaagcaattgcaacaaaattgacaaatgggatctaatccaactaaagagcttctgcacagcaaaagaaactatcatcagagtgaacagacaacctacagaatgggagaaaatttttgcaatctacccatctgacaaaggtccaatatccagaatctacaaggaacttaaacaaatttacaagaaaaaaacaaacaagcccatcagaaagtgggcaaaagatatgaacagacacttctcaaaagaagacatttatgcagccaacaaacatatgaaaaaaatctcgtcatcactggtcatcagagaaatgcaaatcaaaaccacaatgagatgccatctcatgccagttagcatggcgattattaaaaagtcaggaaacaacaggtgctggcgaggctgtggtgaaacaggaatgcttttacgctgttggtgggagtgtaaattagttcaaccattgtggaagacagtgtggcaattcctcaaggatctagaaccaaaaatcccatttgacccagcaatcccattacttggtatatacccaaaggattataaatcattctactataaagacacatgcacatatatgtttattgcagcactatttacaatagcaaagacttagaaccaacccaaatgctaatcaatgatagactggataaagaaaatgtggcacatatacaccatggaatactatgcagctgtaaaaaagaatgagttcatatcctttgcagagacatggatgaagctggaagccatcattctcagcaaactaacacaggaacagaaaaacaaacaccgcatgttctcactcataagtgggagtttaataatgagaacacatggacacagggaggggaacatcacacaccagggcctgtcagggtctgaggggcaaggggagggaaagcattaggacagatacctaatgcatgtggggcttaaaacctagatcatgggttaataggttcagcaaatcaccatggcacagtatacctatgtaacaaacctgcaagttctgcacatgtgtcccagaacttgaagttaaaaaaaaaagaaagaaaagaaataggtcatggtaaaacttgatgaataaaataaaattgaaacttaagttacctggaaatgaaaacataaaaagaaatagatttcctgtttcaccagtggttatccttggaattgacagataaaaagctttgccagtcaaaactccacaatggtctgttccccgaagagcagccgattctaccactgagaattcagtcagctacttgcaaaggtttaatccgtttatgcgtgaggttgcaaatttttgaatttttgcatgaaattcatatatattacctagaaaaattcaaggaacaagaatttgaagagataaaatttttattatgccccattgttcagttaagtggcattccaaaaatggaacactaggcgtaagtggctatgaatcaaagaatattttgcaaagtgctgcttcgctgaccagccctaacatgtagttgtgattaaataatttagagtgcttccattttcagcttgagtttaatacttttcgagactctttctgcaaagagaaacatggcagccgggtttatgggcctttgccttgtgttttgctgtccttgctggagaagaaagaagcagcagaaatacttttctttttgttatttcagtgggtcagcaggatttggagagctgaatacctggggtaacccttgcttctcttacacagactgaaggagctttactttggaaagagctgaactcttaaagagaggagaggtgctctgaggtttggaaatgggggaggtaggaagggatggagaagggtgatagcacccccaaaagaaggaagagagaacatctgtacatgatgggcagatgacacgagaccctatgcctgctgagtgcctcaagagtgggcaggcaacctgatgggccagtgcatggcctgtgagttgggagctaaattctaagatatgtgtcttagaattaaacattataggccttagattataggtacagtggctcaagcctgtaatcccagcactttgggatgccaagcagggtggatcacctgaggccaggagttcaagaccagcctggtcaacatggtgaaaccccgtctctgctaaaaatacaaaaaattagccgggtgtggttgcagctgcctgtgatcccagctactcagaaggctgaggcaggagaattgcttgaacctgggaggcggaggctgcagtgagctgagatccgtcattgcactccagcctgggtgacagacagagactccgactcaaaaaaaaaaaaaaaaaaagctaagatatgtgtcttaggcacagcaaaggatcctggagttcagttaagagggttggagtctggcctcaaaatgaacggccagtccttttgccccaagcaccttagtggcaactctattagattgatgacaagaggctgggtgcggtggctcatgcctgtaatcccagcactttgggaggccaaggtggacggatcacctgaggtcaggagtttgagaccagcctggataacatagtgaaagccagtctctactaaaaatataaaagtcagctgggtgtggtggggcgtgcctgtagtcccagctacttgggaggtggagaattacttgaacccaggaggtggaggttgcagtgagctgagattgtgccactgtactccagtctgggtgacagagagagactccatctcaaaaaaataaaaaaataaaaaattgataacgagaccacttccctgtttagaggtccaaggtggcctgagagagagggaagaggatgcaaattcttgccatcccaatgaatgaggatgtagtcaaatttaattgggtttagagaaataaattaatgtgattttgtgtgtatgcccaaagtgatggagcaaaaattctgtcttctccactaataacaagtgccaggttcttaactctaggatttgagtcacagcttctctgaccagcttggagcatacatgggacaattaagagatgatggcttagctctgatctttgctagggtctcactattggtggagaaagatctctcccactcaagcctttgtgtacttgccgagctgaggacaggagacaaggtaagggaggacctgaagctgggttgtgtaatcctgtccttggagctaataccattgggcagtcttggactccttttccagggcaaccttgaataagcctcttattgaagctgtttctcacctttaaaatgagcctgggagctgggcacagtggctcacacctgtaattccagctctctggagggccgaggtgggaggatcacttgaggctaggaatttgagaccagcctgggctacatagtgagacccctgtctctacaaaaaaaatttaaaaattagctgggtttgcacctgtagtctcagctacttgggaggatgcggtgggaggatcacttgagctcagaagtttgtgatcgcaccactgcactccagcctgggtgacagagcaagaccctgtctataaaataaaataaaataagcctgataatatctattgccagccttatgaagactaggggttcaacacatattgtttccaaaaccacacaactgataatagtgaacaactaacattgtggtgagtatgtactctgtattaggcagtgctagagctttccaaactttaatttaatcatcatgggattcctatgaggtggaaactgttctgtcccttggtgagtatgtactctgtattaggcagtgctagagctttccaaactttaatttaatcatcatgggattcctatgaggtggaaactgttctgtcccttttctacagacaaggaacttgggatgtaaaaaggtgaagtgggccaggtgtggtggctcacacctgtaattccagcactttttctggcaggctgaggtgggacgatagcttcagtccagcagtttgaggctgcagtgagctatgatcataccactgcattccagcctgggtgccagagcgagaccctgtctctatgacaaaaaagaaaatgaagccacatgcctgaggggactctgctgatcagatttgaacccagagtcgtcttttggaggcttgagctcttattgtccatgcttgcctgccacaggctgtacatgtgaaatacactggcggtcacaggcagcatggccacagaattactttgtattcactattaactgtggatggagtcccagttacagcggaagacacctgggaattgataggctcctgtgtcgttccatcagttcctaacctgcaccatatggacatagctttacattccattttctgtgtttatagtgaataacactggcaagttttcctttcatatgtcaagcaggtgttaaaaatgcagagagatccctctggggcaggttaaagtgcttggctggtttcaagtgaatcctattatatttttatacccaatcctttttgcttcctactcccaggtcaattagaggccaattctgagccacttcaatcaaaaagggataattccgtctcctgtcatgtgtggcctgcgatcaagtacttaaaaccagggtccccggggtgtatgaagaaattatccaatggctgtgttttattttgttattttttcaccaacagctctgtcatttgaaataaccaagttttatagttttgttgtgttctcattacattagatagttggttatgatttttcttggctgggaatcatgatttagactgcaactcatggcaacaaaaacccagagcaaggcttcctgaaacacagacaagaatcaatcaaaacatcacaagctaattaaagtaccttggagcccctgggagtacctgtattccagcgagtaccacggtataaaattggttaacattctaagtatactcaagtaccttcggctagctctctccctaaggcttttttgtttatttactcagaaatatgtattaataaaaatagggccgggcatggtggctcatgcctgtaatcccgggactttgggaggtcgaggtgggtggatcaattgaggtcaggagtttgagaccagcctggccaacatggtgaaaccccatctctactaaaaatacaaaaattagccaggcgtgttggcaggtgcctgtaatcccagctactcaggaggctgaggcaggagaattacttgagcctgggaggcagaggttgcagtgagcctagatcacgccactgtactccagcctgggcgacagagcgagattccgtctctaaaataaaataaaataaaataaaataagaaggttaaaacttagttggcatttaccaagtgccaggtactgattatgtgatttacgtataataactcagtcttcgcaacagccctctgagatgggcactattgttaaccccatttataggtgagggaatggaaacacagggagaggtgtgataagccatctcagatcctacagacgagaagtcggccactgccagttaccaaactcaggcagtctgattccagagccggtgctctcaaccctaaggtgtgttcctcaaccctcaggcatggtcgagtattaggtggtattgcgtcccttctcgtgcctagcacaaataattataatttatttattggcccattgcttcactgcaaaaagcagctaaggcagaaatatttgtaaaattgaatggaggctgggtgtggtggctcatgcctgtaatcccagcactttgggaggccagggcaggtggatctgccttgaaccagagatcaggagtttgagaccagcctggccaacatggtgaaacctgtctctacaaaaaatacaaaaattagctgggcatggtggcgggtgcctataatcccagctactcaggaggctgaggcagcagaatctctgagcccaggaggtggaggttgcagtgagctgagatcatgccactgcactccagcatgggcaacagagcgagacttcatctcaaaaaaaaaaaaaaaaagaatggaaaagattttcagcaaatattccttttcctattgtaacatcaattattgtgaaggtttatgtgcaagtgacatcaatctaccaatctctcaagtgagcaataggactatattgaaaggatgggccagagcaggaagtaagagccccgggacctcccagccccagggagaacaggcgagtgagcttctcagagcggggacagggcaggaagctggcccccagtgatgacttgggaggcaatgatttctcctgccaccccatagaagtcagacctactccaaattataatagcaaataatctgttaataaataataatatggttcaggctatcaaatttctaggattctgatttcactaaataagaagataggctatttaattttttgtatatttgtttgttttagagacagggtctcacactgtcatccaggctggagtacagtggcgtgatcatagctcactgtaaccttgaacccctgagctcaagtgatcctcctgtctcagcctcctgagtagctggggctacaggcatgtaccactatacctggctaatttttatttttaaatttttttgtaaagatggggtcttgctatgtggcccaggctggtcttgaactcaagtgatcctcatgccttggcctcccaaagtgttgggattacaggcatgagccagtgtgccagcctaggcttatttgttgagatgggattgggtacaaaaggttaacatttagaaagatctctctgcatggaaaataaaaaagttggagatatctatacatggagggcatttagacttatggaaattgatggttaggcaaaatactggagagagagagagagagagagagagagagagagagtgacagagatgagccaactgagccaacatgagaatcccctggaagaccagtcaaaatagattcctgggctgggcacagtggctcacacctgtaatcccagcaccttgggaggccgaggcaggtggatcacttgaggtcaggagttcaagaccagcctggccaacatggtgaaatcccatctatactaaaacacaaaaaaatagctgggtgtggtggcacacacttgtaatcccagctacttgggaggctgaggcaggaggactgcttgaacccgggaggtggagattgcagtgagccaagatcacgccactgcactccagcctggatgacagagtgagatgcagtctcaaaaaaaaaaaaaaaaaacaacaacaaacaacagattcttgagtgttacccccactcccatttccaacccaggtctctgattcttagcttgggttagggtgtaataatttacatttttaacagattccaaagatattgatcctgctgattggagcttacactcagcacaattttcctacctcttggcttttactgtgctccgggcaccctgttgtctttacgcttgtgctagccccagggcctttgcacttccatctgcttggaaggccctcctccagataccagtaggaatcaagctcttaccttttcaggtccctgctcagatgtacccttattagtgagatcttttctaaccacctttcttaaaaatagcaactcctcccacctgcccacctcctgctccccccgttcctaatccctttcctagtttgtctccattctttcttttgccttctaacagactgtaccatttatttacttagctgtttgttttattacctgtccttcccacgagagcagggatttacgtccatttggctttttgctaaatctcctgagcctagaacagtctttggaacatactaaacattcaatagatatttgttgaggccgtgcatggtggcttatgcctgtaattccagcactttggaaggtgaaggcaggaggatcactctaggccaggagtttgagaccagcctgggcaacatagcaagactccaactctacaaaaaatgtttttaaataaaaattagccaggtgtagtgatgcacgcctgtagtcccagctactcaggaggctgaggcatgaggatcacttgaggccaagagtttgagaccagcctgggcaacatagcaagaccccatctctaaaaaaataaaaataaaaaaaaaatagccagggcgtggtggtgacatgtgcctgtggtcccagctaccctagaggcagaagtgggaagatggtgtgaacccaggtgttggaggctgcagtgagataggaccatgccactacactccagcctgggtgacagcgacagcttgtctcttaaaaaaaaaaattgtctgatgagtgaataaaatgaatgaatggacattcttggatgtagaattgcagtcttaagaacttaattctgatggaaatgcttcctaaccgattgcctccctatctaaaatgaaatataatcgtgtcgctccacttctgaaatatctaaatatctctcacaccccgagtgaagctgaagctccctggcatttgttcatcaccaggcactggtgggggctgggacatgacagtgaacagatgcggaagtggcctttgtccccttttgcctacagtccagttgaaaatagggcctgcctgcctgtctggcctcaccaaccactatttcctgctggcgtttcgcctcccagccaaggagaacgctcctacaggcccctgtgcttcttgccttcttgctttcgcacggccgtacatctgcgcggaaaaccctcccgtcctccctgacacctggttgactcccactcactcttccagctccgctcagacgcctcattccccgggaagccttccccgaggttcccctctcccatgccctaaataacccatgcgcatctctatgctcagcacgttttcatcaccacctttgcatatgtctttatactgctctccgtcaagaattcttcaaagacaggcatcacggcagtgctttgtgttttaataattttcttgtattccagatcctcaaaatgtgttcacctgtacacggtgtatggtatttaatttcactttatcactttcttttagccaagcattgtgatcagaacccaatagatttttatagttaaatccatcctgctaataaaaagcaggggagtcagtgatggtagaaagcagcgtttgtaatcccagcactttggaaagccaaggcaggaggatcacctgaggtcaggagtttgagaccagcctggccaacgtggcgaaaccctgtctctactaaaaaatacaaaaattagccagtgtggtggtggatgcctgcaatcccagctacgcaggaggctgaggcaggagaatcgcttgaacccggaaggcagaggttgcagtgagcggagattgtgccactgcactccagcctgggcgacagagtgagactctatctcaaaaaaaaaaaaaaaaaagaaaagaaaacagcatttgaccagtgttaatacgcaactccttaaaacagttttaaggaaggcagccttccttaaagtctggaactgtgaccactgtttctcataaatgaacaaggaccagtcgcaacactggccccaacaataaagcccacttttttggggatacctgcaatgcattttgaagactcctgaaagcttttgagggggcctaataaaagctcttaataatagagcaggtctagtttctattagatcttgaaatagacatgcttccatctctccctagtctctcctttgtaaactatgaattgttttcatgttggctcttagagatctaaggttcttcctttgttcatgtacttttaacttctttgtgtggttttgggaaggtaggcacagattttttctcaaaagtgaaatcaagttctcagtagaagaggaaatacatagtgaagagaaaggaaagtacctttcaaatcttcagagaatgccccttgtgctctttacaaaggaaattcccttggaaatggttataacctaaactattaatatgatcagctcataataatagtgataataataataatatctactatttgttgagtgccatgcacattacacgcattatctataatttctgtggcaacacaacactgtaggtcttgttaatttccattgtatagattcggaaatggaggctcagaaacactaagtaacttgccaaaagtctgtacctagaaggaagcagatttgtatccaagtcaatttttaagacctccaaagtgcattccgttttttccgtcatggcttaattttgagcaaaaggaggcatgggttgataaagggcttgcagtgcgaagtctcagattggtttctggaggagcggaggggaaccttgaggaaagaattggaagtttaagcgccaaaaatcatgttcagccacagaacatttctgccaccccttgaaatcagaatcatggcacccgagcagagctctgcagacacctggaaatgttctgggtcaacagggccgagccccatgatgaggcataggctgagcctctgcagcccccagtctgggaccttggcatccttcttggtgtgtattagaatgcagctacttatggattctgttgattttcaacgtaaccctcatggcaatcacagtcacatctctgattctgctccttctccctgtgtgactttgaacaggtcagcctgaatcttccagaagggcctttttttatctgtctatatagcaggctgaaactggtgtttaatccactttcctgcccaaagacacagagtgcaataacacagtggtcagcagtacaggctatggtagctgactcctgaggtttgaaccaccaaccaacagcttactagtggtgtaactttaggctaatgagttctaaccttttcttcatctcagattcctactcataggcatgctatgagggttgcattgtgtaatgtataaagagggagtttttggcacagagtacatgttaaataaaatatatgctatggtattatttccattatcagcatccactaagggcgtgaaatctggcagcttttgtctgtatacaataccgtcttctccactatgttagatgtcaatccttggtttgagcctcataggtaactgctgtgagctttaatgagaccccgggtgaattacatcttgtaagttaatcataggaaacagtcttgtcctaaataactgtgccctacattccaattccatccctgtcctctgagtgcaccaagtgtatgctccttgccgagatgttcgccctgctcgtgtgtgaataacttaggagtgaattcaaatgcatttaaatagcccacaacctttcagcaattgagggtgcactgtttgccttcccatgggaatgcccgtcagtcacatctaaaggtgcgtgctctgaacttcagcatttacccctgaggtgttgctgtgtctcatcctcaactgtgtggcgcagtattatccacgcccataggtcaacttctggttccttctaccttctcaggcccttgcagccctacgtcactcagcaagtcagtgacaacactgccgaaaaatgatggagaacccatttcattccattttttaggagttagaactaaaattatattttacatcagaaggtagtctgtagagaaaaatagaaaatgcacctgagttgtctaagtgtgttcttacaaaggaaattcttttggaaatggttataacctaaactatgatcagctaataataacagtaataataataatatctattatctgttgggcggtgatgtgcatattatgtacattatctataatctgcagcaagactgcacagcaggtcttgttaattccaattgtatagatccagaaatcgaggctcaggaacattaagtaacttgccaaaagtctatacctagaaagttgcaatgttcagttcaaagggaaacccacggcgggtcccagatcagacaaaatgaaatgccacaaccgccgattcttacaatacttacaggcaccatgtggctgttgtcttatttgttgagggttcaaggcttgtgtcaacacctccacctgacagacgaggaagtaggcagtaagttcctggcctgcccaatggctcctagtgactctgagggacattcacaatgagaatagacagcctctcactttaggtgatgagcgctgttcactgagagctgtcacctgccaggatcagtggaaagttgctgctagatcaaatatttacacactcataagttgcttcctagtatagtgagttcctcataatacaaaagtacctaaaattctgggtttttaaattttaaagtcacttaaaaaaaaaaaaagcacagataggccgggtgcagtggctcacacctgtaatgccagcactttgggaggccgaggcaggcggatcacctgaggtcaggagttcacgaccagcctggccaacatggtaaaaccccgtctctactaaaaatacaaaattagccaggcatggtggcgggcacctgtaatcccagctactcaggaggctgaggcaggagaatcgcttgaaccctggaggcagaggttgcagtgagccaagatcgtgccactgcactccagcctggacaagaagacggaaactccatctaaaaaaaaaaaaaaaaaaaaaaaaaaggacagaaaatatattagactgctatgtaactaccattaaagttaaacactttatcttctttgcttattgaaagcaagagagagagagcttgctaaagccatgcttctcatcctttttccttccctccccattccctccccagaaggtgatagtctcctacagtaggtctctagcattccctatttgtttctgtcctttgcatatgaatgtagcataagcagtatacactgttttgtgtgtttttcaactttacagaaatgcagctagaacagagttatcttttcccaacttattttccattcaacatcacatttttgagatttatcaatatgagtgtttttgaatttcatccatttattggattccatggtgcaaatataccacaggatgtgtctacgttctccagctgagagacaagttacgtctaagtgttcattatttacaaacagccagggcctttgctcctagcggttcctctgcctgccaagctcctcttccgggaattcattcatttgatgaccttctcaacatgtccacttaatttgctccctcttcttcccatgtttttactcagttatcagtagcattgccagagaaaagacaggaaatccagttaaatttgaatttcagataaacaacaagttcatgtgtagtataagtatacccccaagtgctatgtgggatatacttaccctaacaaaagattcactgattatctaaaatttatgtgggaatcttatatttgtatttgttaaatctgcaactctaattgtgacattctcagtgaggccatcgctgtacagcctagttacagttttagcctcctccccaacacttcctattctttttcactctcttattgttttttcacagcccttatcatcagttttcctgcaatgtatttccttatttattttgctcattacatatctttttcctctggaatgtaagccctttgcaggcaggatttttgttttgtcttctgctatgtgagacacagtatgtgcttaataaatacttgccgagcaaatgaataaatgaatgaaagggtgcaaggactgcctttgtacatgtctcctttgtagtgtgtgagattttctctaggataaacatttggaagtaaaattgctttctgtagggtgtgtgtctttactaggtattgccaatttgctgtctgaagtaattgaacaaatttccgttcccatcagtaacgtataaaagttcccatttcttaacacccacagtacctttctgtctttacctttgcaattgcaataattttgatttttgagtcaacagttgagaccagcatggaaacataagataaccacaaatgaattcaaaataaacagtaattatgaatgcaaaaggtgtcagatgttcttaggtgcttatttaaaagatgagttaattattatggatgtacgaacaattctaaaccatggtgtctcttgtgtaataaaataaacagaaattgcccaaacttaacactgtcgcaatgccatttaaaaactcataataaaaaattttgaagaaaaaccattttatttattttgcaactaaaaaggaggaagtcttgcctaagaaaactaaaatgaaaacccaaacgcaagtggtggagagttctttaagatctgcttcagaattgccagaaacatgcaactcatgtcaaaagagaaaatttgaaaaagtcctttgttatagacatggccaatctcttttaagtccaaaagacgagtttgaggtatataaaaaagcactgtaattaaaggatacaaaaacatggcctattttaatgtgttcttaatacattcttggacagccatgaaatatgttgtgaaacattgtaaaaaatggccactatctctcactccttcctgtttcacggctttgtaatgtgactgtgaagtgatgtctagaagtgaaatctgtttttcttccacttgaatctgggctggtcttctggtttgtcttggccaataaaatgcaggagtgataatatgctagttcaaaatttaagtctccaaaggactttgatgcttcaatttgatctcttggaagactgcctagctgccatgtgaacaagcctggtctaacctgctggaagatgagagcaggtggatcaaagctgaggcagcctagttatctcagcccaggcctcagagaggggagagaacccagctgacatcagcagtgtcatccacttgacttgcaactgaccacagatgcatgagggagaggagaactgccttgctgagccccgcctggattaccaacatatgcaatcatgagctacataaatgctggttattttaagctattatattttgcgatggtttgttacttagcgatggttaactgggacacaggctaacttggttcttcaccctgcagaaagcagatttgttaatttcttcatttacttttcttttgctaaatgtatgctgatgaaaattgttgaatatgttttaatttgcaaaggatttgatgggaaaataactgataaagattttttttccacaaatatgtgagtgttttattgagcacaatatcaactggaaccaataaacaattatgcacacagctggcacccagcaatgacacacagctgcactggaacattttgccccgtgcatgtaccagaaaccacggcatcattcaccaacaccatcctgttaagcctctgggagtttcatgaaaaaaaaaaaaaaaaaaaaaaaaaaaaaaaaaaaaaagtctagtggtttgaaaacttgtcttttaagggaaattattaagaaaatgaaaactgcctctgaaatttgacttcaaaattgtattctaggtatatccttttccttctcagccagggaaagtgctatgtggagttttcaaactcatagatgaattactagttttcttcaaggagaacaaatacaaacaaataaaaatcctgactacagctttgaaaaatccaaataaataacattaatcatgaagagtggctcacaaatcttttttcaaagctgaatttccacagtctaccagggcaaaagaaagctaggaatgttttttcctgcacatgataagatcatttccaaaaaagtaaagctctgcaaatgaatgcaaatgttgatggtgaacaattaatcttttgtaacctcaagttcagttcatattatgaaaattatagtgttggggtaaaaatatagaaaacagcctccattatctcacttcactaaaacggttttagatactcaagaatctaaaagagattgactagcaaatcagagttcattcagttcaccacctgcaaggaaatgcattttttgacattttcacctgcagaagcctaaaaacgggccatagttttgttgtacctcaaggaatctctttttatttttattttggagacagagtcttgctctgttgccccagctggagtgcatggcacaatctcagctcactgcaacctccgcctcccgggttcaagcgattctcatgcctcagcctcctgagtagctgggactacaggcacgtgccacctcgcctggctaattttttgtattttagtagggactgggtttcactgtgttacctagggtggtctcgaactgctgagctcaggtaatccacctgcctcggcctcccaaaccgctaggattagaggtatgagccactgtgcctggcctcaaggaatctctttagtgattctgctggacaagcatacaaagcaaagagaaaatccttttactctgtgcccacatatttatggggtctaggtcctcaaaatactgaagcacccaaacagagaagagaaagtttctagaaactgaatctgacagctacagctttcttcccttttctttaatgcaacccagtttcccaaaatgaatatgcacaatccaaatgcttctcatttttgtttttcctttatttttcctaacagtaaatattttaactttgacaatgaaccctttatattatagaaaagaatgcaaagtttacaaggaatgtaagataaacaatgagactaaaaagcagcttcctacagtagcagtgttggggacaacagcagggatcagggcccttgtgcactgctggtgggactgtgacatggtgtagctactttggaaaacagcctggcagttcctcaaaatgttaaacacagagggaccatgtgacccatgcctgggtatataaccaagagaaatggaaacatatatccacagaaacttgcacatgaatgttcatagtgacattacacataataggcaaaagcaggaagaaactaaatgtccatccgctgatgaacagataagcaaaatgtgatgtatccacataatagaattttttttttttttttttttttttttgagatggagtctcgctctgtcgcccaggctagagtgcagtggcgcgatctcggctcactgcaagctccgcctcccgagttcacgccgttttcctgcctcagcctcctgagtagctgggactacaggcgccaccaccatgcccggctaattttttttgtatttttagtagagacggggtttcaccgtgttagccaggatggtctcgatctcctgactttgtgatccgcctgcctagaatattatttggctgggcgtggtggctcacacctgtaatcccagcagtttgggaggctgaggcgggtagatcacctgaggtcaggagttcgagaccatcctgaccaacatggtgaaaccccatatctactaaaaatacaaaattagctgggtgtggtggtgtgtgcctgtaatcctagctactccggaggttgaggcaggagaacctcttgaactcgggaggcagagtttgcagtgagctgaggtcacaccattgcaccgtagcctgggtaagaagagtaaaactccatttaaaaaaaaaaaaaaaaaggatattattcagaaaagaaatgaagtgctgatacatgccccaacatggatgaaccttggacacattatgctaactgaaacaaatcacttacaaaagaccacatattgtctgagtccactgatatgaaatgtgcagaatagacaaatctatacacagaaaaagtaaatcagtattttcctagggacaaagggatggagttaatgtgtgtggggatgatagcttatgagtacaggatctctttttggggtggtaaagatgttgtaaaattggggcaatggttgcatgactgtgaatatactacaaatcactgaattgcgtactttaatagatgaattgtatggtttgtgaattagatctcaataataacaataaacataagcatcctgctttcattaggccaccatccccaggcttcaggccacgtcttttgatcttctctgccattagggtctttggtgctaaagggatgggagacattcacataagggtccagccacatctcctgaggcacgtgatccgccttcattcatatgacaaacatctactgagctcctgcaacatgccaggacctcagtagatggggtatccttagtaactgtatccttagtactagtagatggggtatccttagtaaatggggtatccttagtcacttagtaactaggactagtactaaggatacagttagtgaacaaaatagactcccaaagtccctgtccctgtactgctgaagttggcattctggtgggggagtttgacaatgaacaaatactaaataagtacatagactatcaggcggatatgagctgtagctcaggatagaggacggggagacgcagaggcctctaagagacaaccatagtgactgggggaagagctgggaggtgaacttggctagcaggtgaggcttgactgcctgtggaccaacacccctctccctccctggaaaggaagcagctgaggtcaaagccctgggcagtcattcagctgtggcctctgctcaagaagaggaaggcgcgggcagatgccttctgttgtctaaagccagggatgcatgttggcctaatttcctctttgggaggattacagggcagagtatgctgtggtttcagtgaaacattttacaaagtttctcatgatctactcaaggtcaagatgaaaacgtatactcttatcataggcagacttctaatgggtaaaataaccatatacaaggaatgtcaatttctgaaataatatatcaagttatgaataacgtatccaatatgctgatgatgagtactagcagtaatactactaccaacactatgataaattaatattattaacaaggtcaataatcagtggcattcaatattattaacaataataacagccgaattctaataagagcttcattgatctctgtgaaccacaggccttttatttttatgtactgataaatacttttattatcccttggttgcatttataaaatccaatttttaaaatgacaaaaacttagcttaaaagcaagattccaacaggccaaagagagactgatggatttaacaatgtggaatgaagatttaaacagaccagctacttacgtgtaggaggagaaaagcagcattaaaaaaacaaaacccatacaacctgaatgttactgacagcaacctgaataggaggctgaagtgtgatgtggtggaccccaaagctcatgcaatattagtatatgaaacaaaccacaagactgggcaacagagtgagaccccatctctacaaaaaataaaaaaaatttgcgcatggcagcgtgtgcctgtaatcacagctactcacgaggctgaggcaggagtattgcgtgagcccatgagttggaggctgcagtgagctaggaatgcaccactgcactccagcctgggcaacagagtgggacctggcctcgaaaacaacaataacaacagcaacaacagcaaaccacaacaaaccacagtgttctcactgggagttaatgggaccgacatattaacaacattatagggagtactgtgttctgtttcatggctacattttaagacagatgtttgcaaatttcatcaaatccaggcgagagcatttaggatgaggaagtgttcaggtccagcttcaatgactgaagggaatggtgatgtctagtccccaaaagaatagctctagcagtgggaaggcgggggctagcgaactggagcacggttttcttcgagattagatgtgttaagtgctggtgcatggaaggaggaccaactaagtggaaagggtcaggaagcggggcttaaaagtgaggctgggctcggtggctcacgcctgtaatcccagcactttgggaggctgaggcgggcggatcacaaggtcaggagatcgagaccatcctggctaacacggtgaaaccccgtctctactaaaaatacaaaaaattagccgggcatggtggtgggtgcctgtagtcccagctactcgggaggctgaggcaggagaatagcatgaacctgggaggcggagcttgcagtgagccgagatcacgccactgcactccagactgggcgacagagtgactctatctcaaaaaaaaaaaaaaaaagtgggcagattttgtggtgactgcacaaagggctttgtgccactcagagctgctacccaaggaggtggctttctggaagcggtgggtgagtgtcctctccctggagtgttcctgcagaggctgggcaccacctgtgctcccgctgcagagggaatccctgctccctgtgggcggttggcctcctgacctctgaggtcccttctggctcttggagtcagggaccaggcacggcgaacaaagagctccagttggggggttggctcaggcactgtggtttcccaacactagtaatttgtattcagagaacaaacacaacattgtctgaattcaccactgctgaaggcacagacttggagaagtcgcaatgatctgcaatggcactgacggcaggtcaactggaactgcaaaatctctcaagatggaagccagtatctcatctatgagccctgctacaccctgtggctgcctgaccgtggctctggctgtgaagtctttaggtttcattctctcttccccaccagggaagggtctcagggagccccgctcagctccatcatctgcctggtcaccgctgtagattgttcactttggctttgcctcccatcttcttccttgggtctatggctggtcctcacactccgaggatcctggatctcacttttcctttgcttctacatctactcttaaggcccagccctgcccattccccttctggattttggggatcccagcccaggtcaaggtctttattgcccttgagcaaaggcccaactagtgtgtagtaatagtgccatttattgactaacatatgccagatgttgaacagtctctatttcacctagtcccataatgacagttcagagcaggtgttatacccattttacagaagaggaacctgaggctccaaggctcagtaacttgcctgaggttccccagtgtgtggtagagctagaattcaaatctctgtttgtagattcaatgtacaatgtagaattcaaatctctctgtaaattcaaatctacatttttctctagtgtctcatgccgatcatgctgacgtcagcacctcactaaaaccataccatattttcagtaaatatgtgttgattatttcttttgtatttgtttgcttgtttttaggagaagaagaaaaacattctactcatttccccccaaaaaagaaagaaacagaagaaaaagataatctcacatggctttgaaataaacagtggccgagcacatttaaaacgaaagctttgtgtgagagaaatctgctttgaggttttatacttggattgttctaagtaggaaaagaattgtctctgtgtgctcaccgaagttttggctctcaaaacagtgttttaaaaaagtttcaatatagcagggatgacatacttcctgataaagattctcatcaccaagaagtggctttagtgtgatgaataccaagtcaggtgacaaattatgcagctcctagctagggtgtgattcggattgacaaacacaggagggataagcatgcggatattaatattgttgggagattctttaattctgcccaattcttctatctggttctatcttaatatccatcacagattttttttttttttttgagatggagactcgctttgtcgcccagtctggagtacagtggcgcaatcttggctcactgcaaactgcaacctccacctcctgggttcacgtgattctcctgcctcaccctcctgagtaactgggattatggtcatgcaccaccatgcccagttaatttttatattttcagtagagatgggatttcaccatgttggccaggctggtcttgaactcctggcctcaagcaatccacctgccttggcctcccaaagtgctgggattacaggtgtgagtcaccatgcccggcccacagattttatttaataatatacacacactgtactttcattctctctagggggtaaacaaacaaatcaaggactgtaaatatcaaacttcagaaaagagtaaccaagcaggacacaaacccaacagctcaccctttctcattccccagttggcagggctggcaccgaaggtccctctctttgcaacacccggcaaaggggacaggaaatctgagccacagttgggcactggcactcacaaggtgcatggccttgggtgagccctttgatcagtttctgctcctcagttttgttgctgatagcacggggagtattaggatctcaaagagctgcaggaaagttcagaggatgtggtgtgggcaagcgcactgtcaactgtaaatcactctacaaaaagtgatcactattaccttagtcaacaggcatttcccagtgcggagaattcagctgacctgctgttgaaaaggagacactccacctaaaactgctttctcttccccagcactgagatttattcttctcctttgttttcattacttcctatattgcatgtttatttatttgtccattgtctgtttccctgtattagaatgtgggtttcttgcaggcctggctttggtctgtttagttctctgttgtatctccagagccttgaacagtgcctggaacatactaggctcaatacaccatttttgaattaatgaatgctaaatgacgtctccagtctaaatgacccccatcttagcccccagctctgatattatgaacaagcagtaaaaatgtcacgtagaattttagaaacttgaactttcaaagcaggatgttagagtggttcatttatttatttatttatttattcattcccttaactaattttcagtcaagtactatgtgcaaagctctaggctctgctacatgtctgttacgaatatcagtcaatacaattttcttttttttgagagagagtctcactctgtcgcccaggctggagtgcagtggtgtgatctcggctcactgcaacctctgccttccggattcaagtgattctcctgcctcagcctcctgagtagctgggattacaggtgtgcaccaccacacctggctaatttttatatttttagtagagatggggttttgccatgttggtcaggctggtctcgaactcctgaccacagtgatccgcctgcctcggcctcccaaaatgctgggattacaggcatgagccatcatgccccgccagtcaatactgttataaaacaaagcaaaatggttttttgtaagaaaaaaaaaaaaagctttcaaatacatatttaaatgacaaatgcccccctaatttcctatttatgcccaaatgattctatctgatgtcttcacagctgatttacaggcatctgtggtctggtggcttctttctagaattaggaagctcatcttaatttccaaagtgacatctagttagatgcctaggggaaggtatcgtatggtccaatttcttccacacttgtttctaaactcattgtaattactggagatgtgggtttcagagagggcatgaataagtacagttgatgtgtaggaaaaaaaaagtctcttagcagaaaaggttaaaaagaaaactcctgctcaagcgccataagttttaaacaagccagttgtccgtgactttgtttatactgcagttgggtattgtttgacttaggaagctgttcagtcatcatggtactaatgagttaataagtaagtagatgcctatattttccaattacgtgccccattttatttctgggtagtaacagtgtgaataatttggcagggcgggtccaagagagaaagaaaacttagaaaaatcttcaaaccttcagaaacatcactggacttaagagtgtagaaaatgcttcatagtgagattatatatacacaaattaaaatgaatttaatgtatataaaattaaattttttaaattaatttgtataggattaaattaattttatataaattaaaatgtagcaattaagtggaggaatacttatttcaaaattctaagtaattcaaaaaattggattaaggccagtcgcggtggctgaagcctgtaatcccagcactttaggaggccgaggtgggcggatcacttgaggttaggagttcgagaccagcctggccaacatggtgaaaccctgtccttactaaaaatacaaaaattagccaggcgtggtggcatgtgcctgtaatcccagccattcgggaggctgaggcaggaggattgcttgaacccaagaggcagaggttgcagtgagctgagattgcaccactgcactccagcctgggtgacagagtcagatcctgtctcaaaaaacaaacaaacaaacaaacacacaaacaaactaacacaattgcatgtgcgcctgacctagcttacataacacaatagggaccatcaaagaagccaattagaacttcagaaactatatcccccaccacagtcctaaatctttcctgtctcttagaaggggagcaagatttttaaagtattaaagggtctacagcaactgagaagagtcatcaggtataaaacaatcacagagccactccaaatctttacgaaaccagttagatggaacaaaaagatccagcatttaacattcctctggcatgtaggcattttttttggcagaagcagaactttggagctactgactcaatgctatcctccccaactccatgtttttgtctccttaggacaatcttgttctcaaaagctatgatgaggttcttgaactgaatgcctttaaggtgtcctttacatcctgcctgtcttcacccagtcctacctgggtattttgaaagtgtgttaaatactttcatccagaatgcagatttttaaggtgattataggaattctttctaggtagtaagaacctacattacaatacaacctttggttgcgtacaaatttgggcattgtgtttttgcaaccaaagtccacagcacttgaattccaccacacacttataggtgaatagtggaaaaccacttgtgtcgaaagggtatttccctgtcattactgcggtgtcagaaattcaacactgtgttctcccatgggaacattctttttagacatgtgtcctgcacttggcttataaaatcattcactattattccaaaattttgtacacatggcatgtttgtttgggcttgaaagccaatttttgtattcaaatctttgcttttattatttttttttaatccttccacttagcatgtgaccagttatacacaggtgcttcaatagtagggtggtaactaacactgaatcaattctcactatgtgccaggcactgcgccacacatgttacctatcataattcacttaatcctatcatccccattttacagatgtcttagtctgttcaggctgctatagcaaaatacatagactgggttctattatgaataatagcaatttatttcccacagttctggaagcccaagatcagggcacgagcaccattggattttggtgagggctcctctttccccttgcagacggctgccttctggctgtgtgcttacatggtagaaaggaaaagggacctctctggggctttttagttttctctctctttttctttctttctttctctctctttctttctctctttctctctctctctctctttctctctttctttcttgacagattctcactctgttacccaggctggagtggagtgtgcaatcatgactcactgaagacttgacctcctggcctcaagtgatcctcccacttcagcctcctaagtagctgggaccacaggcgtgtgccaccatgcttggctaatttttgtatttttgtagagatcaggtctcagtatgttgcccaggctgatctcaaactcctgggctaaagtgatccacctgccttggcctcccgaagtgttggaattataggcatgagccaccatgtctgggctggtgcctcttttataagggtactaataccattcatgagggctcagcacaccctcataacctaatggcctgtcaaaggctccacctcctaatatcaggaccttgggggctaggtttcaacagatgaattttggggaacacaaacattcaggccatagcagcacataaggaatggagtcttggagttagtgagagacggaactgcaattcaaacccagacagtgtggttccagtgctcttacattattttacattgtttcttgtggcaacatttccctccgtgtatgttaagaatttagaaatgttatatggtgactgctagggactaaattgtattcctctcccctaaatttatatgttgaagtcctaacctccaatgtgatggtttttggagaggaggcctttggtaggcgattaggtgtagatgagttctaagggtggagcctgcatgttgagactagagcccttagaagaggaagaagagagatcagagctttctgtctctgccacctgaggacacagcaagaaggtggccgtctgcaagccaggaagagagccctcatcaggaatggaatctgctggcatcttgatcttggacttccagcctgcagcacagtgagaaataaatgtctgttggttaagccactcagtctatggtattttgttattgcagccccagctcatgatgacagtgacaattcatctgtctatcccttacattggtgataatcagtgaagaattaaaaaaaaaaaatagaaggtactacgtaaataaagacaggcaatggtctttaagatcaatgtcagtacatgtattatggcaagtattaaatgatcttatacagccagaaaatatatgtggtctaactcttattttataaaagaaagtaaaacacaaagaggttaaatgactggtttaaggtcatgtaaaagtacatagaagtagtatacaggtggtttatttttttagattacaggtgattattttctagctatgaggtaagtgcagtctgctctaaaaataaaaagctctcctcctgctcaaacctctacttgaactagagggcaaaattcctgctttattattctaatgacaagatcatactgcttctgactagaaaatgccaaaacaggagacaaaattagcatcgtatggtgccagttaaaaattatttagaaacccacaagttctgtgctttgtaaatttttttttctctctctaggacatagtagagctgaatcattacaatgaggcatgtgacagaaatgttgactatttctgccatgtctgtctatttatgacttcttcagactacagtaattgtctgcaataaatagactgtattcaaatggcaggattgatttgccattcaggattataagcaactgtgagtagttcattctttggttaaattatgcttgtaagaagtgagaaaatgggatgagaaaaaaatgtgctcagtccataatgataacctagggtaatcatgtattttcctgaaggaagtaataaggaacacacaccttggacacacaataaacagcatggtgggaaaccctagagtggatggtctgtatcgagtgaggttttccagggcaatgttattcaaaaatctctgtctctttgtttgaatcttagaagcatcaatatatgtttccttgaagatgatgtttaaggccaaatccctttcatctaaggagaatctacagtgtatatgtaaataaacagctttcttcttcaggtgtcaacaaaacccatgaccgttatgatgtcaaggaactaaagcacccgacctccatacaagtgttcctgagtgcgacattttctccttccaaactactagtaccacaactttagacttaggctctgtgggcaggtcccttatctgatgaaagaggaaacaatgcttctgctcacacatgtgtgcacatacgtacacacacataaaccgggtatgttagcacagcatcatgtatatgctatgatacatttattctaatcggcaaatggcccaaacctatgtttaccataaggtttcatcactttttttaaagaacagctataccacatgtaatgcctcacaccgagttcaaggtctgctaaaaatcagacttttttttaaaacctggactattgtaaaggtaggccacgtttatcttatacataagcagttgatctttaagatatttcatcttattggtgctagctagtcctaacagattgctaaagaattcactgatgcaaagaagcatggttgagtctctgtgatgtgccagccctggggaggaatggagaggtgaacatggcaccaccctgttttcaaggttggcacagtattgaaggggagatagacaaaataaacctgcaagtcacaaagcaatgtaatgatagaggcagcatgtgccacatgtcaatgacaaaccatgtgagagggatcaaccatcaggttggggtgggccgtggctaggggagaggcagtggaggctgcaattcagctgcgcatctaaagttaagaagaagctttttaagatcttgaagctgttattccccacttttatactatgtgcccatctcatggacatgctgtctctgttgcccaatgagggaatggctaaaaatgactcaggctgtggaacatggcctccttcagtctattgtccatgccatggcctgagtaatcctttaaaatcgtaagccagatcacattacactccagctgaagttcctccaatgacttctcatctaattaagagtaaaagccaaagtgcatgggccagcctaaaaaatcaacattatttggaaatctcctttctaccccatcttatctccgcctacttttcttctcgttcctttttttttttcccagtcatcagaaaagccatgctcccacctctaggccaccacacttaccgttccctctgcctgggactctcttcccccagatagcatctcttgccataaaggaaggacttctctcagggagaagcagtccctgaccactcagtcaaaaccacattcttttcacattactctccatcctcctagactattttatttttcttcatgatgttacttatcatctgacacagtacagattttatatttgttcatttcctgtctaccctaagtcctcttaaaatggaactttcctgagcatgggcacggacatgttttattctcggcgttatccctgatgtttagaagagtacctgtcatagtgtgttcagcagacatctgttgaaagaatgacttccagcactttgggaggccgaagcgggcggatcatgaggtcaggagttcgagaccagcctggccaacatggtgaaaccccgtctctactaaaaatacaaaaaattagctaggcgtggtggcgggcgcctgtaatcccagctgctcaggaggctgaggcaggagaatcacttgaacctgggaggcggaggttgcagtgagccgagattgcaccactgcactccagctctggtgacagtgcgagactccgtgtaaaaaaaaaaaaaaaaaaaagaatgacttaagagagaatgcaactggagcatttcttcattaatacaggctgcaattgtggtggcacaatgggcaagatctgcacttacttctttcaaggaagagatatcacagggatggtggggttatcccactcctgatcagaatttagattcactgactgcaccaatggtggggcttgatcttgaccactgggccaaaacagatggagatatacattaaacaaagaattccctctaatcaccacttctattatcaatcaaaagtatttgtatatttacttttgtgtacaaaaatttaacctcctgaatgtgatcgctttatcttctgttcttggtcattcaaaccactttcccagaaaaatttaattgcacaaaaggcagcatgcaaatgctctttaattttagtttctgttccttctttaaaatccattttcagtgtaacaatatcgggcccagtgaaagtttctattgtagtgaaacgctttttttttttttttttttttttttttttttttttgagatggagtctcactccgttgcccaggctggagtgcggtggcgtgatctcggctcactgcaacttccgcctcccaggttcaagcaattctcctgcctcagcctcctcaggagctgggactacaggcacgcaccaccacgcctgaataattttttgtaattttagtagagacagggtttcaccgtgttagccaggatggtctagatctcctgacctcgtgatctgcccacctcggcctcccagagtgctgggattacaggggtgagccactgcacctggctcttttttttttttttttttagtataaaatttccctttacctcatgcaatttcaagttatcaatcagtacatttatatgattgattgaatttggtgtgtgctaaaaatttgctgctcaaggaaatcaactttttatttctcctattaggcgtctgttcatcgtgtgtggttcaaggaggaaattcgtggctgcagagatttgaaaaccacagacgaggggaatatattcaacccagttttgacctgtttctgcttctgtatattgtgcattaactagaagtgatgtgaagaaatggaacagaagagaaaatgaggctgtgtattggaaaacatttgtcagcctgccctggccaactgtgaacacagattcctagaagaatcagtgaaaatctcatcactggggttatttgcagccagactggtccagatagttgagattttactgtagggagtgattgtttctggaccccttaaggcctgggagaaggaggagtgatgatgatctcattgtctattcccttttgtgatgggtattgattagtgccaagccaataaccaaggcaattccagtccataataaaaagcaacacaacagcagtcccaatgatcagtcagcaatttggaagccaaaggcaaagataagaagcctgctagagatttacttgcaggctttataatgtcatctccttcaaacactagcagaaagcacagtatttccttttggtccaccagctgctgttgaaacagagttttgattgtagtaagacaggacatttgtttcactcagggctcactgaccatgctggtcttcatgttttctacttaagacagtgtccttatacaagcaaataagaaaaatgtgccctacacgacaatgtacaaggatacacagaatgaacagagccaagacgcctaaaagacccacatacttttagagcagaaaaataaattccactgagggtcacttctggaatttctatctttattcctacagattggatttcccacctttccgaagaaggtaacatggtcaagttcttccaagtcctaagagtccaacccaagccttcatttaagttttcagtttagagaccaggtgtggtggctcacgtctataatcccagccctttgggaggctgaggcgggcagatcacttgaggtcaggacttgaagaccagcctggccaacatggtaaaacctcatctctactaaaaatacagaaaaaattagctgggcgtggtggcacacacctgtaatcccagctactggggaggtggaggcaggagaatcgcttgaacccgggaggcagaggttggagctgagatcgtgccactgcactacagcctgagtgacaaagcaagactccgtctcaaaaaaaaagaaaaaaaaaattcggttgagaatgaagcccagtgtcatcatttgctcccctaacatgtaaaaccatctatgtagaaaaactgattctactataatagaaatgttttctagaacctagactcctctaaactcatggctgcccatgaatcagtgcttgaagattgatttttacagcttactgaatcatatattggtatctgatttttcttacagcactcaagaagttaagaattttctatttcaattggattcaagtggtttctgccttttctcagggtacaagttctacaaggagctgggagataattttaaaatagccaaaaaataccctttgcatgaggaaacgatcagaacgagagtctagttatttccattaggctgtcctcttccacaagtgatgctagcatgatagtaaatgccagaactataaattctataaatgtgtagagactgtccatacagaagagaaggccatcatttcataacaacatatggaaagtaaacacaacttgatctttagattttaaagtagttggcagtgttggaaattcaagaaacttgagttcatttggagcaagtaagttaagatggagctcataagaaatgtaacagatttttttccttgatattatttttagagtccattttcagaattcaactgaattgtatttagaatttaaaattatagctcaatgatccatttttaaaaagagaaattcagctgggaggaaaaggatagttatacttaacataccttttttttttttttttttttctgagacagggtctcactctattgctgaggctggagtgcagtggtgcaatcttggctccttgcagtcttgacctcccaggctcaagcaatcctcctacctcagcctcccaagtagttgggactataggtgcatttcaccatgcatagccaactttttaaatgttttgcatagaagaagtcttgctacgttgcctaggctcgtctccaactcccgggctcaagcaatccgctcacctcggtctcccaaagtgctgaaaggcccagccttacttaacatatctttagctggatttttttttttgttttaagtagaagagaaaaacaaactctgagcaaaccaagtttgtttttctcttctacttaaagaaaaaatcctaaactctgaattctaattaatgaaaattaaattatttacacaagtatttggattggcatttatatcctggcaaatgatctacatgcacattttttaaagccgtgggattaaaaagataaagacccttactagaagactagcagttggttttttaacttagctgctctgtttcatttctttttacagtcagtgataaatggagatcatatattctccttaatggcctgttcgtgatttggcattgtgctaaggctggctggcagtggctctgaggatatgtgggggtgtccctgggcaggagaggagatactgctgaaagtcatgccccatcccttttccctctgccccagtgctaggggctggctgggccactcagccagcacagacggcccagtgggcacaagttacaggggacttcttccagcttcctttttcctctcccttcctgcctgttcagagacgtgcaacagagtaatgagaaggaggaggcctccttgaaataatgtcacatggaattctcagtttaataaggcctccagtttgttccaaacatgcttgagcatttggtggcatattagaaattgatctgaaagtaaccggacacgcttggcacccttttctttttgcgccaaaccattttgttattctcatgttttatttccttattatttgtaagcgtgtttggctgcacagcaagccacacattatttgtgggatggtagcctgcaggagttttttatttttaaattaagctgccacttgacatataaaatgtaaattttccataatcatatcatcacagtgacagttccatgtttcataatttgtgcaggctccattctctttctgcatggaatgcttagcagccagtctggagaacttgccgtgtgttctccaggctgagtccttgctgaagaccaccctgagctggaggtacagcgtgctacctggacaccctttgtgtccacctggcaggtgcagagctgcccgcctactacgccctgggtcacctgcttacccgagtgctgcaccttgaaggtttgccatggtagagcctggtgggggagcagtgttgtcccttccagagtgaaaaccaacttatgaagataagaaccaacatcacctctggaaggaaaatccagaacaactggtttaaaacctggaatttaggcttattttgccacctgaaaaaattgggggacagtagggagggaacagcactccccaaagctggaggcctagtttctattagcggttctaagtcattcccgaatattaacttaggcaaaatatttataactttcagtatttcagttctcagcaggcaacatggcagtaggctgtagtggtagagatgggatctgcggtcagagtctgttgtgagtttgaatcttagctgtgctacttactagtgctatgatggaggcaaattaacttgaactttctttgtgtcagtttgctcatctatcaaatgggcataaatactctcataaggttgctgtgaagattaaattagatattccatgaaaatcatacagcaaagagccaggtacataataaacatgcaataaatattaaccaaaaggattataataattattattcagtgccaggacatggagtgagaattaacaattttctctccaagaaaaaaaatacatttaatttccagacaggagggatatgtaacaataacaccctatttcaaacttggtgagaagatggagatgacttcactcatgcagagaactatgtatttgtggaggacttccagcttgcaatccccataggctcagccgggtctgcacaggactgaatgaggctctacctccttcactcactacgccctgctttcatcaaaggcgttcactgcatttagtggcttgtgtggttttggctcagaatggtaataaagaggtgacgagtgacaagagagggctcctgctactctctggcttctccgttaagcgtctgataatgctggtctctgcctgataagccgcaggggttacttgtcctgcgtgagcctttcaaggagtcagaaaggaaacctcagctctgcagacccattgatggccgcggaggctcagggacatgcctagggattgtttttgaatgagatatggtttgtccctgtggtgttgaaaatgattctctctaatctactgtaaaacccagtcccatgcaaagagtgtcactgccagacgttcccgaagggtctggggggaaacagacagatacagggactgcagctttaggagaaaacgtcgtttgagggaaagaatgcttaaataggaatataacagtgtagaattaagaataaaaaggcaaaagagcctttaattgctatagaatcccagagcagtggttcttaacctaaattatactgttatttagaaagatttataaaattttagcttatttgttaatttttttttaagtcggtgtcttgctctgttgcccagtttggagtgcagtggtgccatcacagcttactgcagccccaaaatcctggactcagaagatcctcctccctcagcctcctgtgtagctgggactacaggtgcacaccaccgtacctagctaatgtttagaaactttctgtatagatgagatatctctatgttgcccaggctggtctcaaactcctagcctcaagcgatcctctcacttcagcctcccaaagcctttggcctaaaatgttaacttttctgatgtaaggtgttgagccataaagaggtcagggggaagaggagattagagatggtttaacccaccaatatgtttccaggaaaggaagctgattctgaagagactcagtgagttgcccaaagtcccagagctaagtcaaggccaaggcagaaccagaatccactgacctccagctctagggctgttatgtattcccccacctaccccttctggactgtatgactctagctagcaagagctgcagttttagcactggccaaatccattctttttctaggcttcatccattgctgtgccccccgaggacccttgtaccaatgaccatggtttctgatgagttcctctgcatcctccacatctcagagtggagatttcactgttcattccccaggaaagaccttcctgactcccagggctaggttggctgctactaccctgtgcagtaaagcctttgctctatcccctatccctgcacatctcacgtggggtgtaactgccttttcttgagggagttaaaaaacatgcaattaaggttgggtgtgatggctcatgcttgtaatcccagcactttgggaggccacggtgggcagatcacctgaagtcaggagtttgagaccagcctggccaacatggcaaaatctcatctttactaaaaaaaaaaaaaaaaaatagaaaatagctgggtgtgtctgtgtgtgcctataatcccaggtacttgggaggctgaggcaggagaatcgcttgaacccgggaggtggaggttgcaataagccacgattgtgccactgcactccagcctgggcaatagagcaagactctgtctcaaaaaccaaccaaccaaccaaccaaccaacaaaccaaccaaccaacccccttctacacaattaattagaaacataaagatgaagaattaagaaaggataaggcaaatggcctctttcattcccacagaatcgtagagatgtattaccaacccaaattctattgctccctgagaaaacatttttgtccagacccattgaccaagtctaagttttgcagaagcaataacctggtcctctgctttgtccttggttcctttagaatctagcacagtaagtggctcatagaaggtgctcaacaaatgtttgttcaatgaaagttgaatgagtgctttaatgttagctaactaacattaacatgggtcatgtcctctctgtggcttttcttcttccagctcaacatctccatttttttctgcttctcatagacagtgtctagagtcttcatctcctgaaagccccttctggacaaactccaggtttccaggtctgtttagctggtgactttgcagatgccacaccttgttccatgaggagaaggcggggcagtctctcttgctcctcctaggagtctctgtatttctaaggaagtgacttacaattgtgttgccttccttaatcaccagccaatactgttggttcattttcaacttatacccattcaaggctatgctgtatgtttagaagggactactccctgggacttacagtctctttgagtaagttataatagtaacaacacccataaaatgatagtgaatgatgatgtcttaatatacaggtgtgtgattactccaaaaagtaattgattttattcattataattaaaaaatagcccaagcacaataacccaatgtgggttattgttgagccaatcaacactttcttccccctacaaccatgcttgactagcttaaaaaaatatttctgaaaggctgggtgcggtagctcaagcctgttatcccagcactttgggaggctgaggcgggtggatcacctgagctgaggatttcgagaccatcctggccaacatggtgaaactctgtctctactaaatatataaaaattagtcaggcgtggtggcagtcatctgtaatcccagctgctcgggagactgaggcaggagaattgcttgatcctgtgaggcagaggttgcagtgaactgagattgtgccatttcactacagcctggacaagagcaaaactctgtctcaaaaaaaaaaaattcttactaaggcaggaaaatagggtctggaggcagggaacataaagcggatgaacacttcagctatgacaggaaatgtcttttcatagggtgtacaccgagtaaatgactttgtaacttacttcatcctcttcgtttacatagggcatacaccaagtaaccaatggaatcgtctggaaggtatttaaatccccacaaattctgtaacgaggcccttgagcccctatgcttgggccgttcccacactgtggagtataatttcattttcaataaatcccttcattccttccttgcttgtttatgcgttttgtcccattgtttgttcaagatgccaagaacctggccaccctccaccagtaacattactacatttgaaagaatgaagggtttcaaaattttgtccgtgacaggggtcactctatcccactggcatagtgagtgtgtgaacaggggaacaagatgtgttttacagtcagtttcatccacattcaagcatttcttttccagattttcaacataagaagttttgttgtttttgttgatattttgggtagtggtggccaatgtctgttgcctctctcctgtatctctgcccctagaggcccctgggacacagatagaaaggaagcagcttccccaaggacttggacagcagacaagctggctaggggagcagggggcaggtggtgaaacaggggaaaagctcatttctatgacccatcagggaagctgaacaaaatctagaaatgtcaccaggataactgcatagggagatacagcatccttgacagctctataactattatgcagaaaatagcaacagcagaatcaactaaggttgtaaaggaacattgaaaccattatgaatggagatctaaaagaagtgatcagaaaagcactacaggatttggcaagcaccctggaaaaaatataggagctctatgcctaaaacacattgactatgacagcattaagggtggtgaggaacatagaaggagccttggaaaggacaagaaagtgctttgttttagagacatagttttcttaattcttatcatacctcactcaaatgatgcctagaacagggaacaggttctagtgaggtgtagacaatctagattcacagagaaaactattattttttgcatgaggacatcagaatttagagaaaagtctgaactcttttcctccacaaatgtctacggatccacttcattcactgaattcttggaagcgcaagcttaattttatagctgaaaaagcaggggctcaaagtgtcctagtcattcattttaaaactttttttttttttaaatggagatgctggctgtcctttcacattcattaaccaaaagaaaaagagaagcaaactttgcagggtaatcccacttatatccttgttgacgaagactgaaggttccttagggcctaagtttttcactccacaattgctgcagtaaaaatggctggtccttttgctctcgatctcttgcagggagagcaacatttttacataaatagccttacgttagaatgctaaattatattttggtttcatttcagataaactagaaatggaacacatgataattacctagtaaaaaattcaatatcaggttatgaagagaaccatgtgttgcagtcccttgggcttctataacaaaatgccttagactgggtaatttataaacattagaaatttattgctaacagttctgggggctgggaagtccaagatcaaggtgctggtagctttggcgtcaggtgaggcctctgtctgcttcataaatggcactttcttgttgtgttcttacatgccagaagggtaaggcggctctctagggcctcttttacaagagcactcatctcattcacgagggcagaatcccgttcatgaattttggggggacacaaacatttaggccataaaaccatgaaaatccaagattagagcagcagtcctcattttagaactgaaaacaaatgggctgggtgtggtggctcatgcctgtaatcccagcactttggtaggctgagcaggcggatcacctgaggtcaggagtttgagaccagcctggccaacataatgaaaccctgtctctactaaaaatacaaaaactagccatgtgtggtggtgcacacctgcaatcccagctacttaggaggctgaggcaggagaattccttgaatctgggaggaggaggttgcagtcagccaagatcatgctattgcactattgcactctagcctgtgtgacaagagtgcaactccatctcaaaaaaaaaaaaaaaaaaaaaaaaaaaaagttgttaccaaatgatcaacgattttccagaaaatcccaggacaatctgccaatctgccaatatgttaggtaaaaatattgttgtatatggtgtgccttgttttccagaaaactgataaagacaagtttatcatctctgatatttatttttcagtggtgacgtgaagcaaggccagaaagcagggaacagcctctaggagcccttttttcagcacctgcgatgtgccagggctgtgttgtgctctttccacttactctcatgttggactctcctatcagccctggcagcttagatactcctatcctccttcctactaaaaagaaactgaggctcaaaaagctacatgaattccctcaaaacatgccttctgcaagtagaaaaagcaagactcaaacccaagtctgtctaactctagaatctgtgtgctttccattgcatcaggttgccctgaccaggatgtgtctctctcctttgtcccccttcagctgccatggtagatttgtataactaaagggaaatgtgtttggcacaagagggatttctttagattctcttttgtcccagacactgaatcagatatggactcagttacactgaacaagatgtaagatcttatattgaataagataaacaaaagtggatataattcttaccctttaggtgctggcacacaagtaaccataagacagatgtgtataatccaggaaagcttcctggaggagtcagagtatgatcttaggggaaagtaaagagcttcaactggactcctggtttcatgcagcacggtagtcatcactctaagtcatcaacaggtgctgcagtgccaaaaatggctagagtctgaggtcccagttctgccaccaaactcttcggaccagtctcctattcatcttgggtggactgaaaagaatggctctttgctataggctgaatgtgctcctccaaaattcctatattggaatcctcaatcccaaggtgatgatattaggatggagagactttgggaggtgattaggtcatgagggtgaagcctcatgaatgagattagtgtcctcataagagacagaccccagaatctccctcaccccttctgccatgtgaggacacaaagagaagactgctgtctatgaaccaagaagtgagcccctttcatacaccaaatctacccccaccttgatcttggacttcacaggccctagaatggtagggaatatatttctgttgtttatgaggcatctagtctatgggattctattatacaagcctgaatagatgaagaccctcttccttgcaaatgaaggggtgagccaaggatgcttgggttgctttgtgtctcagagatttaagattctatattctacattgattttttaaaaaactcctcattttgttacactttcatcacttacatggcacactcgtgttaactaagcttttccccttaaataaatagtcttgacatttctttctgttgcttctgatccacttactagaagctgctgcggtctcagctgccaggaacaaggcaggcatgcattgcccttctggctgggctcaccaaaggagccttgagttctcagcaatgtggaaatactcctgacagcaaagggagggttgcaaatgttctctgggggtgacatttctgcaaaccttttgttgggcaatcccctttctccccagaaagcatcaaatgcatgctatccccagaagctacatgtctttagaaagaggaaagaataacactccttcaataacagcaaccctcaggtgggtggtgaaggatctcactctctgattacagtggtgcttcctggaagacctgaaataactgtccgcatggagaagtactcagagaagcagaaagggtcagcagatgaactaaaaaacaactttatgagcagatacctaagagttaacgtttcatgttgtagaagtcaaaactacaactcccgtcaccaacccaacgcccagcctttaaatgttttacctatacttacagcggtgttcctttaaatatgatcaccgataaagaggggtgccttttaggtttagacccgcctcaaattgagtaacaaatcagctctttcacactcaggctgcgttttggttaactgcagcagtgatgttcattatccttcgtgagtaagccctgaggctctttgggcatcagtgctcataaattaatatttatgatgaagattaataaaactgaaatgaaaaaaagggacttaaaattaaaatttaaaaagctcttcaatctctaaatccatttccagtgagagggatggaagaacagttagtaccacgtgtgttcgcaagcatttatcagtagacaaatctcttaattgtaaccattatattgtgaacgatccactaatccttcaatttcattcttcactgtttctcatttaagcaattcttgcattttttctatgcctagttcctcagttaaagaaggaaaataaacttcttgtgaaaaaatttacttttcctttgtattcttatatacccacatgcttttctgtttatcctttttgttaaatatgaaagaaactgaataaaaagtctgaaaaaggaatttaagagaaacctgtgctatttatttgcccctaaaccaccactacagataatcttctaatttttaaagaccttcaaataatagaatagcattgaatgcatttcattattaagcactctcagtattagaagttttccttgtgttcagaaagcattcttgttgtgttttttgttgttgctgtttgtttgtttgtttgtttgtttttgagacacagtcttgttctgttgcccaggctggagtgcagtggcatgatctcggctcactgaaacctctgccccccgggttcaagcgattctcacacctcagcctcccgaatacctaggactacaagcgcacaccaacatgcctggctaattttttgtatttttagtagagatggggtttcgccatgttgcccagggtggtctcaaactcctgagctcaggcaatccatccacctcaacctcctaaagtgctaggattgtaggcatgagccactgtgcccagactcttattgtggttttatatgaactactttttgctctgttcttctattgcctcaatagagtatactattacatttttatccagcacaaaatcctggcaaagctttatacagggcacagaagggttaacagtgatcctccactaggggtgattttgcacctctgctctccagccagtggaggacatttggcaacatcaggagatatgtttgattgtcacaacatggaaggtgctaccagcatcagttggtagaggccagggatgctgttaaacatcctggaatgcccagagcaacaccgtcctccccaacctccaacagagaaagacctggtcccaaatgtcaatagtaccaagtaccaatagtccaaggcaacatcatgagatatgtttgattgtcacaacctggaaggcgctaccagcatcggttgatagaggccagggatgctgttaaacgtcctagaattcccagaatagcaccatcctccccaccctccagcagagaatgatctggtctgaaaagtcaatagtaccaagattgagaaacccgagggttaagaggaagtggcagctacacggtaaggcaagaccattgaaacagctgcagggaattcaacgccagtaccaaccgtatggttcacattattctaaattgcctgggattaatcaatgtagggtgagattagggagtgaaaccatcctggagagcgtttaaggttttgaaaattgttaaccacatgattttagttatattttggatctactttttattttatggtgagattaccaatgcaattttcctctatttttcataaggtaaaagctgtaatgcattatttgggaattctaatttttcaggaagcattttagcttggccagcataactgccaatgcttgacatgcttccctggcataatgagtgggatttatttgtaatataaacttctgattggctagttcctggctctttagaaactgccacatttttgagggttgtactttcccaacattaatatgagagtttgaatgttattttttcctccagaaaaatgtccatatgtcaaaggtcaatgatataaaagtattctaatttaatagcaggcatgactaaatatagaatggaacaaaatcctggaattactttgcagagccaacaacaacaagaataatcagtactgcacagtgaccccctctcagacaacttctggatgtgccacatttcttttcaacagggctgccacaagggaagtcagtatctagtctttgttaaatcagatttcccattctggcagcaaaaaggttttcccatctcatcaccttagttggaaaacaaagctcactgtcctgatagttgaagttgctttctaaagtgcaaagggatacacatttgtaaggtgtattaaggtatttgtttccaattatttggccatgcaaacagcgcagctctttgattgaaataaatgtgagaaaacaacttaatacttgttgaagtccggtccaccatgagccatttggctttatgggttaggaagtgagaaacattgctacagcccatgagtacttggggaaactgaagggcacaaaccctttcagtttccccaagtactcatggagtgaagtcatgtttctcagtacgtgcttccttgggggtctgacaatgcttcactcagagcagcgtcaactgaggccaaggtcatgggttgacttcttcaaggtcacagattggcttttcccatgggcagtcaacttcttcaaggcctgtggtcaaatccagccctcctcacctttcctcactctccatttaggaatatgtcaactgttgcagtgtaaggggctagaatgtgaggtctttcctactgtctacttccatgagaggacagcagtcaatgttgtgttgatttcatactcaaaagacaggagtctacatttaattggatgccatacatgttatttcttgtcctattaaaaatatggtcttgtattaaaattagatttctgaataatgcctatgtataggcctgagggtatttctccatctcaacctccgtgctatgagcctgcaacaggaatggcgctatcactgcttcttcacacaaggttaactctcttactaagtggattctgaaaggattgaggaattgaggctgacccgggtagtgatgggatgagaatgtcaagagaagatgtccttgggtggacaacagcatcttgatagagcttccattttatctttccaagcagcccaatactgttttcttatctatagattcatggaaggttacagctcagaaatgtctttacgatttcctagtccaaccctccggtaaaccatgggccagagtggttgtgtcaaccaatgatcacacagctggtcagtggccaggctaggattcattctctactctctggtgctactgactataaaggaagaagcaggatgggaagattctaatgaactcagaaagaggacggggaaagagagcaaggattgaaatcctagtatccgagaaccatgggacttgaaagggtccaatttagttaaatgcaaatcgtgtgatatggtttggctgtgtccccacccaaatctcatcttgaattgtagctcccataattcccaggtgttgtgggagggacctagtgggagataatggaatcatggaggcggtttcctccatactgttctcatggtagtgaataagtctcacaagatctgatggttttataaggggaaaccccttttgcttggctcccattctctcttgtctgctgccatataagacatgccttctgccttccaccatgattgtgatgcctcctcagccacatggaactatgatccattaaacttctttttctttataagttacccagtctggggtatgtctttatcagcagcgtgtaaacggactaatacagtgtgtatgcaaagccaaacatataacattactttgtcaaaaaatggcagcccaaggaactatgaaggctcaaaaagcaaagcaaaacaaaacagggtaagagaagagtctcagatcgtagacaccaggcaggttaactagaggagctttggtgctacttggaggcttgagctgatagaattatacttacagttaggatttgtgcttgccctcagacagaagggcaggccaggcctgactgtacacctatcatttcaacagtctacaggacacatggctggcattttgctaaacaaggctcctaaaaaaggtgtgaatggcttccctgacatcactttacatggatctctgaattttgcacaaaaacagaaagtcttagagagaaggtggccacagcctcctagctggccctggaatggagtgaggcctctcttttctactatattggtaagatctgttttacattttaccctggtctggaactgccctgagtctgggaggtgcccatatgagggaagcacatggtggaccacagcagaaaagccacagggtcttccagagcggtcactccagctaccctccttggtgtgggaaggtgtggttttctgaagacaccgcgccctgttccaggcccttaatggtgtcaagttttcatggaggtttctttgtgatggagggaccctatcctttctcatgtctgaaaactgctctgccacagggtaaatgattcagaaagtttctgattcagccacaaatgaaactggggaagcctcattaaaggcactaatgagcgctccctttcatcgcaggcactgtcttgacatctccatagatgtctctgcaatgatgggcccctccctgtgtactgcctgggagagcagccagggcgaacctgcaatgggggctgagctctgtgaacaaaagaagcctcccttctgaaaggcaagcccaagttgaagtcatcagacagagataactgagctacgggccctcaaggctacactggagcaggtctgaggccagcccagactcttgtcattagaacagtctgcaagacatatggctggcattttgctgaccaagcccctagaaaaggtacgaatgaattgttttacatcattttaaaaggatctgtggtattgtgcaaaaacagaaagtcttatttccagatagcaaagaaaagttttaaaaaagagatctagccaggcgtggtggctcgcacctgtaatcccagcactttaggaggctgaggctggcagatcacgaggtcaagagactgagaccatcctggccaacatggtgaaaccctgcctctacaaaaaatacaaaaattagctgggcgtggtggcgcgcgtctgtagtcccagctactcaggaggctgaggcaggagaattgcttgaacccaggaggtggaggtttcagtgagccgagattgtgccactgcactctagcctggcgaaagagtgagactccatctcaacaaaaaggcaaaaaaaaaagacctatgtcttttgatttcattttccttgagagaagcaagacgtcttgtggtttgtttcatgaaatatctgatcatagaaagggggaggtggttcatagattataaaatgttgtcattctaaaactgcgagttatacatttcatatcacacattacaattacatttgggaggaaccgtgctttctcacacggcaagatgtccaggacaagaacacaagaggaaacttaggcaagtctgcataaggttctaggtggacatctcctattccagtggtctcccctcaggcctctccaccagcaacggtgcagtgagagtaacagagaaatagacccaggcctggtgggaggttggaaggcagcaaatatagataattgagcaaaaatagataatttgttgaaaaggagacccacatcggccaggtgcggtgattcacgcctgtaatcccagtactttgggaggctgaggtggatggatcacaaggtcaagagatctagaccagcctggccaacatggtgaaaccctgtctctactaaaaatacaaaaattagctgggcgtggtggcacgtgcctgtagtcccagctacttgggaggctgagacaggagaatcatttgaacctgggagggagaggttgcagtgaggtgagatcacaccactgcactccagcctggcgacagagcaagactctgtctcaaaaaaaaaaaaaaaaaaaaaaaaaaaaaaaaagaaaaagaaaagaaagaaagaaagaaagaaaagtagacccacaccaaagagtgttaccttgcatgtaactttaaagcaaatgattttccttctgtttagataacaaagaaaccaaatattgcttatgtctttaaaaatacttggtatggaaataggttggtgtggatcggataaattgctgtggaaagtctgactcagatgaactggagcagagtggccctgctcagtgggaagaaaggcaccttcaaggtgacagcgtaaaagatgagactataaataactccggccatcagtaagggcactcgatatgttcctaccattcagagacaacagaattaaagagttggacaaaccaaaagagaccatctgtccaggtctgtctttgggcaggtgaatacctaaaccatcagagctgtctctttatttcttggggatcttatgtagcagggatccccaacccctgggccacagactggctgcacagcaggaggcgagccgtgagagagtgaagcttcatctgtatttacagccactccccattgctcacattaccacctgggctccacctcccatcagattagcagtggcattagattctcacaggagcacgaaccctgttcgtgaactgtgcttgccagggatgtaggctgcatgctccttatgagaattcaatgcctgatgatttgtcactgtctcccatcaccctcaggtgggaccatctagtagcaggaaaacaaattcagggttcccactgattctacattatgttgagttgtagaattatttcattatatatttcaatgtaataataatagaaataaatgtaatgtgcttaaatcatcctgaaaccatcccccaacctcagtccttggaaaaattgtcttccatgaatcaggtccccggtgccaaaaaagttggggaccactgggaccatacacccttcaacagaacatgacaggtctgcataagattcaaggtgttttccctgacattagatagaaaactcttctgttatatatttgtagctatttctgcatactaatgctgcctcatttgctgacttatcattctgaaagttccttccgtaaaaaagaaaggcttaaaaaatacattctaatgatacgtgccttctctgtctgtgcacacagtgtcagatagaaagcaacttcttatccttccaatgaagaacacggaatagctgagtctttgccagacatagcctgatgggaaccctgtggtgtggccctcttcatggggagttcagtgtgatcaggttgagccatatttatgtgatgtcacctaggcagggattaacactggctttacgtggacatctcctattccagtgatcgcccctccggtctctccaccagcaacagtacaatgggagtaacagagaaatagacccaggcctggtgggaggttggaaggcactaagccagccggactagtgccaaacttagaaacaaaagggaagaagttgagtgaatgaacaggggcataaaaaggaagggatttctttggtaggtatgacaaaaacaaccaagtccatatcttaaatattttctctccagtaaaattttaatgtcactttgggatagggtctgtatggttagtcttcttctaaacctgggtccagctgcttggttttgtcatgtgattttttttaagtaatggtgaatttgtaataggtttctttcttctctttctctcctatgacagaccggggaaaggggcttacaaccagaatgctatcaaatcctttatgaaacatttggggctaattacccttgctggaagtctcaggatttttttccttgcagtttttttttccattttaatggaacacagttcaagtctcataaatgcttaaatatgtagtcgtaaagtttcagatgtctcatgggcaccgctgtctgcaaatctaccaggcagggctctgcagaggttcaaattcgaactggtttccgcctctcacaaagtgtgttatataagctgggctgggagaatttacatgctccatgcggccatttaataaagctcacttgattatagagccagggtcaccccaggaaatcttgccacctccccatttaaacagtgagagggaactatgcatttggctgttgttgctttctcctgatccagttatccccaggaagtgatccttcatttccttgctcatgactgcaggcttcaaggaagaagccagaccaggccagggtcagaggccccagtttcaacttcctctggctgcaaacaaagccatcaatcagagcacaggcattatttacacattccctaggagttgccttcttgcgtctcagagcaatgcaccagcacgtagttagggaagtaaaaaacaggactgcccctctgtggaataattatggacttcacaactatgagttgggatcaaaagggggacaatcaagggatgccactggtttatgtccctttcctgacccagatgcctggggagagccagtgaagtcagaggcacatgcaagttcttcctgcacctcagagctaggagaatgaactctgctggactctttaggcagatgcttccctgaacgcaagaatctttctgatgccctgagggctaaggctagaaccaggaagttgaaagaggtgctcgttactcagaatccctgtccctacctcagccatattgtcaaccaagtcagcgaacgctagagacttcaggaggagaagggagtgttttctcaccataaaaaaaattctaggtgctcctatgtcatcgtcacttgtttatttacctaatgcaactttcccaagtcatgtacatgtgtcttttagacactgaacacatcccactcccttgggtcagtctggaaactctggtgtagactcggccaccaactcacattttagtgatcctttaccttgggaaaattgcccaatcttttctttttttctcatctttgctttcacatcttccaaattccacttctgttcttttactcgccttctccttgccaagtgattggtccactgaagaccagcatggccagcctataaaggttgtaaagaaagaactggcaaggtaaggtgtgtgtcaaatgggtgatgtgttctgtctgtgtgtctgtctgtctgtctccatgtgtctatctctcgatgcctgtcctatacctggctgagtgctgtgagctggccatgcttcaataaacagcagacttgacctcggggagcttatggcacaaagaagaggaaggcagacatgggacaaatgattatagacaagaggagcgctcatatggggaagcttgggaggcttcaggaaggtacctgagctgtaggacttcagagaggagattgttgtgggttatgtaaggtcatcacagaaaccttccatcaaggcatgtctgaaaggctgggtaggaatctaaccacctgaaaggaagaattgcattagcctgcagccttccaggctacggacacttcaggtaggaaagcggagacctgagtgtcccaggggttttggggacaaggaatagagcagttgactacgtggatgctatggatgcgctaggagaaagaggcaagtttggagatattagcactctctatatacacttaatcttcaccagaccgctatcattcccaattaaacagacaaggaaactgagacacagaggctgaattgcccaaaatctcacaaacagtaaataattgagtgggattttaaacaaggggagcttgttgcagagtccactgacttaaaaccagggcactcagttacccctctctgtggtaagatggagtggagttgggaaggtcttggatgaccaaaccaagatctgtggtcatacgggatgcctaggggagtctgtcaaaactggatttagttatcatttataaaagagacacacatgcaacatgcatacacacacacacacgtgcacacacacacacacacacacatatatatacaccatgtctaacattttcactcaaatacatgccatagtacagcagaagcctccagtgtttaatctgtgcttctcctcctgcatgtcttggtaaagaacatagatccttctgccatcactttggatctgtttgaaactttcccaaatgcctcattggatggttattctccatgtcatccagagtcaagaagagtaactctgtcctgtccttttcaaatattctggcctgtgcatgtccactcaaaaaaaataagcaaaaaaataaaacaaacttatcaggcggggcatagtggctcatgcctgtaattccggcactgagaggccaaggtgggaagatcgcttgaggccagggattcaagaccagcctgggcaaaaatagggagatcttgcctctataaaaaataaaaagtaaattgaaaaaaaaaaaaacaccttatcagtgtgttccaggattttcttgttattgtgcaagcaaatatggttctcattaaatggacttgtaataaataaatgttattcacttatgctactaaaatgtcatgttgaaatatatatatatatttttaagatacaggattctcactgttgcccaggctggagtgcagtggtacaatcatagcttaatgcaatgataaacacctgggctcaagcgatcctccctccttagcctcccaaagtgctgggattactggtgtgagccactgtgcccagcctgaaatctattttacatattcggagtttagtatagaattctgccaaaggtctttgctgctgaaatctttggccctaaaataggcaatcaagagccactaaaggtactgatatctcagcagacaagtgacttatacaatgatggataaacggaatgaaggtgaagatgactggatgaagatggggaggggttaggagcattttgcaggcagctctagggtacagcatgggcaaaaagggtctgagcagagagcaggtggtggggatgaggagaattgataagcccatggaaaagaggatttttttttttttttttttttgagacagagtctcactctgtcacccaggctggagtgcagtggcacagtctcggctcactgcaacctccgcctcccaggttcaagcgattctcctgcctcagcctccctagtagctgggactacaggtgcgcaccatcatacccagctaatttttgtatttttagtagagacagggtttcactatgttggccaggatggttttgatctcttgatgtcgtggtctgcccgcctcggcctcccaaagtgttgggattacaggtgtgagccactgcgcccagccgagaggatttttaataagttaaaatgcaaacaatttatttgatcattcaaatattatggcatttgcaatcatgttcaagctacctaaagtatgggcagttgtgagtgcttaggaactggagtttgtttattttcattgttgattaaatcttttatggaataaatacaattcaacacatgccaatggatggtcttcagtgactgtgtaaccacttttaaaggcctttcactttcaagatcgataaactcagtaaaggcaggttctgctattgacaatcagggtgaaagacgttgttggccctggtatgggtgaatctgtgagacgagctcccaagttctaggttctagtgatcaaaaaaaaaaaaaaaaagaaagaaagaaagaataggatggggtaatgagaagttttctacttgcattttctaaaagttaacttttcaagtacagctttgattacttacacgaagtttagttcacacaggaatttatacatgacttcaagttgagttttcttttagtattcatcttccagatttgggaaatacatcatgggtcttaaaaactcacatctaggcccatacttaatcaaaaagaactctgggaatattttgttcttgtagctccacatatggaagaccagaattgatattgccaagacttttcaaaagcctgagattacttgtattttgtaagaccctttatgacttacaaagcaattccacaaatttttagtcttcacatcagtactattagatagattttataaatccttattttatagacgagggcactaagagccagagtgtgtaagggacatcccaagtcacacagttaataaatgctaccgagttgatactggagcctaggttttctgacaaggctcaagctgcaccctaaaccatggagatttctcagcgtcttgtttcagaagcactggggtatggaaagcagcactcacatctgtgggtttttctctttggaatgcatgaaataagatgttagtcattttccatgtcatcaagaatcaacacttcttatgacagatcacaacatctcagaaaatatttctttcattagccacattactgacttacttcacaactctttgctggggaaggagtctttggggttaatttggtctgaccttagcccatgttaggaattctcctccacacacagctggtcctgtggagatgaaaaacatgtacacaccctaaaatcctgtcccagatgagtggctttaggggatgctaaattcccaggcaggcggaggcaaaaaaagaaagggacatttggcctttgccatgatgactacatttgactgatgtttcagtgtgatgttatttctggcatcatcttgatctgtaactcaagactggttttaacttgggaaagtctgaatcttcacagatttcatttctgtcttatctcctccactgaaattcaactaatttaacactgtgttgatctagcgctggaggggacagaaaaacaagtaagacctgatcttcccactagaggtgcctatggtagggtaggagatagaagacatgatgtaaataattgtaaaaaaatgccatgacaaggcagaatggaccaggtaggataacagaaggagcaagtgaggtggggacttaagatttcctggaggaatctgcctttccagcctctctctcttccaccctcccctttactcactatactctagccacactgtcttccctctcttcccaccatgtgccacattcgtttctgcctcaggacatttgcacgcccgcttcccttttccctgtgtcctttcctgagaattttgcttggctcattctttttcctcatttgggtttcagctcagatgtcatcatgtcaggaagtcctccccgatgaccttatcctgcttatttgtttacttatcttctctcttgccatggagaatggaagcttcccttatatttgagagtcacagataagctaagacaagaacataatgctgctcaaaaaatactgagattcgaagggagtagagagagagaaaaggacaagactgagaattcctctttgggtttattcatttaggtgggatgaggagcaagagaaactagcaatgagaaggctcagagaaggaggaagaagggcaggctagggccgggagagagaagccaagggtgctgggtgcttccacagaaggagctacagaaacattgaggcagatggggaaatggcagtgggtgtgacaaccgaatggccattggtgatccttcggggaaggagggacagcaggagcagaggtcaaggttatgagggcatatggagtggttggtgaggatgcggggcgccaggaagagtgagttgcacctgatggctagtagggaaggaaggagagaggtagtgcgccatcttgggatcgtagcaggcttgagagaacgtattttctaagattgatgggaagatctaagtttgaatgcagactcaaaggaaaactacagagggagatattgaagatgaaagaagtggggaaagttgaaagagaaagctgctgaaagaggtggagtagaagggctggagagtacagatgaagggatccaaccagccacatttcggggagttgtgctgatcgacaggacaaatgttaaggtgatcaggtatcacaatctaaaattttggctgggcgtggtggctcatgcctgtaatccctgccctttgggaggctgaggtgggtgaatcacctgaggtcagtagttcaagacgagcctggccaacatggtgaaaccccgtctctactaaaaatacaaaaattagccaggcgtggtggcgggcgcctggaatcccagctacttgggcggctgaggcaggagaatcccttgaacccaggagtcagagtttgcagtgagctgagactgcatcactgcactgcagcctgggctacagagtgagactctgtctcaaataataataataataataataataataataataataataaacaatctaaaattttacagagaagtggttggggcaaatatctgttctctttgctttttcaagttttggagttcttaagaagttctttaagatattcatcttacattgggaaggggcttgtttcagagccaattaaatccagtttaatttaaaatctccaagatgaaggaagtatgactttccccatgatgtatgtttttttttctttttatactcttttttctgatttttcaagtaatatatgctttttatttttattattattattttttaaatggagtggctgcctgggcgtggtggctcatgtctgtaatctcagcacttggggaggctgaggcaggacaactgtttgaggccaggagttcaagattagcttgggatacacagcaagaccctatctctacaaaaaaatttttaaaaaggagccaggtgtggtggcacacacctgtagtcccagttgcttgggaggctgaggatggaggatcacttgagcccaggagttggaggctgcagtgagctaagatggcaccactacattccagcccaggtgacagagcgagaccctgtctctaaaaaagaaaacaacaacaaaaaaagaagacaccaaaaagtgaaaggaatttaaaatgtacctgtaattcctaccccaaaataactgctatatgtcaaagagcagaaattctagaagcatgatggttcaaatctggctctgtctcttcttactgagaggtagttgcaaattatgtaaactttattttttaattttaattttttattttttgagatggagtctcactctgtcaaccaggctggagtgcagtagcatgatctcagctcactgcagcctctgccttccaggttcaagtgattctcctgcctcagcctcccgagtagctgggaccatggtgcccaccaccatgtcggctaattttttttcgtatttttagtagagaaggggtttcgccatgttgtccagactggtctataaactcctgacctcagatgatccacccgcctcagcctcctaacatgctgggattacaggtgtgagccaccctgcccggcccaaattatgtaaactttaacgctcagtagttctcttctgtaggatgaggatggtggtcatagctattaccttacaccagctgatgtgaggactaaattatctccagaacctgtagcccatatgggaagtactcaaaggcccctgcttttatgataatgccgttttcctcccaggctcttccatatagatgctcttccccttgtgaaactcaggttgctttgcaggaacaattttgtgtcctgtttttgttctcatctacccttagcttgtgaacattttcccataacatctacatttccctttttattctaaagggagctatggcacgatgcccccaagaaagtgataactacataccatagtcccccattatctagagttttgctttccaaggctttagttaaccatgggtcaaccgaagtccaaagatggtcaatgggaaattccagaaataagaattcataagttttaaattgcatgtcattctgaatagtgtgaagatatctcacaccttcccactccatcccgcctgggacatggaccctccctttgtctagctcctgctgtccacattactcacccactagtcacctagtagccatcttggttcccagatcgactgtcttgaggtcatagtacttatattcaagtcactcttattttacttaatagcctcaagcacaagagcaacgaatctggcatattgttagaattgttgaatttattagttatagtggttaatctcttactatgcctaatttataaatgaaactttatccaaagtaatgtatatatagtgtatatagggtttggtactattcgaggtttcaggcacccactgaggctcttggaagggaccccctcaaggataagggtagacaactgcatattgtcataactcttgcagtatcaattatttttaccttttttaaagtttaagaactcagcatcatcatcatcatactggaagctcactttacaaagaatcaccatagggcagcagccggtacttatcccttctctacaaaaacaaatcacaagcaaaaaccaggatccagccctgtgctaggacatcagggcagaaacagaccaaagcctgcacagtgttcactgctccatttagcctttgctgcttctccgcaggttgggttgtgttggtaaagaaataaacaaaaggagagtccctctttctaatcagtttcctattgcactcggtggctatattagtctgttctcacactgctgataaagacacacctgagactgagtaatttataaagaaaaagtggtttaatggactcacggtttcacatggctggggaggcctcacaatcatggtggaaggcaaaaggcatgtcttacatggcagcaggcaagagagagcgtgtgcgggggaactcacacgtttacaaaaccatcagatctcctgaaacttatccactatcatgagaacagcacgggaaagatccgcccccatgattcaataacctcccaccgggtctctctcatgacacatgggaattgtgggagctacaattcaagatgagatttgggtggggacacagccaaatccaatcagtggctccaggggctcaagtcatgggaaggggaattgagaggagaaattccccttccagcaccatcagggccctgcagaccctggtgtcaccatccatgcatggcagcagtgccctatgctctgtggctggcagcctgtgtgagttattggggtcatcatcacagccctgccaaggcagcacctgcagttcatctcagatccactggcttgggttcaaaaccccgtaccaaaccctttcagagtgctggtgtttggtgcagggtcttctctcaaacccctctctcatgttacacttttaacttgcgatgcattagattgtaagtgggctagaaattatcggcacattatctttaaaagcaatatggattttcttctaataaaagccattcacttcaattcttttagccatggacacaattttctttcttagggccagtttttcaaatgtcacagactactaacaaagcatacctcatattcaattgtctatggtaaggtagtcttccaactcttccaaccccatgttaataattctgctttttttttttttgagacggagtatcactctgtcacccaggctggagtgcagtggctcaatctcagctcactgtagcctctgccttccgggttcaagcgattcttgcacctcagcctccagagtagctgggactacaggcgctcaccaccacgtccagctaatttttgtatttttagtggagacggggtttcgccatgttggccaggctggtctcgaactcctgacctaaagtgttctccctgcctcagccttccaaagtgttgggattacaggtgttagccactatgcttggcctaattctgctcttaaatgccatttgatgatgggtgatccatcgtactcctaatccaagtcactgaagtatctggtggctacatggactaccaatacagcagggtggaggagattccctctggccctgggcatttcttttctgcagatgagctgcagtactagtcctcaggcctttgcatatggctagaaaccaacccttgaagtctggggctacagttccctccttaatgaaaaacacattgtaataccagaagtggcgcctgatggcaagcttatttgccaacgtggagccagtgccctgccggggtctactttgttttggaatttctagcgtattaaaggccctaaagagaaactgtgttccatatgtggagataaccagccttccagaaaagcacaatgaaaaggaaggtggggctgtgagtagtcaatgctgagagaaagggaaagacattattagaatacataaagcagtatgtatgaggaatattccggtattttccagtttctcccattcttggcttgaaatcggttatgcatgtgaaaaacacccaggtggcttttattttacaccctttcaaattcatctctacagttgttgcaaagggatcttcctagaaaggcagattcccaggagtacttcaatactgagtaaaatactaataatgaaatactaccatttacggagcaccttgtttgtgctatacagtgtgctaagtgatttaggtagaattcttttttttctttttttcttttgtttttttagacagagtctcactctgtcacccaggctggagtgcagtggcacactcttggctcactgcaaactctgcctcccaggttgaagtgattctcgtgcctccgcctcctgggtagctgggactgcaggcatgagccaccacacccggctaattttgtacttttagtagagatggggtttcgccatgtgggccaggctggtcttgaactcctgacctcaagtgatcagcctgccttggcctcccaaagtgctgggattacaggcatgagccactatgtccagccttatgtaggttctttatctctagaagaaactgattttgaccccgtttaacagaagacaaaactgaggctcaggacaacaaagttgcttgccaagtccatgcacgggtaaatggtggagttggagtatggacctgtgtcagtctgacactgaagtcaccaaggctcatcttgtgtacgccatgatgctaatctaaaatttctagcaaagggaaaagaaaataattgtggatgtatggctgtgtatttttctgagcggcagagaaaactgttagtttactagacaattaagcagtgagtactaagattcaaatgaatcgacttgaattttccagcagcattaagatttcataaaacagcaagaggttggatgacaaaacaaaacaaatgggctactccctggtgttggcccttagcaaaatcctgggaagggggaaagtgtagacgttgagcatttttgaaaactgagattcacaataagttccacatttgttctgatcctccctccagcccccacactgggcactttctcaaggcctgagaactgggtgtctgcttgtccagaacattcttgctaaataattggcttagaaagtcgtgaaaggcgtcagtggctctgaaccacggggaaacccaaacagtttatgaagaacaagatcagcccgccttctagtggatggctccgactccgcagagctatgtgtggaaaggcaaagccggccttgaagctgaaactttcaacaaacaggcagagaccttagggaggttacagtgtgccagtgtttatgtttctgcatctaacccttcctttttgttttttgtgagacagagtttcgctcttgctgcccagactggagtgcagtggtgcaatctgggcttactgcaatctctgcctcccgggttcaaacaagtctcttgcctcagcctcccgtctagctgggactacaggcatgcaccaccatgcccggctaattttttgtatttttagtagagacagggtttcaccatgttgaccaggctggtctcaaacttctgaccttaggtgatccacccgcctcagcctcccaaagtgctgggattatagacgtgagccaccacgctcagccatacccctcctttttgattagcactttatcataaacagagtccagagaaaaaggaggaagagtaaaaatcctccttcgctagagaaagcacagtgtctcaagatttagaatctagctggcaactgggaatctttggtgttatttctgcgagcaatgtgaattcattgggttgaacaaatggctagccctttttgcattttcagttttccattccatttattctttattgtgtccttgtatctttctggcccctaaaactcgctcactcactccttttctttctctctgtactgtaagccacttacaaagttgattacatacggcgactaggaacccaccgctctttccccacacctttccctttgcttgccttttttctttttttgaaaaccctcccctctctaagagcctatgtaaaccctgcctgttcttcaacttcctccctagatcctgctctcggcacagcttgcttcttcctctgaaatccagtggtatttcttgtcgggatttctcacctggccccatacgctactgcagtacattgctagttatctctttcctacttaggcgagtgatttacctagctattctgaaaggtgcagcaaagactgtctcctatccttttgtgtttctttctcgttatcagcacaccaactggcttctaactcattaaagattgcgtgattggaatgtaaaacagtcgcgtgaacaacagccatgaccattgttttttttttttttttttttggagacggagtctcgctcgtcgcccaggctggagtgcagtggcgcgatctcggctcactgcaagctccgcctcccgggttcacgccattctcctgcctcagcctcctgagtagctgggaccacaggtgcccgccaccatgcctggctaattttttgtatttttagtagagacggggtttcaccgtgttagccaggatggtcttgatctcttgaccttgtgatccgcccgcctcggcctcccaaactgctgggattacaggcgtgagccaccgcacccgaccagtgtctttctttctttctttttttttttccccgctcttcttgcccaggctggagtgcaatggcatgatctcggctcacggcaacctccgcctcccaggtttaagcgattctcctgcctcagcctcccgaggagctgggattacaggcatgcacccccacgcctggctaattttatatttttagtagagatagggtttctccatgttggtcaggctggtctcgaattcctgacctcaggtgatccacctgcctcggcctcccaaagtgctgggattacaggcacgagccaccgtgcccaggctattctgctttttacaattataaccagtctagacaattataaccaatctagtttctttggatggttgagatgtagtcttgatggaagagaagggattacattggactaagttaacaattttccccagcactctgagtattttattctatgaaatggcttaaatatgggaattttattggacagccttggctgggattctcagcaatgggcacttgcaagtatgagaatcccttctcagtaaaagtcccctctccctgcaacaatgatcatcagagaatgtctatccatattcaaaagctgtgagtgggctaggtgcggagggtcacaccttgtaatctcagcactttgggaggccaaggcaggcagatcatgaggtcaggagtttgagaccagcctgaccaatatggtgaaaccctatctctactaaaaatataaaaattagccaggcgtggtggcgcgtgcctttggccccagctacttgggaggctgagagagaagaattgtttgaacccgggaggcagaggttgcagtgagctgagattgtgccactgcactcccctccgggtgacagagcaagactgtttcataaaaaaaaaaaaaaaaaaaaaaaaaaaagctgtgagtgatttttttttttagatttgtaatcatcaggtgacaggttcattattcttcaaagaccttttagaggagggtgttttagacaatggccaggttgtgtcatgacagctgagctcgttgtttcatgggtttacccgcttcatgagcttgggaggcaaaccagatataacacagtcgtgaaaatgaggccactccaagctcatgcatgtgctcagtttctacccgggagcactgtgagagctggcacttgctgcccttctactgccattcctggatcagagccctgcaacacggggtcagctgcaatttgccccccagggctgagtatcaacaggcacttcccctcgctctgaaaatgcttgggggcatcctcgtgctctctatttggccaagagagaacacgaaccgcaggttatttggcccagaccagtagatgccgtggaaaaggcaccgtggctgccccagaacaggcaaatcacaaaatgcttgccttgggaagcataaacaaagcctcatggtgtaggaggggcagcccccgcctttggatccgggatcagagggaagagagaatacagggctgtttagatttctaggaaccactatctctgtgaacttcactctgctgtgagccccaggaagtacctgctacccaagacaccaacaattgcctgcctggaatctttggcggcagcttgtttcctgacaaaattgtttgtcaaaagccttcattgaatttcccctggaaactgaaaggaaactcaccacagttatgataatagtaacaatcgtacacttattttggaaacagacgctttaattttttgagacgttaaggaatattgttctctattcatcatttctcaggtgacacagaaagctcaggcatctcgagatttgctttgattttgtagccagggagtaaattgataactgtgactgaacattgattggacatgtactatttctcaggtttggtctaagtactttatatatatagtctcattcattcctgaggataacactatgtggcaaataaggctattgccattttatagatgagaggatttggactccgaaggggaagcgatttgtcctcagacttaccctcttggagtaaggacttatatataattcatggacttcagggcacatgctcctaacgccatgctaagctgactgtctgggatgggttgaccggcagcccacctacctgcacttcccagtctgtgtggtagttgggtgtgtggtcatgtgaccaagttctggccaatgagaagaagaggagccccacttcttggtctgacccataaaaatctctcaccagagctcttccattctctgccctccttttttttaagtgaaggggacactgaacccagaggagggcagggcagagtcacaagatgacatcgaatgatcctatggaaggctgtgtacctaccagagcatgtttaactttttatgagttagaaatagatttctcttgtgttaaatcactgaaatttccaagttatccactgcagaagctaaagttaccttaattgatgacccctataataaaaatggattgagcacagttaaaacatgactgtaagtggacccttagccagaatttatctctccttccaaacggtatgctctctctcaatctgtagaggatgtggccacaactaggaaattctccgccaacttacaaagatgagaaagacaaccccatatcctctttccatttttcaaagggagttaacacgacatgaaaataatcagactgcaggacaatcattcactggaaacccatctggtgtggtgatgagctcatacccttgagaatgaagaaaatttccatctgaggctgggcggtgaggcttccaaaataggccagctggttttcaaaagggccagtggtgggtatgacagtgcttagtagagagggccagtggccaagctgtataggcaacatcattgtaaatgattttaaacacacgatgcttattaaataaggccacctgatggttcagagctcttgtcctcccatctgccatagcaactttggtttgataccaaatgtgacttctgcccattcacctcccaccacctcagcctagttaattcctacttatctttaagacctctgaccaaatagtgcctcctcaagtagctttcttcaacatcacagaaaaggcaaggtccctcttaggttaccaggtgccttgtcctcaaagcattgacctccaattttaatttgacttgaatttgtctaatcattatattaatgctgctgagtaaatgatgttagatttccacctttataagaatatggaatcatattttttttgtttaccatttcatctccaggacttagctcaatgtctagcacatagagggtgttcattaattatttgttagatgaatgaacaaagacatgaatgaatgaatgaatgaatttaccattctacctccagaactttgctcaatgtctggtacatagagggtgttcattagttatttgttagataaatgaacaaaaacacacgaatgaatgaatgaatgaatgaatgaatgaatgaatgaatcttcatttaattaatggagaagcggaggaatttagccacttggcttccacagctgctactagccatcttcttccaaatgactttattgaaagagactactccgaatacaccatttcttctgtagctgatcattgccccagaacaaatgtctaaagtgtggctgttgagatctctccccagaggagaccagccactaacttctctgagcctcgttatgataccattatttataaaaatgaagatgacagtacttgccccccaggggtattgagaatcaaaaataataaaatgcatttggaaatatactctgaacatttcaaaaagatatgcatatatatggtttttttagtgtcaaaacttgtctcttacatgatgaaattttgaaaaggcaagcgtttgtgaagactagaaccttttgagaatggtaagaaaatagactctctatttagtgaaatatgcattttttcaagggaatagcagagcaattcgattcctgatcatctccaccagctccaccacaagagactcccaaacaaatacaaattaagtaaaaccctggctgttctccttccagtgggattactattcctgagctccatctaagtagacctttagaagccctcagtgttcaaaggtagttggctcttgatcaaaagctcaaattctcagttgattcccacagtgctttggtggtagattagcatatggcgggagagacagaacccaaattactggtggctgatgcaaaaactggcagctaattgtaaacctccaaacaaagtattatttactcactgaaacaaagaaaagtgctttcaaggagaatgaaaatatcccttatgtcatgtcagattcaagaatatttcatgaacaaagtaaaaattgagctgttaggttgtttgcaaatactgtccacatcaaggaagaacaatttgaaaatgtaagaagtgagagttttgctttccatcctattgcaaaaatatgtttccgtgtcaatttaagaaagtactgttgcaaacgacagggtgagtgaaatggaagcacaccagtagaaatgcaaacacatcttcctttactgacaggcacctacagccttaatgaatgcctgaaaaaaactaaaacaaacaaatgtgcagacttgacagagaaatttaatgaatttactaattgttcttccttggtgcaagcctctttttttttttttttttttttcaaccacatatgttgtagataatcagagaaaaggccaagcccacaccatatgtaggcactaaataatatgcagggcatcgctctttaaaacatacattgccataacgaaatgatgaaaggggaacagcaaaaatagcaaattgagaatcaaagcccaactttccacatgtggaaacgtttggttgggtcatggtagaatccatcagtccaagactggttgtatgagctgtttgtgaagataaaaacgaatcattgaaaacccaatctcattttagaggaattgtcctttattaggagaatggatcattgatgtcactataactaatcatgtggacagctgatagagatgcattttcaaaatgattattctagaagttctgtttcaaaagcatattttctataaagaagaaaacacacaaagcgttctacgtaattacaaaccctattctaggttggtaggtgttcttatatattagctcacatgttttcttatagagtgtgtgagaaattcagtatctataggtcattgcaggcctggctctgtggtctccagacagccagtgttagagcattaggttaggactgctttgcaggttaggaaaaggactctcctcaaattcctaacacatggatgttcattctagccactggtccatatttcctttctagaagcagcagtgatgggtgaaccactgatcattataaaaccatgaaacattcaagggcattcatgcttggaggaaggtgggatgtgccctgtgaccctcaacacagccaacccagaaccagagaggagaggaccaggtgtgttatcttgttggtgctttgtcaacaggcattagaaaaaaaaaaaaaacagaaacaaagtccacaactctgatgactctgatgacggacgcggtttctacaaatagaccaaagaaaaccaaaacaaaaaacatcaaacaaacaaacaaacaaaaaccaaaccaaacacaatccccctccccactaacaaacgaacaacatctaacttaaaaagaaaaatttaaaacaggtttacatatgccatacatatgtgttttacaactttggggccagaagcaatttatggtaagtcagtaattcagattgttggtcttatttattttatttttcctatagttttactgcacagccaggagtggcgtggagctggaggcagggtgggggtgggtggggaggcaatagagaggacagaggtcgatttgtcatgaaaccaatgaagcttaaacttcagggttcctcacttcatgggatcttccaagtctctgggatgattcctagcaagatattcatgcattcattgcttacaaaagtgagatattttaattgtcatcagttacaactaatgcctcttcttttgttttttttttttttttgagacagagtttcgctctgtcaccaggctggagtgcaatggcgcgatctcagctcactgcaacctctgcctccctgcaacctccacctcctgggttcaagcgattctcctgcctcagcctcctgggtagctgggcctacaggtgcccatcacagccagctgatttttgtatttttagtagagatggggtttcaccatgttggccaggatggtctcgatctcttgacctcatgacctgcccgcctctgcctcccaaagtgctgggattacaggcgtgagccactgcgcctggccaactaatgcctcttcctatgttgatttcccctctgttaaatttcctcttttgctcaggtaacattggaatgaccactgggcattttttttttttttttgaattcagctaaggagaagaatggtcaggatatattcagtttgggagagaggaatatatttgaggtccacagacattgccatctgtaatcaagttacggtgagctgcaccagcctagaaatggcttccagcaagaaccctcacccttaaatgccgactcgcccaccttgttcatgaaggactagagatcttatcaagatatggctgcatcttatggcaccaggctgtgaaggtatgtggctagcagaagagaaagaaggtttaaaatgccaacagccagaaacccatctgtggaggaatctcccaatcctcagactgataagataataagtagagagttccattctcatacctcctggacacaggtggcagtgttcccactgtcaggagtatatttcatatataggacacacaattacaaaagcaccatataatgttttctttattgaaggaactagaatataattggattttcctgcaatccctgtgtttagaaggcacatatctgtaatcttactctcaacagcatgttctgcaatagatcatataaaaaagaaacctgtaagaagtcttcccaaattcttcaataattctaaaaatctgcacagtatttccaatgacaagttatgaattggaaataaacctttctttctttcagtaatgaaaggacaagttttgatcagccataccatgcgaaagacagacttagctttctcttctctctctgtagaaaatgttataaaatcattatcttgtgaagaagagatcaaagaccaggcaaccaaaataggtaggaagaagaggataatagggatgttggcaggttaattaataaacacacattccttttctgaattttgtgatgtttctaatagttgttggctttcctacatttgtaacttgtgatttttcctttcacatgtaagtttgtataacttttttttttgagacagagtttcactcttgttgcccagattggagtgcagtggtgccatcttggctcactgcgacctctcgaactcccgacctcccgggttcaagcgattctcctgcctcagcctcctcagtagctgggattacaggtgcccgccatcgtacctggctaattttttttgtatttttagtagagacagggtttcaccatgttggccaagctggtctcgaactcctgacctcaggtgatctgcctgtcttggcctcccaaagtgtaagtttgtataatttttaatgattttccttttaagtctcccccacccccaattatattaagttggtgcaaaagcaatggcggtttttgctgtaattaaaagtaatggcaaacccgcaattacttttgcactaacctaatagaagccgcaggccctgccattaaccctggtttgggagggtaacgtgataaagaagtcatatgtaaaaggcacttggaaaaacaaaagtccccgttgagaagagactggagatgtgcagggggctgccactcacacacagccatggttctgggagtgagatggaaacccgggtgggacagaagtttccctccagggctggggccgagtgctgtttagagaaggggactgctgtgctgagtggcacatcacagccacatcctgcctctgggtgtgacctggagtgatcacattctttctcgtgataataaaaacagaagtcattatatgaaaaatacacttgcacacgcatgtttatagcagcacaatttgcaattgcaaaaatgcggaaccaacccaaatgcccatcaatcaatgagtggataaagagattgtggtatatacataggatggaatattgcttagccataaaaaggaatgaattaatggcattctcagcgatctggatgagattggagactattattctaagtgaagtaactctggaatggaaaaccaaacactgtatattctcactcacaagtgggagctaagctatgaggatgcacaggcgtaagaatgacacaacgggccgggcgcggtggctcacgcctgtaatcccagcacttcggaggccgaggcgggcagatcacgaggtcaggaaattgagaccatcctggctaacacggtgaaaccctgtctctactaaaaatacaaaaaaattagccaggcttggtggcgggcgcctgtagtcccagctgctggggaggctgaggcaggggaatggcgtgaacccgggaggcggagcttgcggtgagctgagatcgcgccactgcactccagcctgggcgacagagcgagactccgtctcaaagaaaaaaaaaaagaatgacacaatggactttggggactcggggaaagggtgggaagtaggtgaaggataaaagactacaaattgggtgcagtgtatactgcttgggtgataggtgcaacaaaatctcacaaaccaccggtgcagaacttactcatgtaactaacaccacctgttccccaataacctatggaaataagaaattttaaaaaaacaaaaacaaaaacaaaaagcagctaacatggattggttgcctcggatgtgccaagccatgggcttaatttgaatgatctgagtcagtcctcatggtcgtcttgtcaagtcattgccacaccctcatttgtcaggtgccacatacaactttttgtcctctgtcattagttcctgctaatatcagaaatcacgtgttaagaatacagattgtgtaggctgagcgcagtggttcacagctataatgccagcactctgggaggatggggcaggcagatggcgtgagcccaggagtttgagaccagtctggacgacatggcgaaaccccatctctacaaaaaatacaaaaattagctgggcgtggtggcgcatgcctgtggtcccaactacttgggaggctgaggtggaggatccccagagcccaggaggtcggggctgcagtgagccatgattacaccactgcacttcagcgggggcgcttaagacattttatacatatttaaagtggctccccagtgatcctgatgctgccttttgctatgtgcagaatgaggccccttcagttcagtggctccgggtggactgcacattagtatcaaaaacctttagaccatcccaacacctaagccccggatcaactaaatcagaaccgctgggagtcaggactgagtatgggtgtgtttaaaaagttccctaggtgaactcatccagagccatcagccatcgccttagccaatgaagacaccgcaaactacaaaaaagtactgcttaaaatcgctaataaataaatacactcaagatgagtctttcccaagatcaaagacagctaaaatacaatatttcaacaaaaacaacatttcacatttgtatctttcttagtctttgtgacacactttcacatccatcgcttattttatttttttgagacgtagtctcactcttctcacccaggctggagcgcaatggtgcgatctcagctcactgcaacctccacctcctgggttcaagcgattctcccgcctcagcctcccgagtacctgggattacaagcatgtgccaccatgcccggctaattttttgtatttttagtagagatggggtttctccatgttggtcaggctggtcttgaactcatgacctcaggtgatccacccaccttggcctcccaaagtgctaggattacaggcgtgagccactgcacctggctccatcacttatttaatccctacaatgcatgaagctatcattcccattctgtaatggagaaagcaaaggctaggagtgactaacagattttttttttgaggggggagtgaagtttttcttgagcaaaggtagctgctctctgcacttttctcaaatcctctatttgttgaaatgcagttcttgcgttcttggctctttcctgtgagactatgaagaatggaaaatggcccatgtattattacagatatgtctttaaaacggccctggttggcagtagaaaggagggctggggaaggtaaatgctgaccatgggttggtaatcttggacctcctgcagaccaccccagcctggtcttgctctgggccgcctcttcttctcccaggcccctcggcctggctctgcaggctgctaaccagtccttgttcactgagcctcccaggttggtgaattggtttagacttgccatcctggctgccttccagacccacccatggggattacctcccagctgcctgggttggacatatctgcccccaagggcctggcttggccagagaccacagacaagcacgaggcgtggttagcctttgagccccaaacgcctatgatggggccaggcacctatctgctgctgaggacctgtctgcagagttgaactgagtcatgcttgagcaggaatgtattctttttccaggcccggtggccaatcattcagcactctctacagtatacttacgacattaatggaaatcctaaaaaatggcccctgaggcggggctagcccaccctgcttagttgatttaaaagacaaagagtgccagatgtggtggccgacacctgttatcccagcgctttgggaggccgaggcaggaggatcacttgaggacaggagttcaagactagcctggccaacgtagtgagacccccatctctacaaaaaaattctaaaaaatagctgagcatggtgacatggtcccagctatttgggaggctgaggtgggaggatcatctgagcccagggaggttgaggctgcaatgagtcgtgattgcaccactgcactgcagcctgggtgacagagcaataacctgttccctcccccaccaaaaaaagaaagagatgaaatgaaagtgagaggtggaggccagaagccagggcttcaaaactcatttgtaatcactggaaagacagaatcatcttgactaagtaattacccccacatacccagcttggggacttttgactctaaatcacggtttcagaaaagcttcaaatggacaaaccagccacattactgcttgaatctcccagctgggggattttttttcccccaggattctttcagattcacagcttgtcatgggaaatcttatgtgaacttttcggatgctggtcaaatttggaaggatttctctaaaagtttcttttatatatgatctatgacagacacacttgatatttagagtgaagcttttaggtacgtgcccttcaagcacgagaattctagaaaagtcttcagaagccatgtaaagggtctaccccccgcctgcccaggggcaggtgaagaagcaggagcaggggtcctgcggggctgtgcccatctgtgaaatcaacccgacacccttgggcacatcttccagggcgcctccctcccctgaaagtccagacattccaggaggaggggtggagcgaggggacgggtggtttagccagtgcgttttattaaggaattatagaccaccaaattacacctaaaaatacaaaggccagctgtgcatgctgggttacaagtattgtcatgagccagcttacagagggagggccaaaaccactcaagtcgacttaatgaaataaactgggttacaaacacccgtgagaggaggaaaaatgagcgacaccccccttcaagagccaggccaagggacattctttcacttgctatgctgcctgcgccccccactccccacgcaatctgggtcctctcaggcggggctggggctgtcaggactgaagtctccgcggccagcagggacgtggcttaatgccaccaaactggactgatagctggagaaagcactcttgtctcccctttttgaagtgctctgcacccaccgccagttaactgactcagaagtgccactctccctcaggaaagtttctctccttttctcatatttgggttgagaggtgtgtgtctgaattcagaggccactatgtaaaggaaaggaggctcagtgttggtgcctgaggatcttcccgccttgcctcctgtcccacacaccacattccccttaccagcttgtcaccacccccaacacacaggtgcacacacataggtacactcacacacacacacgtgcacacatgcacacacgcacgcacgcgctcacacacatgcatgcatactcacaggcacacacatgcatgcacacgcacgcacacatgcacacaccgcatgcacgcacggtttgataaatcatccattgtgagaggagcgtggatttgtggaaagaacatcctttgtctttgcagccaggagaactttggttgaaatcaccaggctctgtctgggtgactttgaacaacttacatccttctctgagtttcaataacctcatctcaaaatggtgacaataataatcaagatggtgacataggcacttcctcgatccggtggctttgaaagctgaattaaatcatgtttacggtgcacttcacgtggcgcaccgtatggcacgcatggcacctagaagatgaggctctgttcatgttaactgctccctgttaaatgtaacatgcttcagagtcccgaacacatgtgacaatagctcatgcccccttctccaccattcaccaccactttcccatgcttcaaagaaacgaaagaggagcttctggtcccacctgatagacggccctggagatgcaccatggttttagcagcagctgcagaactcgaatgttcctcacttggcaggtcctcagcgcccgacaagtcaggttccaactccacggtgggtcctcagagccaagcagcccagcagccatgccagccccagactctgccgccaaccctctggtccctggccccacatccagggctgtgttcttttagtgacacaaagtgccaatgtcagtaagatttaatcaggcaaggaaaaaatgcagtccaaataactctgattcctctgactctcctccccctacctaccctcaccaccaccctcactaatcctcagagactgctttccttcaaggataagcaaaaggctcttaactccctcccaaagtgttttctccttgtctctggggactcaccagggacaaggtaaaaataaacctcagtgtgcagataacggcacatccctgtttctcagtggactgaggctggctctttggcagatcaaacagaacttagggaagacctcagacccagaagcaccaccgagtgttgggatcccctccagggtgagaaagctaagagcagagagctgcagccttccctgcaacattccccagacattccatcccttttcttaactctttacaacttggagaacccatgagtttccacaaggtcaagcaaaaagtcccattctgtagcagcactggagaaattgctatttctgtgggcaatttgtaagaagccaggcattttctttggaagcgtcccaagtttaggttgggattgaaatggctggaaagaatacttatctgatggatttcatatcaacatccaagatttggaggaaagcagggaaaaggaggtaaagtcaacctatcccgttttttttttcgccccgcatgaggggttacttcctataaaccgtcttgctattttaatgcatgttgggtaagctacaggtagaaattaactcaaggaaagtccttcaattaaacgtgtcataaccattggaatttcataagttgttttgattgttgattattttagaatggcatctgcatcctaattcaataaattacataccaaaaggtgagattccaaagctggaagggaaagaagggggaggggagaatgcagccacgacctagctgtacaattaagacaaagagcatgtttaatctttaatgtcattttgattgcacagtcctgaaaaatcatggtaagtcataaggcatgtttgccttctccacattccatttgtttatttattatctgtctcttcgaccttaactaataccatcagaaaagtagaaatgtaaaatctactaatctactggagcgtcctggagtcctttgtaacctcagtttgaatttggctctgtcattttctgtgtggcctcagacaaattaattaactcctctgacttatttcttgatctgaccgatggaaataatacctacctcactaggttgtgaggattaaatgaggtcacttacttaaagtggataataaagaccatggcatgaggctgatattttttcccccacttatgatctggtaattcaaggacattatctaccactgataatatgaaacccttaggataaaaatttgtggttctctaaattatgttcttttaatacgttttctccttttgctttgaatttatgcattaatttgtttaattaatataatgcagcctttatttatttttgggggagtttctctatgttgcccaggctgatctcaagctcctggcctcctgtgatcatcctgcctcagcctcccaaaatgctgggattacaggcatgagctacctcacctggcccattttaatgtaaactcttttttggatagttttatcatttttccatgaataatcaccctaaggcaaaacacggtgcataattttattcctgtgtactattcccttatttttgcaccccagtaatgaaaagcaggtgggtactacagaatcttgcctttctacaaaaaccccatcaccagaaagttttatctaagagggaagagaagtgaggggaggggaaggaaggtaggacgataggaagataagaagaaaggaaggaagggaagaaggaaggaggaaggcagggagggagggtgaaagggagggagggtgaagagtaaattaaattaaaaagcatacagtacgcagaaaatgatgcttacattaacattagctaactgcattggtattttcatgaaaaaacacatgcaagatatattatagttagtttcagtgtgtgtgctctgaactaatgctctccaacctctggagatcttggctgtgaaccagactcttatccaaagcatgtaattatggactggatagggacagttcttttttttttttttttttttctttctgggacagagtcttgctcagtcgcccaggctggagtgcagtggtgcgatttcggctcactgaaagctccacctctggatagggacagttctaaaggcattgttttattctacgacgaagtaaagtgactttaaaaattaaaaaagtgaaatgtatatatttagcttatggtctgggaatcttttgagtataaaggtgctataataagctcttttgaaaaatgactgaatataaacaagaattcccgagaacagcaagacctactcaagctgccctgatatctttaccatttgcggggatgagtggcgtgctttagtggggcttgctctggagtctggaatcggagcctggtgacaccagcagcagacgcctgtctctgtgcccatggaagctcggggtgacagtgccgttggaggatgctgcctgatttcactggtcctgtatcttcaatcatctacatgattctgccctagccttgactgattgattgattgattgatggaggcggagtctcgctctgtcgcccagggtggaatgcaatgatgcaatctcagctcgctgcaacctccgcctcttgggttcaagtgattctcctgcctcagcctcccgagtacctgggattacaggcacccgccaccatgcctggctaatttttgtatttttagtagagatggggtttcaccacgttggccaggctagtcttgaactcttgacctcaggtgatccacccgcctcgctctcccaaagtgctgggattacaggtgtgagccactgcacctggctctgccctagcctttaaatcgctaattcagagtttcacaaggcagctccccacgtggcctctgagaggctgtgcgtgcaagtggcatgactgccattgagaacaatgcccttgcttttcaaagggatttagaaacctcagagcaattcactataggtgtgtgtgtgtgtgtctgtgtgagtgcatgtgtgtgtctgtgcgtgtctgagtatgcatgtgcgtgtctctgagtctgtgtgtgtatgtgtgtccatgtgtgcctgtgggtatgtgtgtgtgtgcctggctctgtgagtctctatgtatgtacctgtgtgtgtgtgtctactgtgtgtctgtgagtctgtctttgtgagtctctgtgtctgtgtgtatgtctatcatatgttaatgtgtgtgtgtatgtgtgtgtgtgcctatctctgagcctctatgtatgtgtctgtgtctgtgtatatgtctatcatatgttaatgtgtgtgtgtatgtgtgtgtgtgcctatctctgagcctctatgtatgtgtctgtgtctgtgtgtatgtgtgtgtctactgcatatgtctttgtctctgtgtgtgtgtctgtgcatatgtgtctgtgcgtatgtgtgtctcatgtctattcgtgtgtctgtttgtctattatgtgtctgtgtgtcattgtgtgtctgtgtatgcatctatgtatgtgtgtactgtgtctgtgtgtttgtgtgggtcattgtgtatctatgtgtgtgtctgtgtctgtctctgtgaatctctgtgtgtgtctgtctcgtgtgtgtctatgtgtgtgtctatccatgtgtgtgtgaatctctatgtgtgtttgtgtctgtgtgttttatgggggtcattatctctgtgtgtgtctgtgtgtctctgtgaatctctctgaatctctatatatgtgtctgtctcttgtgtttctatgtgtgtgtgtacacaccttcatcttacagaggaggtcccagcacagatggtgcaagcagccagccagacctcctgcacactgtgacgaagctggagcaagacaccagggctcaccaggtgaacatgtgacctggaccggtctaactcccaacctctcttcatcactttccttattcttttctcaagaattatagaaaataagcatcttctaggtagtttaccacttagacagttgatcgcaaaacctaaagggtaatggacgaggacagagtgacctcttggtgtctaaagggtagggaataccatgttagacaccaggaagacagagtaaggagcagtcactgtctcactcctccttccatgagacttttgctactattaggggtgaaaagagtcaagcattgagttagctggccagatggggtgagttgctgagtgtttgtctattgtaagtcctggggaaacatcccaaggagaagctgaggtcttggtcctgggattgcacattggggaagggaacttgggctgggagccctaactcagtggctgacctgggagggaggcaggtgttgctgatgccaggagttcccctgcccaaagacaggacagaagaggaggtgggaccttggcatggcagggaagactgccaggtacggactcccagccccatcccctgcagctcccacctccgtcccactggttaatcatcttccctatctcggagtttctgtgttttctatcccggctcccagaccctcgttcactgcttctgtaaagacagaggaatttttttttttttaagcaacaaatgcctttgcctggctctgggaatgttttaagacataattactgccttgaaaaggaataggaaaaactcagttgcaagtaatgtgtagtgctattatgaacaaaatttgcaaatacataaatacacagaaaacagcatacacgtggagaagtatatttatagcaactaaagaaatatgttcagaagtgcaatctaatgtaacccatcttaatcattcagggattatttattgctatctgtttgtaaaaacgtcagccataagattggctgaagaactattctatctcaggtcaaagtcagctactagtgcaaatagcatttttaaaaagactttcttggatgcattttgttatcttttactgatctgatctcaaggtaaaggacaatttctccaagagcaaagcccagtacagttgaggcctaatatcaagaaacttcaaggaattaacgccttagcctaagtcacatctgttctcttggaagaacaaaagaagatcaatagccgatttattccaaagtgagaaggtgataggaaaataaataaatccacaagagtgagagggaaaggcagatatgcactcagaaatgcccatcggtcgtattttctggttttgtagaaagcagatttcttttgtgctttgtgagcagtgagcaggcgtcctctacttctgtgtcacgtaaggacttttccaggtcttaactactaatcggtgttttaatgccacattcctttcctgccttccaacacaagactcaaactgaggtttaaatttactgcaaatttctttctttccatccactgaatgccgttaagcaatctccatgtgtaatcaaaatgctgggtagcagtagtgttggaagctttgttctttaaatgaaggtggcctatcactctttgtcagtgctcttaaaaacgtaaaaataccttattgagatataattgatataccgtatacttcagtcatttaaaatgtacaattcagtggtttcttagtttaatcataggattctacaaccattgccacaatctaattttagaacattttcatcccccaaaagaaaaccacacccattagctgtcattgtcattccccatttctcttcattccccctagctactggcagcctttagtctcctttctgtctccatagatttgccacttttggacattttatattaatggggtctttgtggctgacttctttcacttagcgtaatgttttcaagattcatccatattgtagcatgtgccagtacatttcttttctttgctgaataatatttgattatgtggaaagaccatgttgtgtttatccatgcatcagttgatggacatgtgggttgttcccactctctggctactatcaatgatgctgctataaacacttgtgtaagcatttttgtgaggtgtatgtttttcttgtctcttgggcacatacctcggagtggaattgctgggtcagatggtcattctttgttgaaccatttgaggaactgccagacagttttccaaagcagctgtaccattttacatttccactagcagtgtgtgaaggttccaatttctctacctccttgccaatcttgtttctgattacagccatcctagtgttaagtggtggtgttcttggttttctagctggattctatgacgtggcctttgggtaggatagggtggaggcagcaacagaaagggctgcttttagggggctggtgtgctgtcccccatgctttagcccccagcaggctgcagcagatggaatctggggaaaagaggctggagtacagaagagcccagaatgtcctcttcctctctcaacagcccctccatacctccttcttctgctcctgactctctcacacccaccatggggcaaaagtccaaatatttttggaagttaccatttgccattttctaatccgggttccacttccttggaaaaaaaaatgctatttagaaatagcactggtacggctaactgagtgggtgatatgcaaaacccaaacccaaacagtcttttgaaatcccaaggcatttcaggattgctaactcacacatttaatcccatatttgggtctggaaaacgtcccagctccaaccaagagtcatcatggcatcatcgtttctcaacctgagaacccaaaaaactcatttatataaatgctaggaaactcactgtgttcatcttggggactggagaataaccttttaaaaatgctttgctgtgtatataaaaatattttgggtccctgggaaagtacaggagaggcaggagctgccctctgacttaagcactcccaagcagcaagccaagagctatgcttagaaatattcccctcaagctccacccatgattatacaagtgatcctatggccataaaagtgatgtcatctatcaattaccccttaggaaagtaagctgccatatgcacaccaggccccagtagaaataaaaccagagccgcctgaattaaatcagtccaggccatgagttggaaattaaatgccctcagaccctcttttcttaatctcctgttatttggtttccacgaaattcatcctttcccaaggatgatttttgagtacgtacttcgcaagcatgcatatgtgtaatcaaagccttatgtgaaaaaaaatacatatttgttttgtttaggggttacatgcaggtctggggcctggtgggagtgaagttgtaaagtgggggtcctgctcataagaaaaggaggtctgcttgcttgagaaaggggtccccagagagaagggcaggtgggcctagagtcacttccttttcgcagaggacgattaagctgactttatgctcataggagagttgtttgggagataattaacacttcctttccaaagaggaattaagaggttagaaaatgtgtgtctagaagctgggaagaggttggaggattgctcagtgaggagcagcaagtcagtgtctctttcagatatgaaggaggtgaagtagaatttataagaggtaaaaagagctaagaacactttgttttaacctataacttaaattcctttgaactcttgactcgttgggggtattacattgtttatagtaggtattagaggggttttcagttttcaatgctctattcatttctcatagtctctttgctctctaaaactcatcttcctaaagtagcagtctttctttttaaaaaatctctagcgtcttgagtgtaatgggaatgtaatgactactgaatgaatgaaactatgtatgttctgttaaaacacaggctatggcttctcttgctgcttttaggtggccatgcctacataaaatccaccctggtgcagctgaaactctctaacaggcagggccattgtacttctcatgttggcttctcaagagcgggtctatgagcaccccattccctttcttatttggaaagaaaacaacactcaccacggcattcacaatgctggggacctgatgaatgggaatggagaggctgcactaatgtaagtggggtcaacatccctgctggagggcagatgcaattttggcaaactaatgacttttggaagccattttctagactgcatttttctcttctttcttagaatgcttttctcaaggggaaaaagaaagcagaggtgtaaatggtatctggccgttcgaagagcccgtctgggagactctctgctgaccacagcactgtctctccccagggcccagtcccacagtgtcactgagtccagagtcgggactccaacaagccctccgcattccagcatgactgtggtaaaaacaaaaaaaatctattttattctagtccatcacattttctatatttgctaaagaaatctcgatcactccataaatggtcggttaaaattaaaaatataggctgggtacagcagcttatgccctgtaatcccaatgctttgggacactgaggctggaagatcacttgaggccaggagttcgagaccagcctgggcaacatagaaagaccccatctctacaaaaataaaaaataattagctgggggagcctaagtcccagctacttgggaagctgaggctggaggattgcttgaccctgggagtgagaggctacagtgagctatgattgcaccactgcactccagcttgggcaacagagtgagaccctgtccgtaaaaatcaaatcaaatcaaatattttaaaaattaaattaaaaaaattgttcgttattttaacaaagtcttctcatgaaaccacacccagaccaacgatagtagaaaaatccaacacaaataaaacaaaacaaaaagctgccatgaatgatctgtcttgagttggtccatggagattggattagtcaatgaatcagacttttatattcaaactccaagtgagtaagaaaaaaataaatcctttgatatatgcaaaatcaggcctgttttaggataatctcattaatttagtgagttgcctagactactgctgaagaatttaggctggcctttctcatgaagatctcttgtagataaaaatatatgcatttggagctctgcttcttggaataatttaaatgagcctacctgtaggtagtgtggtgtgttcttgatctgtatttgactgaggatggtagatatgggttatgatttggtaacgaagcttggaaaaccaagaactatcatgggttggaggtccagggaagttgtggaagtcagcacagtggcacaggcaaccagccatccagaatttaaaggtcaaggtgaatcaatgggtttaaagcagtcaaccaaagcatctgtgaataatgaatcgagagtttaggtcgaccaggaggccagaaactaggtatgctgagagcaaacagactgaaaggtgtatgaaaggacaagctatggtggatagaatacttaagggaggccaggcacggtggcttacacctgtaatcccagcactttgggaggccgaggcaggcggatcatgagatcaggagttcaagaccagcctggccaacgtggtgaaaccccgcctctactacaaatacaaaaatcagctgggcatggtggtgggtgcctgtaatcccagctactcaggaagctgaggcaggagaatcgtttcaactccggaggcggaggttgtagtgagccgagatcacgccattgcactccagcctgggcaacagggcaagactccgtgtcaaaaaaaaaaaaaaaaaaaaaaaaaaaagggaggccaaagcaggctggagactgctccatctccctgtgactgcaattttctgttcttcctgttagggcagggggtcaagctcccagtggggatccagtgacctgcaggtagaagcaggtaggtgtgcaggtgaggagaaagtgaggccaggttacctgccggattatatgtattggggctcagaaaatgttactcaaaaatgaaagccttagaagcagctctctctgaccttttcccatctctgatcctcccgtctctggcccctcatcctcccacaggcgtagccatacaaactagaatccctcttccccaaggtggtttctggaaaccagaacccttttttcccaaagccagccataaaacctaaaaatgtcacttgaaatttccccttttacatctttctatgttaaagctaaacacaaagaaattctcagctgggcatagtggctcatgcctgtaatcccagcactttgggaggccaaggcaggaggatcacttgcgcccaggagttcgaggccaccctgggcaacataggaggaccccatctctgcaaaaaataaaaaattagctgggcacggtggcatgcgcctgtaattccaacacttagagaggctgaggtaggagaatgacttgagcccaggaggtcaaggctacagtaagctgtgatttcaccactgtacttcagcctgagaagggaaggggaggggaggggaggggaggggaggggaggggggggaagggatcctctgacctaccttgtttgactgtaggtcataagacccccattccagagagggtcctgccctatacccagaaggaaggaacgctgctcagagaggccaagaagaatctagacagacaggccttactgggtcttcccactcagtccattagacacattttgtccagttgtattatctacatggctgcccatacttcactgaacctaagcataaaaatagacagtttgcctgtatctttgggtctttattttgaaggctcctgtgtcgcataaaagtatgatcaaataaatttgtatgccttttcctctatgaatgtactgattttgtcagctaattttcagcgaactttctgagggcaaaggcaaagatttctcctcgccctacaggtgcatcagccaacaagaagtccctctatttgcaggtcctctttgtcctgtcaatttctttcttttaatttcttttttctttttttgagatggggtctggctctgtcgtgcagtgggaagatctcggctcactgcaacttctgcctcctggttcaagtgattctggattctcctgcctcggcctcccaactagctggggctataggcgtgtgccactacaccaggctaatttttgtatttttagtggagatgaggtttcaccatgtcggccaggctggtcgccaatttctgacagaggccaagtgtcccatataagtgaaatatttacttaacccaaggctcaatgtgttcctaaatttgcaagcagtcctcttcctcatttgcaataaagcaaagttcatcctcccctgagccgaggcaaccgtgaaattgacaagccaggagctgggaaatgaccgatgcaaagaagagcaatgccctttaacgcttcaatagaaaaaaaacgtaattacatcctcctaggccatgaaggcattgaaaatctataaggacaatgagcttagacttgattgttcgagtcatcaaaaaaacccagaatatatatatatttttttccagaaaaatgtttctgggtagtataatttgaggtaaattatactaaaatataattccctagagaagaaggaaattggtttgaggtattggttatttccctcttgttgcagaaacaaaagtggtgatttagaattcagagaccaggagatacctaggaggtgagagccatctgttagatctgttaatgtttcttaataaactgggggccgggcgcggtggctcatgcctgtaatcccagctctttgggaggccgaggcaggcggatcaccttaggtcaggagttcgagaccaaattcgccaatgtggtgaaacctcgtctctactaaaaaaaaaaacaaaaatagccgggcatgatggcgggcacctataatcccagctactcgggaggctgcggcaggagaatcgcttgaacctgggaggcagaggttgcagtgagccgagactgcgccactgtactccagcctgggtggcagaaggagactctgtctcaaaaaaaaaacaactgggaaccacggctcctcactcagctggaactaggggtctcggtagtgagccactgatgaggggcaagtctgagggccccttcctgagtctgaccacggtgaagtggcctggggtgctttctgcagggggcacgccagctccttcagcaaaacccaggacagatttcaaagcgttaaaaccagagcagcccacatggcggggttttatgaagtcgaacgtgtgtccagagcccaggggtgaagtttccccttgtggccaggtgaacagccccttcctcatttcatgtgtgatggatggaagcacctacctgtgggcatccaacccccaaccctttcagttccagatactgacctatttttattgtggtaaaatatacgtaatacaaactttacaattttaaccatttttaaatgtgccgttcagtggcattaagtatattcacagcgttgtgcagccatctccagaagtttttcagattgcaaaaccgacctctgtacccattaaacagtaacttcctattcctcccctctccatcttctggtaactctgttttgctttctgtccctgtcggtttgacaattcttcgtagctcgtataagaggaaacatattatttgtttttttgtgactggcttatttcactcagcataaggtgctcagggttcatccgtggtgtagcatgtgtcagaattcgcttcctttttaaggctgagtaatgttccattgtatggagagaccacattcatccatcagcgggcacttgggttgtttccactttttggctactgtgactcacgttgctgtgactaagagtgtgtaaatatctccccaagtccctgcttcccattcctttggggatttacccaggagtgagactgctggatcccatggcaatcctgtgtgtaatttgggggaagctctgtgctgttagatactgatctttcccacctactatttctgccacaggcagcgcttgctccactcctgaagcaggcagggacgctgcccacagacatgcctgctgacatctaggagtggcttagcctcatgagccctgctggtgtgggcttcaggtaaccctgtgctcctttgactcccaaggtggctggctcaccctgacctttcctccgtctgcttggtttgccttcgcattccgggctggagtgggagcttagctctgaagtccggctcacgtgtttggcccctaggccccagcctcgccctcgggtgtccctcctcctgcatacttggggctggctgatctgctcactgggaccctggagccttggtggtaaggtcagctggtctctctactcaggaccatgggacagggaaggaggctggaatggaggacgcctgctgagcacctcccactggccttgggtggtttgaggggttggtggctacaggctgattctggctctagactcatttaaatctccttgaatgtaggtagtcttcagggagtgggtgtgagttcaggtcaggcctaagagcctggaaagccaggcatatgctaaggttgggatgccggagagagaataggatccttttagatgtgaagaagggccctgagctgggagcagggttagcaaaagccagccatggaaccatgtcgcagccctggcaggcaccagtctccacgggaaagcagagaacaggtccaggctgagggcataagcccactgggttggcctgggtttgggaagaaacaaccacagcctagggcacaggagggcccctggcccatcctaagcctttgacacaagctttagagcaggtttacactgctcactagcgtacagccgccctctagaagtctgccagccctggcgatgctgatttaggaactgagcaggctggcagcttttcacacctgcagctgggagggatgagaaggtgcaatctggcaggacagcaccaactggctccaaacgaagcccctccccagccccactgtcccgacactgcagccacccgtggctttggtcatctcttttgtctagaactgagagtttctaggggctgcttggattctgcacaatgactgcaggctcccttccacaggcgtagacattacagccacggcagcaaccctctcccacctgggtcctcccttcctgtggtcccagggtgtcagccctggctgcccatgggggtcccctgggaagttttaagaaagtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacgctaaatgttctcactcatagatgggaattgaacaatgagaacacatggacacaggaaggggaacatcacactctgggaactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataacaataataataaaaataaataaataaataaaataaatataaggaaaaaaaaaaaagaaaagcttttccctgcaccccgctcctagagattctgattttattggtctgggggagggactcagtattgttatttttgagaagcatctcagggtttctagggtacagccaaggagaagaaccactgctgtagacccctagatcaccaggtcttggtggcttgcagatgagttcttcaattcacaatggaacctaagggtttcggtcagtggttctcatacctgtatgagaatcacctgcagggcatggaaaaacatgtctgtagggcctgggaatttgcatttcaaacaggttaccaggagaggctgatgttctggctatgtgactacactttgagagccatagatctaggccctcagatctcacagatctcatagatctaggctcgtagctcaaccttagttcttggacttagggtgattgagagaaatagaagcaagctgtgtccgtcactgtacttaatgtttacagcttcatattttcacatggcttcgaaagatctgccactttacctctgaactatcgtgggatagaaaccccagcagagcaactggcccatggaaggagttaataaacgatccttcccccatatgcagaatggaaaatcgactcttaagaaacttccacccaactttttcccacccctcccatgaaaaagttaaatcgtgaaaagaaatattttgtttaaagtaacaggatgtctccttccaccatgagggcccacttacagacttgaaaagcctgaatattagtaacatgcatttatttctacattaaagtcatttcttaatgatgtgatatttcagtacttgagttcgcccaacgtcaggaaccaagcagccaagctgagaccctgatcactccctcctttgtctctggatgggagactagaatattcagaggttacaacctgcggccaacagagcattttgactcgttatagaaatgagtgactcatccatgggtcatttactcatccgtctctcttccccgaccacgaggaaactgcaggggacacacttacttttctttaactcgatgcacaaagaacacaaatgttgctgattctgagacctgacttcctgttattaaagaggacatcgtacaatttaacagaacaagatttctaagcaaagcagaaggtctaatgatttcagagtttgcttcctacctacaattaactaggtcacagctgtaaaggaagagaaaaaataaatcactccaaaccaggagcactcaatgtcatcgtggccaaaaaataaacacttcagtttttcttttttaaaagaggggactctcaatttaacagaaacaagcacatttgatatacgctagaaaataaaaaaaatctgatcagacagtaggcaaaagcagtgtctcaggcccacttatttaatagttacacaaaacagaggagtgaaaataatgtacttcatatctaaaggctacaatatgcctcgtatccatgcagaacacttctttagtattatacacaaccgtaaagactcccatttggtcatgtaggagttacagagtttttaaggcccaggactgctcaggtctgtaggacttcgcaatttggcaaatgtgaaattctcatagtggactcttcgaccttggtaggatgtcacagaggaagagatccttttagagtggattgtatttttaagtatccccagtgcccaagaaaggaatgctttcagacagggacatttcaatgtgtttagtcccttcctttctctcttatgatcacctccaccaggaggattttgtttctctttgagtgggttgtacagtcactactaattttgtctaagtgtttgcataaaatagctgtgggaaagataattaatggatggatggatggatagacagatatctacatatatacatagatagatgaatggatgggtacatggatggatgaattggtggatagataccgatggatagataccgatagatcgatagatagataggtctctatagttgaacagatggatggatagatagatggatgaacagagagatctctatgtagatttctatagagatctatctgcctatccatccgtctatctatctatctacctacctacctacctacctgaaacaaagatgaaaaagaaaaataacctatgagcatggacgtcagagaggatactttagatcctcgacctcaaaatgccctttataggctccagcctcagcaactacacgggaacttggaggaatgcagactgcatctgcatttagtaaaacccccagatgattccattataaactgacgcttgagaaggtgtgctttaggacagtgattttcagtaactttttttttttgtcaattatggaaatcttttcccaaatgaaatatttggtggggacataagaaatatcttagaagcagagctctggttgaccaggggtgaggggggtctcagtcttccagccccctagtggcacctcccatcccacactgcgtcttagcggtagtggctcctgcttctgagtgggtatcaggggtcctggtgtttttgattatgttgcaccctaacacctaccagcccagaggctaccatgttgattcttctgaacaaagaagccctggcatattatggatgctcaggtgatattagatgatcattagtaattgatttttttttcttttttttgagacggcgcctcgctctgtcgccaggctggagtgtagtggcgccatcttggctcactgcaacttccgcctcccgggttcaagcgattctcctgactcagcctcccaccacgcccaactaatttttgtatttttagtagagatggggtttcaccatgttggccaagaagatctcaatctcttgacctcgtgatccacccaccttggcctcccaaagtgctgggattagaggcgtgagccaacgcgcccagccaataattgattttaaataagaatacatggacaggtacagctcagttgttccagagatgggcatcagaggggaaatggaagcagggagacagcctattgatgatgagaggaagacaagacagagggcagagagatgggagtggccctatagttaagagttgccagataaaatacaggacacccagttacatttgaatttcagacaaactccatggaacatgcttagatgaaagaatgattcattgtttattgaaatttgatgtaactgggcatcctgtattttcatttgctgaatctggcaaccagacctagagttcctttctaaagggacacttttctcagcagcttggattccaagggtctcactctaggttagacccccatttagattcgctctggagagttttctgaagtcagactacctgggttcaaaccctggatctgccactgctggctgcgtaaccctggacaaatgacttaatctctctctattctctgttttcctattctagaaagtggggttaggaataagagccaacctcaaagggctgctctgaggatcagaggagaaaacagctgcatagattaagcacatagaaagagctcattaaaggtactttctattcttggctgtgcttctgggtctcagtaacttccctctctgcctggatttgctcctggccattttcttggagagtgagacccatccagaggggaatgtgggacaaggagggaggaggaagtaaggactgagaaggcccagagacgtgccttcctcttctttccagggtcctggcctgtcttgtctgttgggcgggtatgcttccttcctggccttccttgtggagcatgtctgggagtgtgctaggaaatgagggaggaaaatatgtaacttgatatctgctccttgaccctggctgacctggttaactctctccaggatggaagcaaagcctgcccgggaaaccttccattgcaggaacatctcggcctgaagctgtcatcagggagcaggatctgcttcccggactctgagcagaacaatgggagccccagcaggctggcgaggctgacaagccctaggacggtgacctctccgatctccagatcggaaactcagaaacgtgtaagtgccagaatccgcatttgggaatctgttatttctccctctgcgagtcaacctgatcaccctggaagcctcactgtctctcagcccttgttcccatttttctttccatgaacaccgcaatcagatacgagattccagtaatgatggttcttgaaaattaaacaaatcaaaaagaaagccagccaaggtatggagtgggggacctctaagttcccctggaggagacactggggccaggttccgaggtgcattcggagccagaatccctaatggaattgaacaattatcctgaagctgctctctgaaagccgcggttttcctaaaacactgtgcttggcgtgcctgggcttcttggcactggcccatgacccacagcagcaaatcgttcccaggaagctattgttatttgtgtatctgatagcattcagctgagtacactgacagcaacatttagaaaggaaaagaaaaaagaagcgtagagtgaaaaggacaaaaaggaggcttccaacatcctggtgggaacagaaaaccagcaaagcctcttttccagcccttatccttgtgagtttggactctgcagaactgtcatcccccaggcatagctgcagcttgtatgaaggtgggcatcaggcgcggagattcaggacagtgtgcacctgctttcctccaacgggaccccctctgttcttcccaggaatgcctgtaaactgccactgcctctaggggctgcaccaagtccctgtgtactcccaggacacaatggagtggaatggagtggctctgttctgtcagggcctaacattccaaatgaattcattcccttctgggaaaaaagaaccaccttgctcagagcacaatgttcccatgtcttggcttaccttgaagcatttttgatacacctgttgggacaatgcgttctgccaagagaagggaagtagcatactttgttctattttttactctcaatgggctacgtttccattgtgttggtttcccttacagaaagtaacacacacagaagagaaggttataggattccatgctgcttggcaaaggcacaaaatatgtgcacatatttacatggaatatgagggtaaactagaaaattaagggtaatctaaaatagaaaaaaagaagaaaacaataagttaaaagtatgaaaagacatccagaatgagcaagttactgaggttgtgcctcaactttagcttgagtttcctggcagcaaaggtaaaaaggtaagtacattgaatcacatacttcttattatcttctaaaaggaattaacggagtggaatatataaaaagcactgaataacataaggaacaagatcttcaatggtcattttgaaaaagcctcagaagcgtgcttatagatgtttcttctgctggctttctcagcaagatgatactaagataccatcctaaccacctcatctctgcctatagcccaggctatgcctagacatgcctggagctatgccagtggttcaaggggtttctacaaacacttgcttctacctttgctttaaattggtttcttctcctctgatttctctggtctccacctgtttcttgattctccagctatatttgacacatctaaccggattcatgagtctttagcctgtctgtgggttggcttgcaggctcactgaccccagcaaactcccatgcctggccttgggtcctgcccacccacctccatgtcctgcctaagtctcgggtcacatggccagccccagtccaggccaagaataggttgctgctcattcaaaacaaaatgacactaaacatcagccctcaatagagaggaattaaatcttaactttgtaaaataatttcagcagggagttgagaaaatacagcataactatgttgatatttgattatttaatttaataaagatctagtgtaggccaggcatggtggctcgcacctgtaatcccagcactttgggaggccaagacacgcggatcacctgaggtcaggagttcaagaccagcttgaccaaatggtgaaaccctgtctctactaaaaatacaaaaattagccaggcatggtggcgcatgcctgtaatcccagctacttgggaggctgaggcaggaggatcgcttgacccccggtggcagaggttgcagtgtgccaagattgtgccattgcactccagcctgggcaatagagtgagactctgtctcaaaaaaaaaaaaaaaaaaaaaaaaaaggatttagtgtaaagagattaaagtaatgactagccaacatatccattgatctgcttctcttgcgtgtcctatgtccctacaaaactttgggctaagtgctagaaggtagtgaattcaaagttgccttatccggcaagagacagtgaggacatcctgagtttaaaactgaagagttgcatctctgctgtggatgtgacaagtgtgagctgctgtttagaagggacaatggagaagcctgacttgcctcctcccccagcagggacatcattctatttgacatcgtggtgagatccagagttcctcagggtttagccaacgtttccatcagaaaaggagctgtgaatccattcaagttcttgctcaaggacttggctgggaccccagaattccactccatctagcatgaaagagatgatttagaactgaaaggttttagtccagctgttaccagtcagccaccttgatcataaaagaacctctgtttggctcttgtgcaatctctagttttaagtaggaccacacactgctggtctgcaaatttgagttagcaaaatatacctctaggtggtagggtgattgttctattggctgaaattgcttgatttgttctgttttaacaccatcaatggagaatatcttcccaaaacaaaaaaatgttgctgatgatattaataagttgttctatcaggcaataattagaccagaggttcagttgcttctgaagttgttgtcctattgctaggtaataaaaccatgttctcagcaaagaggatgtcatcttcctgtttcctctagctggaggacgtgtattcaatgtattcaaatatattttaaaatttgcatttgacctgtcagaataggttttttttttttaaaaaaatatatattctgatttagcactaggattatgctgcagctggagggcctgaggatctattttaagattagttttttttgtagcaagatgtttcctttttatgaaaatcaagcctggggcaggggagaatatgtagatatttagggtgggacagtccttttttttttttttgagatggagccttgcttcgttgcccaggctggagtgcagtgatgcgatcttggctcactgcaaccttcacctcccgggttcagcgattctgctgtctcagcctcccgagtagctgggatgacaggagtgtgccaccacgcccagctaatttttttttttttttttttttttttgagacagtctcattctgtcaccaggctggagtgcagtggtgtgatattggctcactgcaatctcttcctcccgggttcaagcaattcccctgcctcagcctcccgagtagctgggactacaggcgtgccccaccacactcagctaatttttgtattttagtagagatggggtttcaccatgttggccaggatggtctcgatctcccgacctcatgatctgcctgcctcggcctcccaaagtactgggattacaggtgtaagccaccatgcctggctaatgcccagctaagttttgtactttcgtagagacacggtttcaccatgttggtcaggctggtctcaaactcctgacttcagatcatctgcctgcctcaggacagtgctcttttacttgtagaaattgaaaactggcatcttaggcaatgttattctttaaagttggattataaaaatagagatatttcatatctctcactctgttcctctctcacatacacacatacagacatatgtattttttccttaaatataagaacaacgcatacatacattttcttttgtaaagttagaagatccaggaacaccggccctggttttcccgtggcacagctgagtagtagctggcctcacctgctggggcaggagttttccaggttgcaatgtgcctctttctgtattttcctgctacatttcttccctgcctggctttgacacatatttgagtttataatgcctctacgaggttgtattttctcaggtgactagagtgaacaggagcgcagccacaggagttaagataaaggattaggtcttatgtgtaccatctgagatagaaaccaactctcaaacctagccagtttctgaccactggatctcttaaggacagaagttttcttgtactgcatgggccccactctaagatacatgagacatgtttctcttatgccaccttaaggccattgacagaagaaaaaaggaagtcacagagtcccgaagatatttttgtttgctcttaggtatgttggtttaataccatcaaggagaacacagaacacccaaccagagattctactagaaataaagggcgagtaagatgatctgggctgggcgtggtggatcacacctgtaatcccagcactttgggaggcctaggcaggtggattgcttgaggccaagagttttgagaccagcctggccaacataatgaaaccctgtctctactaaaaatacaaaaattaactaggtgtggtggtgcatgcctgtaatcccagctgcttgggaggctgaggcacaagaatcactagaacgtgggaggtgggggttgcagtgagctgagattgtgccactgcactccagcctgggcaacagagcaagactctgtctcagacaaacacaagatgatctgcagatggacgctatggctgaaccaaaagccataggatctaggtattgccccgagagtaatgtcaaatggcacggcatgtggccttgggagctgaggttctgctcgttgacaattggtcttcaggaagccaagttgaccagtaggctgacataagcacaccattctacgttgttgatttcaaatcgacaagtgcccgtatgcatttccagactgctttttttttttttttcttaatgagctcctctccctaaatgctctgctacctgacaacccagagctggggctcagcaggggaggaagcgccctctcctcgtcctccctttaaggatggcatcttagcctctccatgctgctataacaaatcccataaactggggagcttacaaacaacagaagtttattgctcatagttctggaagctggaaagtctaatattaaggcagattcggtgcctggggagcactcactttctggcttacaagcaaaactttcttcctgtgtcctcacatggtggaagggactactgagcttttgagggcctcttttataagggcactaactgtctcccaaaggccccatctcttaatgccattactttaggggataggatttcaatatattaattgcagaggaacaaaaacattcagaccatagcatatgggattcacatcttaatgacagtgattccagaacctgacacctgcactgctgcctacatgggtggacccggcacctatgcaccaggccagtgacaaagcaaggctgtcactgcccctgcacaggaacagcttttgcagagccctgatgactctgctcatctacacccaggcacataaatttcactttggtaacaaaataggcaaattcacaagaatcggcacagactcgtgggagggctcctgtaccacttgtctgcttcttaaacttctctttcagtggtatgaatttcatgtgtcaggggtaccatcttacttaaaggaaaattaaaggggctggtgaaggggaactaggcataatgtaactgggtgaatcccacatagaaagccttctctggataggatctacacggaagacttccttcctagtgttggcacctgttacttactttccttcaccctaattggcagataatagcaggattttcttctacaagaactccacgagatcttagaaatgatttcttccaatttgatccaaatccatttgcttttacagaatagatgtcgatccccaaattcggagttcaaattaggacttgctcatttcgggcagttgatggctggctccagcctaaattatactttctaaatctattctgggactcagctgggttatgaagccctgacccatgattacatcaagccattgaaaaaaattgaggcaaaacaaaacaaaacaaaacaaaacaaaacaaaacaaaacaaaacaggttttccctctgctagatcttaggacacctaagacttaggggtagagtgctggcttttgacataggtgaccaatagatgatactgaaattggtctttcatcttctctcttgcctttttttttgcatgggttgtggaagctggaaaagacctaagggacaattgcagctccatttttctgacatagtggctgaagggagggatatttaaaagaggaacatgctgtttctttggtgctatagggagaaaactcactcttggccttagttgtaataatcttcaccccaagagtctctaccatggtctctaattgctctctgtgtccaggactgaccttagggtgagtaaaaattgttctaagagtttctctcttttcccatctgcattattcatcacttcctctgctgtgttcttttctctaccccactgtgcctgtttttctggaacactatatattaaggcactgcttctcaaactgtcttctctgttatatgcccatgagcattaggttcaggatgtctgaggtggagaccaggcatctgatccatgtactgtacttagaaacacatggcaattcttttcttttcttttcttttttttttttttttgagataatatcttattctgtcacccaggctggattgcagtgatgtaatcttggctcactgcagcctcgacctcttgggttcaaacaagccttccatctcagcccccagagtagctgggactacatgtgagtgccaccacacccagctaatttgtttgtagagatggggttttgccatgttgcccagtttgttctcaaaactcctgacctcaagtgatctgctcacctctacctcccaaagtgctgggattacagccactaagcccggccaacacaaagcaattttgatgcatgcaatttgtgcaatcttttatgacaatgctgcaataaggtgatttcttagtccttatctcacttgactatcagcagcatttgaaaatccatcatgcccttctgggatcctctttctacctcactggctgctctctgctcatctccagtgctggttccaccacatggagcccatctctaagctttggagtggcttcaggtccagtgtgctgacaattttctttccatccacacacattccccagatgttatcatatagtcctctagctttaaatgccaatctccagtggtatactggagaatgtgtaactcttatcaactctctaggggaataaaagccctgctttgtaatgtttgccaatttccatggtgtaaattccctgccatggcccatttcaaactgctcatctgtcatcactgaatgtagagttgagaagaaatcacataattggctctggagagcctctcaagccagctccagtgaacccctgataatgtccacatcttatctccaatacagacctctcacccaaagagaaaacatatgtttttaacatcctactgtatatctccatttgaatttttactcattatctcaagtttagcacatcacgaatagaacccagtctctcccgcccaggctgtcatcactgaccagctcttcctgcagtggttcccatcttggtaagcgtcagctgcagtctacagctgctcagggggccgttcttgactcctgtcttcctttctccctccacacccaatctgtcaggaaatcctgccagctctcccttctagataaattcagagtccattcacttctcaccacctccagggtatccgctggcctaaatcatcatcatctgtcactaagatgattgtactagtaacctcatgcaacaccctgattccagccttcttctctatcaacctagtagctaacgtcatctttcagcccctgatcccctgatctttttcagtcttacccagagtaaaacccaaaggtccttctcatggcctgcacagcctgtgccagctgggctcctaactcttctctgactctttaacctcacttctgaccacccccatctcaccccttcactctgctccagctacctgcttgccatccctcaagtacatcaagcccactcctgcctctggcctgttgtacttgctgtgccctctgtgtgggatgttctttccccacatggctgtgtggcttgctcccatctccctccctgtccttccttgagagccacattatataaccatgctgcacgctccgtctccccctgctccttactctgctttatttctctttagagaactcatcaccacttgacgtactaccaattcacgaaagcgcagacttagctgtgtctcttgggcctagaacactgtctggcatgtagtcgatgttaaataaatatctgtgaaattaataaataaaatgttaggtcctaggtattccattcccagggatatctgtattctgggactgattctgtgtggttggactaggaccgcattttctagcaatgatcaatatacttctaacccttattggttttcctcattaatgttccaatagagtgattggagaaattgtgtctgaatgatccctccaatccctccaatcactctatgggaatgttaatgaggaaagccagtcaggcttggaagcctatagcgtttttgagaaaagttagcaagtaatgtaggaaaatgatcagaaggatatttctgtactatctcaaaatatccccacaagggttgtgattgggaagaaaagggactgcccatgcacccaaaggtgttaattgtgtagtaggattttaggaagtttttcatgatcaagttctccaccaagaagagctagcatcttaaaataagtcactgttaggactggtgatgacacggatgttcgtctgcatacaagcacaggcacactgcaaccctggcccttgaaggacaattctgttttattaaaggcttgagtttataaccacaaaggtattctttttgttcaggtagtcagcattcactcaataaacacttgtttatcctatctttatcccaggtattgttgtaggctctgagacctagtagaaaaactgaccaagtcctttgaagtattagttattgagtggccaataagagaagacaaaaaagaattaaaaatccgtagatgtggttcatccactcccagattagaataaagatccattgcacagtttcttctatatagttttatggatgtaggatagataatattatcctctgaggctcattgatgagtaaatacaaataaaagtggattgttttcaactatgtgttcaaagaaagtcttatattacacaggtggataatattcattatgttagagcagtttctaagagatctgtttcaaagcatttaaagaaagccatttcccccggggcaggtgtggtggctcacacctgtaattccagcagtttgggaggctaaagcgggtggatcacttgaggtcaggagttcaagaccagcctggccaacctggtgaaaccctgtctctactaaaaatacaaaaattagccaggcatggtgatggatgcctttattgtcagccactcaggaggctgaggcaggagaaccacctgaacccaggaagaggaggttgcagtaagctaaaatcatgccactgcactccagcctgggtgacagagcaagacgccacctcaaaaaaaaaaaaaaaaaaaaaagagaagaaagctatgtcccctttctccttgagaacacgattgactttgtgtacatatttgcaatatggcagattgaaagacacacaaaagggactttgtccatgcaccagtcaagaaaagaagcatacaggagaagctagattggatgtttttgatcttaaatagcctggaaggaagtcatgcacaattctagactctatgacttcggaaggcctcaggtaactatccagagactctcctcaatgtgctggacactgcataggatgtgccaggaatatggacccaactttcaaggagcctaaatagtttttttcccctattgagaatgacatgacccaaaaacccaacccaaccaacccatttatttctcttttatgtaaagtcaccagaaaacacaaaaactagctggtttccttatgctagcatcttgcccaaatcatcgatcttggtaatattatttccttggggcagctgttctcagtgttggctgcaggttggaatcacctggggatttaaatactgatgcctggatcctatccccagagattctgatgtacatagtctggggtacagatgggttcttaaaagctccttgagtgtttccaatgcaacaccaaagttgaaaagcattgttttaacatgacccatggcatgatggtgaggcatgacgaggggacaagctattcaaagaagagaaccatagctcagtttcaggcccagcctgagagctgccattttgcataggatgctgaaacgcctgggagtcctgaccatttgcatagatatttgcaatcctgctttccacaccagcttgaggaatgaaaactctggagtggtacccatagagacagcctttccttccccacactgagccaataagcaatgtcattctacccaagatgagaagtcaatggcttaacatgacataagctgctatacaaaacaaaataaatatcggttcaccaagtttgggtcacttaaaattgcacgggcctaaccaatgcagggaaaatggccttcaatgcattctatgaaccagagaattggagtccccagtagtctgtgttctttttctccagagaggcgtatatttatagaaggaacaaaaccccatgcaggatgagggggctggctaataatatgtgtgaatacactgatctgtctgaacagttcttggctgcctgcgctcaatggtaataaatatccactgaaagccgtctgctgtatgtgtttttggtaacgtctcacacttccctgcatgaatacattcagaatgtaagcagcacacactcaacgatagagactctgttgtattccgaattcttaagttatgcagcttagcagctgtgataatgtaatggtttgcaaaataatagactggcaagacgtcaacctggaataacacatcatataatgaatgatgtgggtacaaaaacgtttaatttatgctgtgttaaaaatatcgctccagaaatatcccaccatttcagtctttcccagacacacaaaaaccctttcacctaaagtattggaataattgtgataaaagagaatgctttcttgtctcatttttcccccaataaaatcatcagatttgtactactttgtgaagagatctatgatttgagtctgattggctgttcatgcattaactttgttccacttaaagatgtacagcatggtcttagagttccgaataaataagaaaagagcatttcgctttctccgcttgtactgacacgtaagagtgaacacattttccaccagagataatgggacttgtggtaggttagcacgaggatggaggctgttccagtgtaggtcttaattctgatcctcttctcgaatttgctcactgacagtttatatgaacttttagatttcattcattctgtcatctagtggatatttattgcactcctgttatgaaccaggaacccaggggtgttccctgtcctcaagatgcctgccatcgtacggaggattatgactgaagcaaaccagtggtttcaatgcagtgtgatttgtgctattgtaaagggatcctagagtactacgggagccagcagggagagcatttactcagacttggggaagggatggggtgctggaagagcttcctgtggaattggctttaggctgaaagaagtaaagggggtggagggaggaggcagaaattgccaggaagatgaaaacacacgcaaagttcctggggcaagagcaagctccgtagtttggaggaacagcaaacatgtccacgcatggttggaatataacattcccagggtaaagcatgggaagaggtgaggctggagggctgtgattaggaaaggccttgtgatttgtccttatcctgaggcagggagccacttaagggtttcagtagacgagtgacacaatcacccctcggttttagaaagagcacagtggctgcagcacagagcgtgaattgaggggagcaagactggccacggcgagaaggcaacacgcaggcaagagatggtggcgggctgcaccacggaatagaggagcaggacggggagagacgtttcagagctggaatggacagtgccttgtggctgtgagaaggagacgatggaaagagaggaggcaggaagacgccagggtctagtttgggttttaggaagctgggggtgttggaggagaagcaggattattaggagagatgacgaagttcatcgtggacatgctggatttgaggtgttgagatgttcaagagaacagtgatgtccagtccagcttgggggtctgtgggtgtggatattagagatgataagtcaacggggcagacgagcaatccagtaaatgcaggaaattatgctcccacttcaacaggtgatcttacagctggaaaatcagtgggtgaaaacggagatacagcaactctgtaagtatttgcacgactgggtcagagccctcataggcgggcatctcagggtgtgaagaaatatacatttctcagcttcctggagcccaaactacagcagcagagaatacagacagaagcctagcagatttcacctccacttaaaaccacaaactaagacaacatggggtgggccacataaaaggttcactcactcattcttaggctttgcatctataaaggtaatctccaacataaaaccatttcctcgtattgcaaagttatagcagtttaataaaaacttcctccctgccccaaggcaaacgcccaggaaaaaatttccacattttctctttccttaactcatttatatgttttgttcttacatttattagaattttccatgaagttcatttttactttacttctggaataaaaaccatctggctttagaaggaagagaccatacagaaggatgtgggcttgagtaagttgagttacttgggattcacgtgtagtcagttagaaaaattttgttttccacgtgtcttacataaaattgggagtcccagaaaagttatcaccacgacacaatatactgcttgtcttggctttagcaagcgaatagccctaaaggatctccccaggagacagggaggtgtgtctaaatataaaaaattgtcatctgtttattaaaaatacaagactgggtgcggtggctcacgcctataatctcagcactttgggaggccaaggcaggtggatcacctgaggtcaggagttcgagaccagcctggccaacatggtgaaaccccgtctctactaaaaatataaaattatccaagtgtggtggcgcacgcctgtaataccagttgctctggaggctgaggcaggagaatcacttgaacccaggaggtggaggttgcagtgagccaagatcgtgccactgaactccagcccgggcaacacagcgagactctgtctcaagaaaaaaacaaacagaaaaaaaaagatacaagccaaatgttcttatacacaaagacaggcaatcttaaaaatgatgcctatcattatggactacattttatatgattgccaggtattgtgttacgtccttgcatacatttttggtgatcctttacaagcactgcaaaggggtgggcagtgtggatgaataaaccgaagctgagaaagtttgagtcactctatcaaggccatatgactcgtaaatattcaatagttaaagagtaaatagtaaaactcgtaaatagcaaatagacaagcctcactcttgtcaccccaccctgctgctttctgtagcacctaaattgtctttgttacttattttgtagcttaattctagcctgtattatactgacttctaattgttttatttatataaactttacaggcctaatctctcctcccataccaaacgtggcattttatatttctttctttctttctttctttcttttttttttgagacctgagtctttctctgtcaccaggctcgagtgcagtggctccatcttggctcacagcaacctccacctcccaggttcaagcgattcccctgccacagcctcctgagtagctgggattataagcgcataccaccacgcctggctaatttttttgtattttagtacagacagggtttcaccatgttggccaggatggtctccatctcctgacctcgtgatccgaccagctcggtctcccaaagtgctgggattacaggtgtgagccatcacacccagtccattttatatttcctttatgttttccaccctccctagcacagtgacgggctcttggcagtctgaagaagcatgaaccagaactaagcctggtctctcaggatttggtggatgtctaagttgcagggttaagaagttgcagttccttctttcaactcaacctctagcagttggatacagaagcaattgtcgaacctgggcacctaaggggacaggactgtcagtgtcctggaaatcatgttcttctctttggttttcaccacctcttaatggcatatcttctatatttcctttaatgcgaacacaggtaacgagttggttataacccttttctcagggccaggctgccatgccatcgctcctccagagagcaaacacgaaacatgatcctatggcaagaacatacaatgccaggtccctggatttaggtcctgctctgtcattgactgtatattcccataaagaagattaaaactctccacgccttggtttccctgtttatacaggacaagggtagtaacccctgggctctgtgccttgttagtgactcgcaatggtaaagcaggggaatgaactgaaagccttacagaaatgtaaggtcttccgcgtcattagatgctgtgagacaatggaaaccaactcaaatgcctggcgcccttagagccgctgatggaactgaacaaactgctattgctttacactcccaatggaagggtgctggctctcagtgtttgcccttacctctcctcctcttctataaacacaggactccattctgaaaattgtcacagaattgtcaattcctctgacccacagtgttagatgtccagtggaattgacaggacatcatacatttcaattagttccactctccattgctctggagggtgaggtgctacctcaccttcacggggaagacccaatgttccaaggatgtgcagcgcgggagggccccaaaccattcagaccatactcatgttaaggcccatgtaacggtggggtgtgctcaagggcagaaaatagccctgtgtgctttgaaggcaagtgtgtgcaaacatacccaataacagacatgttttgtgtatgatactatattcccatattgtcaatttttcttaaattagtaaacaatgactaacagaagtggtaactgcctatatttgaatttatgcaaacatacatgatttattaaacactttatctggagaacataatggtataaatggaggtttccaggcgactggatttgtgtgtgtgtgtgtgcgcgtctataaaggaagactatgtgctcaatgtggccattcacacagccctaaggcacacaattcacacttccatgttagcatttgtgaataaatatcttaataatagaacacgtgataaaaattttgttaccatacagaccaaagagttttcactaacacctaacatcacactcaatagcagcctgatcaatgtgtaaattttgctgtcactgatggcctaagatctaagctattggaataacatgaaatacacagtaagcatttaatacatattagttgatgatcttgacattcagaacaagaaataagtctcaaaataaagaccgacacacaaccagaatagaaagcaacgtttttttcattattcaaatggcagaaaaaatgtaactcatcaaaactcaggaaatcaacccgacctaagtatttagttagcccctcacatttttaaacctttagtttttttttttaaataaaacatcgctgagtagtaagttataccaaccagaaaaagtcacttgaattcagttctgatcttctttataagatgctgcggatagctgatctaacaagagagcttcatgtgatgctatttgctttattaggtcttggactacaccttaactgaagacgtctatgtaggtgacgaaaactcatggaaggacttgccacaattcaaacatgggcttttggggtttctgagaccaacagaaccaccatatactttgtgggtgtagggattctccctgcatgttgagcctgtcaccctaatgacaaccagctttgcattaactagagtcagccccaaaaatgcatctgttactccagagaaggacaaatccttattattactttataggattttctctactaggggcttccataaagtaaacatgctttcaggaaattaacagagtaattttaagccaaaatccatagcattaaaaacaaataaaccccaaatgatagcaatgtatttggggggaaaaaagcatgtaatcaactgcctgcataatttaaactaccaaagctttgaagctccttaacatcaccatcacctcccttttagacactgtcacccagtagaagaaattcacagccctgctgctctaatgagtatgtttcagtaaacacagaagaaatcattttcacagcccccatgcatttctcagcaagcactcaaatctttcaaacccattccagggggaagtttccatcccaatcttttccctcatatttcatctctaagagcacccctcccccatctgagatccacaagttacaaaaattactgtttcaggtttctcatcattatctgttaaaaaactaaaattacagatgagatagtattctacagtcccaggaactccaactgttcaggaaacgtgagtaacagaagtaacgcggtatacaatgaaaacaaacatcttcctgtctttggagcaactgagaagcaaacaacccgccacgtagcttaccctttcaacgctgcgccttctcagagatccataaggaattttcagtaaaagtctttgggatctattcggagccactgcagcctgaaccaccatggtgtacagctgtgtgtgtgtgtgtgtgtgtgtgtgtgtgtgtgtgtgtgtgtgtgtgttcccagcaaagggagagaaggagcctccctcaaaaataagttatggtctcctggagggttcccaaatatcaaataactgaaagagtttttctttcgaccatctgagtcaagatgtggtttgtcaggaggaggggggatgggaagaaagaaaaccagcccaagttctgcaacttcagcgcccacgaagcagcatctctagctttcttccatctgtccctctgcacagctggctcagcgagactgccgtgtcccgcttgtgggcaagtgacgcgtctggggagagtgatccagaaatgtcaactttgcttctcgtggctgcagatggtaatcaggtcagttgtctaatcaaagctctatcagacgtattattcattccatcacgtgactcccaagcccctcggccgtacagtaggtcacatgctcaccttaaaaagactatttggaatatcaccatctggagtggagattaatgcagaatcctacactctgatttcactcccttctgaacggaggaacaatatctgaagaccacagacagaacacatcagggacctctttgaaatcataaattctatctataaaactgagcatcagacatgcgtatctgtttacccttcctgctttctaacgcataaaaataaacgcacgggtattactcactgtatatgtgaatacagtccacagagagaaagtatgagggaaagaagaagaaactgttgcaatcacatggttcagatgaatcaaatcaaatcgaacaggcttgtgtttggcaccttctcatttaaatgtttgtgttatagaacatttatttttacgtgtgccagtaaacaagaagaaattatgtttcgttttacacggctgtgtcgaagcagattcatccatcacgtctgtcaattattttctgatcatattgtgtaatttcagatcacacagccttctttgatggatggcataaatggtctcaaacgttaacttttctgtaatattttcccctaccttccccatctctactcctcctgaaatcggcttatttccatagcagaaaaaattactacaaagaaaatcaagtaaggtgcttccaggatatggggtatgtttgggttttttttttctttttctttttaaagcatttctacatacactgcttctgtctgttctgagttttatgaaagggatggccatttcctttgtaatcatcccgtggtttttggtattagccttgataccactcatacgctctgggcaccagctttgagacactgtctgcagaccagtgtgcttacttcattgaaaatgacggaaatgaaggttctgtttattcaaacacacctaataggaaatgggggtggggtgcgaaggaaagaagcagagttttgtactatgagaaaatgaatcagaagaaagaggcgaagggtgccacggcggcggcagcagcgcacgggctggaaacctgggttcagccctccagcgcagacacacatcacgagtcagttaaagaaagcatcaggttgatgtgggaaattccaaatatacaacaattgggctttgttcgtaattggttccatgtgtgcagtaggagagtcagtgagagggtgagagagacggggagacggaaacctcttaaccacggctcacacggcgtctttggtgaggtggtttaggtttacatctcttttttctctctttcttgcttcttgcctgcactgcctggtttcagagcattggcggggggtgggaaaaaatctggaacgatacccgatgattgagccaaagcaagagaaactcatttctttgtaaaactgcacttgacgttgtaacggttttgaacaaaggataggcacactttcagaacactttatctgttgagagtcacggcatgtcattcttccagctcagttttggggtcggtgggggggacaatgatgagatggactgagaagccactgtcctcttctctgacccaggccagggcaaagccccggggagctgaatttatttacatttgactaaatgcaacttcctgtttcccaggggtattaatgagtgtttcactgtggagcttaggcttatggcatagttcagatcataagggacattttgatgaactaagtgcaaataaaacaaaaacacatgcatttgattaaggttaaaatacatatagaagagaatgttaatggtaacaaaaataaccctgggccagactcccacacatctgagtctcacacattccacatccttcccttgggaggcggggagaaggatcacttttcatattagcacaaaagcctcctcccagataatggagccctccccagtccccgcggagtaggtgaccccctccttggagtgatttcaaggctctcaaaggttgctggtccaaaaatatctttctgattgtcttgccatgggtgtcggagacttacatattcaaaattaattgtcgagtttaggtcttttttttttttttttttttttttaaatagagacagggtctcactatattgctcagggtggtcttgaactcctgggctcaagcaatctcctcgcttcggccccccaaagtgctaggattacaggcatgagccaccatgcctggccaagtatttctttccattgttagaatacaaatatgtttccccggaagggatatgcattcatactctcacagttatgaccactttaggagaagcaaggggaatgaatgttcactgagcacctacccattggcaggccatgtgctgtgaggttatcaaaggctacttccatggaggaaatgcgtttcattatccctgtttcagtggtgaagaaactggtgctcagaggggcttagtaagttggccaaggcagcacagctagaaatgtcagagctaggatgaaaaccaaagtcaactggtgtgatttcagggcccagcttgcctgtcctacaggactttatcagattacagcagtttggaaatcccaaaggaagatacatccattgaacccaacaggaaaatggaaaactctgtctttgaaaagaagagaatgtcaatataggaaattgttagattgagcaattttagagtttctggagctgctgctttgatgtcaccaggagttgggcacaggggacggaggggctaagaaccacaaagggggaggcagggaggctggcctaaggggtcaagggaggagccgagttattagagccaggggccaggtcacctagtggagtctagaaccttggagacccatccagtgggagactcagccgctgctgaagccttcatccatggtcaaggggaggtgaggagaaatgcctggcccttctttccatctgccttccaatctcctggcagcatcttccagccagttgaaagggaactgtggaaatagccatataggcagggcagggaaagggagagccatagatctgagtatatgtggctctgggccagccctgagggaccgagacattggaccaaaggaatgggaaatggtgaattaagggtgaactgaaaagaacagcaagagaaggcgggacacggtggctcatgcctgtaatcccagcactttgggactcagaggtaggtggatcacctgaggtcaggagttcaagaccagcctggccaacatagtgaaaccccgtctctactaagaacacaaacattagctgggcatggtggtgggcacctgtcatcccagctacttgggaggctgaggcaggaggatggcttgaacctgggaggtggaggttgtagcgagctgagattgcaccactgcactccagcctgggaggcagacagcatgagactctgtctcaaaggaaaaaaaaaaaaaaagaacagcaagaggaaaacctatggaacaatattacatagaaagagcaggttgttgtcaggatagtggatgacacggtaccctcagcatccaggaatggcctaatggctgctggatgtggggtgggagttgaggggggaaagatgcctcagggatggggggcagtcaacaaactgtgtgcaggagagggagatgtagaagacactcttcagttctagactctccgaagctgctgcttttgatgcctcagggagcagcacacttaaggctggcaaagccttttgtttgtttgctttgaacatttccttccagtctcaatgaaaatgtttgcattaaaaccctggaaggaaaatgcataggaatccattgagccaggtttcaggaaagtcaatggtcttgacatgccacagcaagatgtatcaaagcaaatgggtgttcttggtcacgaacagcagggtgtgaaaggggtggcgggaatggggggaatgttccattggagagagaacattttgcagtgttggtgataatggaggcagcagcaggagggggaagagtctgccgagccaacgtgtatgcacggtcacaggagcagactcatagatgaagccagtgcccgcgcggatgcatgctgaaaagccacgtgaagggtaaatgatctcctgatggaatcctgggtgctggcacggacatgcagcctggtcattgcagcccagggtgatcctgatgagccggcctcaactatttgtccaatcttttgcccagtgcctgaaattaccactagtgaggctggcctgtctgtcccctggaagtccactcacatgtgcatctgacctcagaactgccacttgctggcactaaataaactcattttcattgctttattttgttcatttggcagaatactgaaaggacaggccacaggacagacaggtttcagctggggacgtgactgaggtcacactgtataatagatgctgtcgtgacactcccagggcagaaggcaggctgaggccaccatgagccccagcagaaggggcaaaggatggtgagctggagaaagagatgggaaggtgacctaaggggcctttctgattttgttccttatcattctttcctttgcaaaaaaggcgaaataccacttacatgaaggaaacagaaacaatccaaggctgacattgtaaatatctgtcctaacctccatcttgagccatacttccttgtaacatcttgcagggtattaaaagcgggctctttctcagtgtcgtttgagggctccaggcaatagatggcaactattcccaccctctcccacacgccactcaaggagttaggcctctaagcaggacatgcacaaggggtgtctgagaagcaggtttgaaatccctcaatgacctcacctccaggctgtaggaggagggagagggaaacaaaagaggggtgtggggctcagggaaagagaggtgcctgaaatggcttattggaagagagacatctcttggaccagggaattgcagagataaatccccagagatccccagcaaaaaacccacaaggcaccctgcaaggacaagaggtgggcttaaacacccattagtcccagagaaaaccatggccagcccagccaggcagggtgactcatgcctgtaatcccagcactttgggaggctgaggcaggtggatcccctgaggtcgggagttcaagacgagcctgaccaacatggagaaaccccgtctctaccaaaaatacaaaattagccaggtgtggtggtgcatccctgtaatcccagttactcgggaggctgaggcaggagaatcacttgagcctgggaggcggaggttgcagtgagccgagattgtgccattgcactccagcctgggcaacaagagagaaactccatttcaaaacaaaaacaaacaaacaaaaaacccaaagtccaaggccagcccatgacagctcaggcatgaaagctccctgctaggccctggcctctggtccacttcagccctggacgggtgaagacagcgcagtgagtatcggggaggtgggtggggatgcaggggaaggatttggaggtggagacacacacccatggttcccactgcagccatcacccgaacctgcccccagctgggggatgggagaaaccgtcgctttgatggaagttggtgttgtaattattgtcatgtgaagaagagaagaggagcaataggatgaaattgaaccaaaacacacgcaagaagaaaacatattcttcctaataccctgactcgattattacacattctatgcatgtaacaaaatatcacacgccccccattaatatgtacgtgtattatatatcaatacaaaaatgaaaaatagctgaatcttcaaaaagtacattcttaaaagacttggaaaattcctagagcaggaggggggagtttggaagggaaaccctgtgtttcttcaacattccatctccatcccattacctccccacccagctatagcctaggtaattcatgtcacgtctcattagaggaagctgggactgaggttagacaaacagaaaggctgcctacatccataattttctgtttgaaaactggctggaatttaggccaaacatgaaacccaatatccgtaagaacaggaccaagacatcaagcaacactcctatcaccagacctcacatgcccaggggctgcgagattatctccagctcaccagtgtgggaaagctttctcttggttttacctacggtttgctctgacacagtgcgctgtttgcagtatctgtctttggacagacttttcctcctcctgtgccatttggaagactctaggcagaattgtagctagctagggtgggcagatacatttttccctccctccctcccttccttcctttccttacttcttcctttcttcttccttctttccttccttccttccctccctcccttcctttcatcctttcttatctccttccttcctccctccctcccttccttccttcctccctcccttcctttcttccttccttttcttctgtccttccttctctctctctctttccctccctcccacccttcctttcatcctttcttctcttccctttctccttccttccttcctttcttctttccttccttttcttctgtccctccctccctcccacccttcctttaatcttttcttcccttccctttctccttccttccctccctccctccctcccttccttcctttccttcctttcttccttccttccctccctcccttcctttcatcctttcttcccttcctcttctctccttgcttcctctctttcttcccttcccttttctccttccttccttcctttttctcttcccctcccctcgcctcccctccttccccttcccttccttgactctctcttccttcccttgccttgctggactgcagtctaggcttcatttaatacttgtcctccatgagcagacaggcaaatgagataaaggatgtttagactgaattgtgcagtttgactcctgcttatccttgctgtgggagagggtgtggtgttctaggataagtggtcaactcctcgcttctgccatgacactgcccatgctcttcttgtattctgtaccaagctccatgatactggcttcatccttgtctaaatgaattgtattattttcatttattgcttatgttacatcattcattcaaccattattttattgagtgtctaataaaataaggcaattctcttatacggcatattctattacaggcactattctaaagttttaaaatatataatttagttagttctcatgacactttatcaaataggtactcttattttccctggatgaagacaaaaggactgaggtacagagactgaagtaactcactcagggtcacaatgagaggctccagtgtccattgaccgcctccctcttctgtgtcactacaacggatcaagtgctgagccaagaactggggatgcaagataacttttgcttattggaagagttttcttttgttcctcaaactcagctcctctctgtgatgaggcgtctgtggtgaagtgaaagactgctggccttagccctgagtctgcatgtgaaaatgtcatcacaaggggaagtagacctggccctcttccagggcagggaggaaaacgcagcctgtgctgcatgggaacttcacgtgctaattggacatcccagaatctcactaaatctttatcatagcaagcatcaatcactcaatcttcatcatagcgagcatcagtcatagagaatgtcaagtctgctgaacacctacccaacaggatgaaacaatgtttgtgaaagttctttgtaaacaagacgtgtgcaccttcccttttcttccagtctcaattctgcacacggttttcctgttgtctcatttgccacaacagcctcctgcacttcaccgtctagccatctgcctcttcctgtctgttctgctataaggtccacgtttcatctgcctgaattccttaaaggccatccggcttagccacctattttgagtggtaaacagacttcttcttgaacctttgagagctccctgtttagtagatttcatttgagtaactatgagtacagaattaattcacccaggttaagaccccctatccccatcaaatgaaaatcacacatgacaaaggaagctagaccttatcctcttgcagggcagggaggaaaatgcaccatctgctgcatggaaacctcatgtgaaaatcaggtgtcccaggatctcactcgatctttctggcaaggatctagccatagagaatgtcaaatatgaatgacccatgtggaagatttgtcggtatctgtgtcagaaggccttgccttatggacatcaaggacaaggcccatcagcatccttgcaggctgttcagctcgtcatccacagacagagatcttgctcacaagctgcagatggattttatgcctccacacgaaggtccttcacatctggtcttgatatgatttgtccccaaaagaactccacttgcccttcccagcatgaggccaaatcaggtcatcagtggctatagcctggctaaaggctattctacatggtagtaatggcttattgtgtgtgctattaggagtgatgtcatgcccagggtttgaggaataacgctcctgcaagatggccatgtgattaaacgggtaataagctgacctctgtgaagctggctgtgtagattggctttcaagatcattttgcaaagcccgttttcatgtgctgtcagtcgtggatggattttgataactagcattgatttgccatgtttatgaagtgcagtttcacagggtaaactgtgtaattgcacctggaatggcaatataaataacgtccttatctatggtattgactgcccaggattcgctgaatatatatagcatacctccaaacagagccaatagctgttgactcaatttttactaggcttagctctcaaatttcaggtgtcttaataaggattgggtggcgaatgatcaacttttacatctgtttctaatttccatgcttccttttccaggaggagaaatttaacaagcaattttcttcaacaggggaatagttcatcttggttcaagtaatccctctggtgctgcaaaggacaatggctttctttagggccatcagattcctttcgctcctgtgcccagggacatatcactcccagggtcaactgtccatttgctcatggacatctgggatgagtcacgtggtatattttcccaaagtgaggaaggaagaaaagaaagcatcttgaatctgttagaaagacagtctctttgaagcctcatgtcatgggaatatggtttatgttgaatgtgttctagagtatacccaacatcctgtaaatcaaaacaccaaagtgcaagctgtgaccagaatgggtaaaacacctccagtggacaaatccttagaggtagatgaggatgagtaggggattctaactgctcttgcttgctgggggtactccattctaagaattttaaacctctatggcacgaatgcagttaatagactgttgacatgaaaattacatgagatagcacagttctgtctgtgagaacaagggtggtaagaaatgacattaaggcagctgggtgcagtggctcacatctgtaatcccagcactttggaaggccgaggcaggcagatcagaaggtcagaagatcatagaccatcctggctaacatggtgaaaccccgtctctactaaaaatacaaaaaaaaaaaaaaattagccgggcatggtggcaggcgtctgtagtcccagctactcaggaggctgaggcaggagaatggtgtgaacccgggaggcagaggttgcagtgagccgaggtcgtgccactgcactccagcctgggcgacaatgcaagactccatctcaaaaaaaaaaaaaaaaaaaaaaaaatgacattaaggcaagattctgacttgcatactatagaacaatatattttagatctcattccatgagcaagggggagccattttaagttacttttagggaggaagtgacaccatccaatctgagttttggggacttgattgataaaagatgaatggtagaatgaagaaccaaggtatattggaggccaagagagcaggtacaagattattgcaattgtccaaatgagaaatgattaagtgcagaactaggacattgttcttttacaatttctattctgacagactacaggaaggatggtcctattagtcaaaataaatgcacaggaagaggggaagatttggggagatgataatgagtagctcggggcatgcagagcttctgatgcctgaacattttgacctggaacttaggagaagagtcaagcctgtaaatgcagctctggatttcaacaagagaataccgatcactagataagttattagttaagtgtgagggcagacattcaataacacgcacatttacttctcatgcacctttactggaagatgtctccagcagaagaatgttagaagggaatatgaattccaggaaaaggattgatcacaggagaggtaccaagggagttcccagaataatagaaaagaggatcctcaagaagacagtcacgcaagagaccaagagaagagctaatccaattgatgcaggaggaagtagagcttcagaaagaatgtctcaaaaaagaaaaaaaaagaaaggagtgggttaagtatctgatgaatttaccaaattgagaggagttacatagctctattgaaaatcttagataaaaatgattgataaatacatagaacataaagcaaacactgaaataaggcaattatcaactccaggaaaaacataaagttgtaaaatccaagacatgccatcataatgtataacatttctcagatgtaaataatattttaatattcataataaaactgaattttgatttaagctgtgatgccaatatattcagtagacagagggggaagagacacatgtgtttatagggaaagagactcataagttggcaggaaaggactggagcctgggtttttctttctaagccttctagtactcttcagctttcaaatgttatgaatattgccatgtacacatattattttgataaaaataaaaattaaattataaacagaaggatcaatataaacaggggatttgagccagatcagatggacagtgatggggctgatgcctttgagaacgtgcccatgcaatgtcagtagcagaagtagggctgtggagggtgacctagaaccacaggcctctttctgaaaggacagatttgagtctgatactgggttatttaatccaatgagaaatgtttcaggaaacctgcttgatttcctctgtttctttttttcctttggggtgcgttgtggggctcctcatctatggacctgctgttggaatggctgctgaatgcatagcctccaaggtatgcctcggagagaagcattttaaatcttctgaaacgagatgcagacagacaaaacgaaacaggacaaagacgtcactgagggcactgccaacacttctggagcttgtcctgaagagccattcgtgtgcttggactgatctcccgtcttgtgctcttggcattggtgcaggatcctgcatgtacatttgcaggtgcgagcttgtgcacgcgaacatgtgtgctgcttcctctcacgaacccagcagcatagcagcagccagagacgccccagagtgatgacaactaattatgaaacaccagtctgatctgtcccttttatctcatcttgcagaagccttgcattcccccaaagccccccagtggccctttgtaatcccagaaaagaagtgtcaatatggaaacagctgttcttgagatagtgggatgacagcctaatgagcatgccatcagctatagaggaaacccaaggctaatgggcttctgatgcaaatattctttctagaccatcccactcatatgagaaaggctacagtccccagcaagactgggagaggacacactggcctatagatgtcaagtcttcttttgttcttatttaggtttttagcctctcaaaccccatggggcatcaggcaatctccctgactcctctggaaggtgactggaaaaaaggcagccccaatttttttttttgttttgtttagaggccatgctagggaagccagcaggagcacagggctcctgcaattttggtagcaggagaaacagccacaggttgctgtggttcaggcagggagtgaaggctgtgcttagaaagaacccaaattcccaatcattcaagggggaaaggttagggagaaatagtgggagagagctgtagaggtggaggaaagggggatgatggattgcagcaggcgacttaaaacagatgccttttctaggggcaaggcaagggatgaagagaactgacctaccatgtgcctccttggcatcagacacacccctggacacttgctctatgtcacctcttctgaatcttcaccatgatcctgtaagccgggtagcattagctgcactgtattgataaggaaactgaagctcacaaagacgaaatgcttgccaacaatctcacatctaggaagtggtaccaagctgggattgagacttgagcccatgagactttaaagctccctctcaattttctttggggatgtgtatataggtggggaagctatacagaaaataaaaaaaatctttatataaaagctggggggtccagacatggtggctcacacctgtaataatcctagcactttcggggctgaagcaaaatgtttgcttgaacccagacattcaagacaagcctgggcaatataacaagacctcatctccacaaaaataaaaaaaaaaaataataaaaaaaacagctgggcatggtggcttatacctgtagtcccacctacttgggaggctgaggtgggaggattgtttgagcccaggaggtcgaggctgcagtgagccaacatcatgtcaccacactccagcctgggggatagagggagaccctgactcaaataaatacataaatacaataaaataaaaataaataaataaaaactgggggagggttctgtttccctctgggggagggagagaattttaatctagaggggatactcagagactcctggagtcctcactcacaatatttcatttttaatctgggtggtggttacacagggtgttcatgttgtaaataatcctttagactatccatacatgttttatggacttttgtgcacctcaccgatatcttacaataacaaattacaaacaaaaaagagtccctattatttttgcatccagtgatttcttcagtatatcaccagaacggcatctgaaatgactgtgtcagacaccagagtacaacctggtaagaaatgcatgcaatcatgagatttctgcgtttttttttgcattttattgctcccagcaaaagttaaattttacaataacagtaaaaatatactagttaaaactcaagcgattgatatgtatctattgaggtccttgtatacaatattctaggtgccatggaggttacaaaggtgtccttgccttttggatctcaggatcaccttgaggaggaggcaagacagagacacagaatgagagaattaactaagtgaggtcaacaaataatgagtggtacagagaggaagtgcgacagaaatccacgtgtctaagcttcgcagaggggagagaatttcattgaggcttgaaggatgtatgaacttcagacaggtcaagaggaagcagaattacaagcacaaagacatagtaatgagaagaggctcgctgtcttgcagagactaatgttgaccagtttggagtggggaactcacaatgggaaattataagagataggcttaaaagagaacttgacctccaaaaccttgtgtgatctggcccaaactttgtctagctgcctgaatttgttggaatcacatgatttaatataaacattgcataatgttaaatgtgatttaaatgcttctcaagggagaagcaggggcacaaatgttgctacagagggcaggcaaatgctatgtaaataaggggtaaaaattgagtgtggggaggttgggctagagatgataatggatggaagaactggagaagtgctggctgtgggaggatgagaaggtgagttcaagtgataagtcaaagatgcacactggggctatgaaaagatgggttgtatttagagaaaaggatggagtgtctgaccccattctctttcaaggtggagtgcatcttggagctgggaaaggagacgaaggtggtagaagtgttaggagaggagcctgcgggtaggggaagttaaggagagaatgggaaatgtattaatgactttgtggtattgaaataaaacagttccctgattaattcgtttcctccaatacgaccaaactcacaccaacactttggcatgccacagatcacccccaagagtgactccacagccatcagccaccatccccaccatcccaggcagtggcagccaggcagaggaagtggtccaagaaacctccctgtctgcagttcagtttctactcatacttctcataaagtcatgaccctggccatgaatctcccatccctggaaacccagaaggacgctctcccttctggacgcattcctcctccaggcataacttccaacacgaaggtcagaatgaatgcgagtcgcccagagccccacacccagccctgggaagggcgattccctctgggaattctgccagcacaatgttgcctcaatttgaagacaaattttaaattaataaagaaaaaaaaaagcctcagactctcacgtctgccaaaacacaccattccctgaaaggttcctgaaaaggactcagtgatgtactataaagaaagcgccaaccttccatagccttctccagctgcgagacgcagactggcgggtcctggaaaggtaacagctcacagccgccttcccgggggcagcgcagtgttgttcttggatcgagaagacctttcagctgccttaccacctgtgtatttcacagtcttgcagttccctaaacccctatgaacaacacagaacgaacagacccgtggccaacagaaaaccctgagaaaagtactggaagaaagagtgtggttggtttaagatagaaatgatgtgaaggttgcagtgcgtgccctgcagttttcaaagcctgcatcgctaaaatcatcacaggaatagaagtgtccttgtcagctgctcttttctttagcagagaatctctcaaacagcctcaggccacaaaatcacttcctgaggaactcttggtaactgaatgcctctccaagtagcagggacccacacactggaattctggggacagtgaagttcatgcttctatcctagattcagcatcctctaaaaaaaaaattagcattttgagcaccctccccacttttttttctgggatggtcacttcataaacaaacaaatgtggttcattcagggaatagctactgaagctgctttgatctcttctggcaaatggtttctatttcttcaccctattcattcagatttctgcaagtgacttgattctaaacccacatctctactatttaatctgcatggactattctgtgccactcaggcactgaggaactttacggttttctcccctgaccgcacatgagtaagaataaatcatgtggacttgggaactgcacagttgcagatcagaatgagattccgtaatggggacagggtcccaaggactttcggagtggcaggggagactctcttgcgcctggaataggaaaagcctttacttacaaacacatccatgagcaggtgctccagtgtcagctcaaagtcttccagcttggcagccaaagtcatgatgaatgtcccgatttgctctcagtccccgctgacagatcagatctgcaaactccccagctcaggaaacaccgtcggcgtcaaatttgatcacaaggcagggttgccactaatgggaagtagaaacccttaaaagaaagcagaacatcgcaggctggactgctcgagctgtgtagccagaaactgtacaaggatattttgaaaaaacaaacaccaaactctaataatggtgctatgggatcagaatgggcataaagcgaggccaccagatgaagactgcagccactgccttccctgtgtaacttcacagtccgaggtgctggccaagcgcagagaacctcaccagtgagtgaaagagagaagtgagatggggtgaaagcaagagtggggaaaatggaatagactgtctgactctgatatttatagggccacatgtttttgactctagcccatttctcagttgatttctgacctttcataaatggctaaacacactggagtgtattgtcgaacgggggcagtgggtcccacagaagttggctgtgaccaatgctagggcaattcacacagacacaccatcaatagttctttgtagagaacgtatcagaccttgttttgtacacgatgactgaaaagcacatagtcttgtgaaaaacaaggaaacgaaagttgtgagggtactaaatttttcctcagaatattattagatccctcacactgtctttcttctccatcctatgcaccccctctgctgcaagagtagataaacatcaaggaaaaaatttaatatctcgtgtcaattcctcaagcttctgccagttacagaatatccacgaaatcttgcaaatgcagtttctccttttctgcttccaaagtttgctttttttttttaacttaaaaatgtttggaaattgtggtaaaatatacctcacataaattttgccatcttaactatttttaagtgtactgttccgtagtgttaagtacattcaccttgtacttggttcacattgtactggaataaacaagatagacttgtttatttcatcaatgctcttcctgggatggacaagggatcagactgtggataacagctagtgtttcttatttaaggcagtctgctagtctcaacaatgacatcacatgattattgtctaagaaaaattttggggccttaaggatagtcactattacaccaccatccatctccagaactcttctcattttgcaaaacggaaacactgtgaccattaaacaataactccatttctcccctcccacagctgcctggccatcatcattctacttagtgtctctatcaatttgaccactctagggacctcgtataagtgagatcatatagtgtttgtcctttggtgactggcttatttcacttagtgtaatgtcctcaaggttcacccacggggtagcctgtgtcggactttcttccctttttaaggctgaaatcacgtatcctaagaaagatactgctttggacagtttttcaggcctgagaaaatctctcagggacacgtggctgtcaagacgctaatggccatccttgctgtgactgtagtaacaaaatcagccttcgtctagcaagccagtgcccagttctgtcctcttagttccctaaacactttctgttaaactctggtctcctgattccaaacagagtgtgaccacttaacagccaacattgatgtcaaagaaggtgggcctcatgagatcgagagggaaatataaatataacatttctgctttacagtaaaactcccctccctgcatatcagagctctctcgggtatgaacggttaaaactctccattttagtatctctctgtgaattttcttttcccagaggagatagacacagacttaattcaacatttcacacttaaacaaagctaccataaaattaagggcaaagataaagaaatggacaaaaagcactgtattatttcaaaagcagatttggagtcttgtcagatgagtttagcttgacagtgggtcctaaattgtacatgcatgttcttcgagttatggtttctattttgttttcaggcctctaatggaagaattagagcgggtcccacagcaggtgtctcttgttaggaacggcataggaaggggcgggcagtgctgagatgaatgtcttcaatagccaagaatgcacagaaaatctatttccctgatgggctaactgagctacagaccttcctaggggctcatggttttgccatgtctgaaattgattcaataaccagctgcatcacatcagcaagaaagtctcaacacaagaggacttcttgccacatagttgccatcttttgttaaaactatagctgccctgaaggtcctcaaaaagccaagtgccttctctcaccaagcaagacagcctgatgcccatgaggggccctatcataaggagactagggggagggtatgtatctgcatatgtgcaacattgttctagttttccagcgatctcagaggagtgttcaacatcaaattttctttctttttttaaaagaatttatttttattgtttgtgggtacatagtaggtgtatatatttatgggttacatgagatattttgatccaggcatgcaatgcatcataatcacatcatggaaaatgggggtctccatcccctcaagcatttatccttcgaaaaccaagtcctcttagcccctttccttatgaattaaatttggacaaaatgtttttaatagctggaatttcataagagatatactacttgtttgtttcatcaaccctcttcctgggatggacaagggatcagaccttggagaagagctattgtttccatttaaagcagttgccaagagagagttgagtctcccagtctcaaccatgactttatgtgactattttctaagacaattttttggggggctttaaaaacagtcaatgcggccgggcatggtggctcacgcctataatcccagcactttgggaggccgaggcgggtggacagcctgaccaatatgatgaaaccctgtctctactaaaaatacaaaaattagctgggcttggtggcatgtgcctgtaatcccagctactcgggaggctgagacaggagaattgcttgaacctgggagacagagattgcagtgagccgagatggcgccattgcactccagcctgaacaacaagagctaaactctgtctcaaacaaaaacaaaaacaaaaacaaaacaaaaatcaaacagtcagtgcattggcttctcttagaatgtaaatagcaaacttcagggataagaaattgtacatgatttgggcagagtgtgtggttcttactctagcactggggctctagaagaatgtattcagaacatcctgttcttccaacaaaagtcactttaatagtttccaaaggagagaaattgaccagaagggagttagcctgaagaatgcacaggaaattagtgtatgcggatgtcaccccgaagagacattaatcatgaattcggattttagtgaatgatatgagccacttggagtaactgggtaccagggaggaagtagaaccacaccagtgttaagacagaaaaacttgaagatacattcatacaagcaagttcacgggtgtcagtgcttatcggtatatgagaacatggtgaaggctggcttgggccgatcgattgtggatgttttcttagtaactatattctaactacctgttatatatttttttgataattatggggacattttattaatacttatatcaaatgtgaacattcatttgttcattcattaatgcaccctttggacaaatgtttatttactaactggggtatatactggcataggtgctggtgcctacaaagatgattaagatattgtttcttcttcaagaccttacagactagaaaagaggaggcctgatgtgattgaagtaatcttacattattttttcttgggaaatatgaatgtagagcgtaactccttatcaggggactcactctgggacttggggatgagggagagtcactgacaaagggggagaagaggctgttgccctacctaagaaacattaactgttctccatgctctgatcccttgtccaccccaggaggaaggttgatgaaataaacatatctcttatgaaaatccagatattaaaaacattttgtccaaatttaattcataaggaaagggactaacaaaacttgcttttcaaaggataaatgcttgaggggatggagacccccattttccacagtgtgattatgacacattgcacgcttgtatcgatatccatactcccaccctgtgggaagggcaatgagtgagaatgagggaggtatgtagtacacctcctgaggttgggatttgcagcactaagtggcagggacatcagggcagtgatggatcctagggttgagcccagggatcattgggtttgaagagttgacagccaaggtctcaatgctgacagcacaggatcctgctactatttatagacatttctttgatggtgtaaatttctgttggaaaaaaatccactttaaccgttgatcaaagcttggtggccacctaagaatgatctgacatgaaccatcctgctggggctggccggttgagaataattaatcagtgacacactctatacggtaggcaaacaccggaatttgttctgtgcatttaaataacaacacttgtgggtatgtttttaaattcagaaccgttaaatttctttctctttgaacctcagatgatcatctctttctcccatttctatgaaacatctcctccagcgggcttaacgttttagtggtaagattcaaataaaatagaagtctcggtggtggggtgggaattggctgaattatttgtaaaggcatgaagctggtctctccttagtccttctccctagggaaacggtgggcagatcgttcttctagagagagtattatagatttctgcagccctgaaaatgaatcatctgcttcaaacgcatgagtgctccgcaaaagtgaggttcttgcctcaactagattaattcagttcatatcaaccaatctctattaaggacaaccacgtgtaagcccaaagcagtaggcaattgcatatacaaaatgtgttccttgaaccattttcctgtctaacctagagcagtggttttctattcagcaagatcacatatttgaagatcaggtttgggcaggtgatcagaccaccacacagtggatcagaatcagtcagtaagacacattagttacctattttcatgcctgggtcagtaaacctaagtagaagtttaatccaattattaaataagtactgagatacttttaaagagcaaaaccactggcttttattttgatcacccaattagtcccacagatccagtttacatgaaaaaaaaaaaaaaaactacatgtttgtttttaatcgtttttgagttgatttttgtatatggtataaaataaaggtccagtttcattattctgcgttgtggatatccagtttttacaacaccatttattgaagagattgtctttttcccaaacctggaggatattacgctaagtgaaaaatgtcagacacagaaagacacatatactgcatcatctcacttctaggtagaaggctaaaatagccagactcacagaggaacagggtagaatgtggtttccaggagctggaggagggggaaatggggagatgttggtcaaggggtacaaagtttcagttacgcaggaggaataagttctgggcacccaatgcacagcgatgtgactgagttaacaatgctgtactgtctacttgaaatttgctgagaggatagatcttaagtgttctcatcataaaatgttttttagaaaaagaaagcaaaaaagaaaatggcaactatatgaggtgatagatacattaattagcttgatcctggtgattatttcacaatgtatacctgcataggaacattacatcatacaccttaaatacatacaatttttgtccgtgatatctccataaagatggaaaagaaaactctcaatgatatgtgtaagagcaactgatattaatgtcctaatgacatacttgtctatcaagcttctgccttaccttcaaactacaaagagagaggattttaaagattgtttgtttgtttaagtaaaacaagcccttttgatggccatatagacaacaagctgcctgtctgggtctagttaaaggctggcctgtctgctccagctatctcttggagaacagacatgttaatttaaaggtttgcttctatagggcccctggcagcctggcactggcctgggatcaggcagtggttctcagaagactacactcttagcatctgcccttattcttccatgtttgtgtagatggcttacacaaccaaccttgtctttcccactcaggatgcattttccattttgacagcctctccaatgagtacaaagcctctattcctctgcatccatctccagccccaccgcagtccctggctcatgcacccacaacccctgaccagtcacaaggatgaatttcaagactttcaaaactcagaagcagggaaatgagtgtcaggcacacccaggagtaccctgaacttatgatggggtgaaacataataactcatcttttctcagtcttgccatctgtcacttactgtaccatttggagtcaaagaggcttgcagggattccgaggtcgccaccagaagtgtgcaactggaatgtgccaggaatgatcgcctgggcttcaccacgtggactttctaaggcatttgtttgctagggttcaaatacacattgtggagacactaatctttactgcatcctcctgaatcttttatagacatttttttttttttttgagatggagtttcactcttgttgcctaggctggagtgcaatggcacaatctcggctcactgcaacctccgcctcccgggttcaagtgattctcctgccttagcctcctgagtagctgagaatacaggcgccaaccaccatgcctggctaatttttgtatttttagtagagatgggggttcaccatgttggtcaggctggtcttgaactcctggcctcaggtgatccacctgcctcggcctcccgaagtgctgggattttaggcacacccagccttacagatgttttttaatggctctttcccatctgtaacagacacacaggatttaaagatttccatgccttccggagttgtttagagaaccaaggcatgagctctaggcgaagctcttagagctggtctgaaatgagaagctgtggaataggagctggagctatgtgacgactactaccattgcatgttctgcactttggacaactttgagtggggcattttgctcattaatgtcattgccaaatccaggaagtctgctggttgtaaaacaatcttgaggaagaaccaccatccatttcacccaactctgacttagattttttttttttcttcccccattgcctttcccatgggccttagaatgatcaatgatgtttaatccctttagagtcagcggccttggttctaagaaatattctaagtttttaattttttgagatggggtctttctatgttgcccaggctgaccctgaactcccagactcaagcaatcctcaggcctcagcctcttgagtagctgggacttcacgcattctaccactgctggctctaacaagtatttaaaaatactcccttactgtcctcaaataaaattcatggatcgtgcaacctgcttacacatattattgaaaaaaattagcacaattctctgttatgtaaacaaaagatagtaggaaagtaatctgtcagcaaataacatatattacaatatgtaaatgtttgcagataatgcaactacaaccagaaatcatgaagaagtgatcgatttcttaattactgtgaggccagaactccaaatgctaattgccaaatgtctgtcatgttggagactcaaatgccactggggtattgccattagtgaagcgcttttcctgaaacatgaatagttcttggtgaacttccggctaaaacaaagcattatcaccccttgacttgcaggagagttgtacttgggagagtctgtaaacggtgaaccgcaagtagcgctatccacacccgcgacccctccctcactgttgctgcctgggaactacgttgccaccacttccagtgaaggccaccagggggcgccagcaagggggagctgctggcggacaccaccctaagacgcccaccctttggtggatgcggtgttctgtgccgtgtccaccatcacccctcagacaccagcatggcatcccctcaccccatctgttgctaggagccagcatccctggactgcactagtgataaaaggcgggggacatcctgcaggaaggaaatggggctgagtgtgtttgtgtctttgagcaggagacggtggtggtgggaaatcatgcacagtctgtttcccagtcttggtaactttgcctggtattgccagatatacccaagagcaattcaagtggctgcagtagtcaccaggtaggtctggaacgaaactgaatatctgcgaggctccactacgttcttttaagataattgtattggctgggcgcggtggctcacgcctataatcccagcactttgggatgctgaggtgggcggatcacctgaggtcaggagttcgagatcagcctggccaacatggtgaaaccctgtctctactaaaaatacaaaaattagccgggcgtggtggcacatgcttgtaatcccagctactcaggaggctgaggcaggagaatcgcttgagcctgggaggtggaggttgcagttagcctagattgtgccactgcactccagactggccaacagagcgagactgtgtctcaaaaaaaaaaaaaaaattattttagattcagggcacatgtgcttgttacatggatattattaatacatgcttattggtggagtgtgggcttctagtgtgaccatcacccaaatattgagcattgtacccaatagctaatgtcaaggaaccaacctaagtgtccaccaatggctgattggataaagaaaatgtgataggccgggcatggtggctcatgcctgtaatctcagcaatttgagaggctgaggcgagtggatcacttgagctcagaagttcaagaccagcctggccaacaaggcgaaaccccatctctactaaaaatacaaaaattagctgggcatggtggcatgtgcctgtaatcccagttacgtgggaggctgaggcaggagaatctcttgaacccaggaggtggaggttgcagtgagccgagatcgtgtcattgccctccagcctgagcaacatagcaaaactcagaaagagagagagagagagagagacagagagagaaagaaaagaaagaaaaaaaagaaaagaaaagaaaaaagaaaagaaaagaagttaggaaggaagggagaaaatgtgatatatagacaccatggaatgctacacagccctaaaaaagaataaaatcacctcatttgcagcaacatgcatggagcttgaggcattcatcctaagtgaactaacttagaagcagaaaatcaaatatcgcatgttctcacttataagtgggagctaaacacgggtccactatgttgttgagacactacattccccaatagcaagagctatctgttataacttggacatttttctatttggtccctagggtcccccactaaggacatgcttgggaggtcatggcactgtgtaccctgcctttccctagatgttcattaagcgcatttgttgcattgtgcatatccttgcctgctccctaggctgtggaggagctatcggtacccagctggttgtctgtggcaggctggtagcaggtgagggcaggtctcggggttccgagtgatgagaatccagagacgcacgtccctgactattgctggatccttgagcagacagggccctctgttacccacactcgagttccagaacttagaagaagagttccaagaacagctggctgtggaacagccatgggaggatgtctcttgccctttaagcttccatgaggtgaatatatacagtgtccatccctgagaaaaatgaagcttccacaagacaacagataaatattttcaggagaaaatgaaatattttcatgagagatgatcagatctgatcctgggccttgggtgggtgggtctctacctgcactttacaaccctaatcaataaataacctgagctccttgttcagcttacaagtccttggtccagtttagctcaaagagagacggatgtccagtgacctaaatttatcttacaatggcagtgctgtgcctgacaccaggttcatgcatcttcacacaggccgtccctagaagagaaaaggatgcctcccctcattggctttctaatattactgcaacaactacaaccttggggacaatttcctggtgggaggacatgcccaataatgcaggtgcatagtggaacactggcatcacttagttggtgacttgaggacctcagtctccctgggttcagtttcctcatgtgtcaaattcccagcttaactagatgagggtttccagactttgagtaatatgaaacagtacaatctgaaaatgaaattaaataccggggggaccaacctatagggttgtcagtatcttatatgctacgttagggaattaaaaacaaaatagactgggcacggtggctcacacctataatcccagcactttgggaggctgaggcgggtggatcgcctgaggtcaggagtttgagaccaccctggccaacaaggtgaaaccctgtttctcctaaaaatacaaaattagctgggcgtggtagcaggcatctgtaatcccaggtactcaggaggctgaggcgggaggactgcatgaatccgtgaggctgaggttgcagtgagccaagatcacgccattacactccagcctgggcaacaaagcaagactccatctcaaaaacaaacaaataaacaaaaaaaaaaaaagaagaaaaaaatgaaacaagccaaatataatctgctgtctccatgattttattaaagaaaagacattttaacacacactgaaaacaggagagataaaaatattgggttttaaagtggataaatttagcttgatagaaaaatccttctgttgtctgtatttttctcctgggctgcgtacccacgaggattttattataacggagatcaggaaagggcatctgggaccagagcacaagaggatcccagcctcgatccagctgtatttttatctctagtttttaatctccagtttttatctctagtttttaatacagcctcacactgttcctatgaaatagactaaagatatgcaagaaacacactagtaagcgaatctctggaaacagaatcctccaccttcctttccatgtgttttgcttctctgaccatctcaatgccaaaatacaaaaattagccaggcgtggtggttggcgcctgtaatcccagctacttgggaggctgaggcaggagaatcacttgaacctgggaggcggaggttgcagtgagccgacatcgtgccattgcactccagcatgggcaacaagagtgaaactccacctcaaaaaaaaaaaaaaaaaagtctataaaagattcaggaggatgcagtaaggattagtgtctccacaatgtgcatttgaaccctagaaaacaagtgccttagaaagtccacgtggtgaagcccaggcgatcattcctggcacattccaattgcacacttctggtggtgacctcggaatccttgtaagcctctgactccaaatggtacagtaagtgaaagatggcaagactgagaaaagatgagttattatgtttcgccccatcattagttcagggtactcctgggtgtgcctgacactcatttccctgcttgtgagttttgaaagtcttgaaactcacagcagagaacatcagcaagacggaaagggaaagctggaaagataaacaccccgccttcctgttcggagtctgcagaaaagggacaaagccaggccaaggggagcggagtatagtgatgcttgtttcacttcttaacccggattgcttgcatttgtactttctgggtgatgctacccacttcctaccatgacggaatcactgatttttacctcttctctaagcacatgcttgagagggagcaactcaagtttttgggatggagtcttgctctgttgcccaggctggagcacagtagacaggctcaagcaattcacctccctcagcctcccgagtagctggaattacaggctattgaccattatactcgtctaatttttttgtatttttagtagagatggggtttcgccaggttggccagactggtctcgaactcctgacctcaagtgatctacccgcctcagcctcccaaagtggcaagaatacaggcatgctccaccgtgcccagttgggagcaacccaattcttaccctcaaaactgaaaagctctgcttttgaaactcttttgttactattttttgagtaggtaatatatgcagatgatacaaaattcaaaattaacaagggagcagaaacaaaaagttaatttctcttatacctctgacctacagccacccagttctcactagtggcaaccacttttacatgcttcttgagatattctaatcagattcaggcataaaatgttaccattggtgattatatatacacacacacatatgcacgtgtccacacacaaacacacaaatagaacatactttacaactataaattgtacttcactgtccggatctggaatatttcctttttctttactttttttgaaacagtctcgttctgtcatccaggctggagggcagtacactctgcctccagggctcaagcgattctcctgcctcagcctcctgagcagctgggattacagatgggcaccaccatgtccacctaatttttgtatttttagtagagacgggggtttgccatgttggccaggctggtcttgaactcctgacctcatgtgatccacccaccttagcctctcaaagtgctgggattacaggtgtgagccacctagcccggaacatttcattaaatcagtcttctattgatggatatttgaatatgtcactaattcaatgtgaaaatgtttttgtacatctgtcaatgtatctctaaggtagacttctaggagtagaattgttggctcaaaagtcatgtgtatttaaaaaaaaaattagacattgtcaattttgctccccatggaggttataccaatttatatccccagtatagagagtgtctgactccctccactcttatgttacagtgagggtgtgtaccataaaactttcaaatcttgggcactgtgatgggtaaaaaatggcatctcatttttatttcaattgataatctcctttcataagccaaaatgctgtttcacaaaatttccccaagaccaattcccttttttaaaccaagctttcattgatccaaatggatccagttttgtctcataaacatcccaataatggacacaagctaataattaagagaaacatgttagaaccatctactcactgaagtccacatttaaaggcaatttaaggccggtcgcggtggctcacgccagtaatcccagcattttgggaggccgaggcgggtggatcacgaagtcaggagatcgagaccatcctggctaacacagtgaaaccccgtctctaataaaaatacaaaaaaattagctgggcgaggtggcgggcgcctgtagtcccagcttctcgggaggctgaggcaggagaatggcatgaacccgggcggcggagcttgcagtgagccaagatcgcaccactgcactccagcctgggcgacaaagcgagactccgtctcaaaataaataaataaataaataaaaataaaataaaggcaatttacaagaatctttattaatggctcccttatgtatctctgtattgtatatgccacgcatacctgttagaggagatgaaaattaaaatgacgctaagcaaaaacaaagggcaattcatccaaatattcctcttagtccaatttctccttagccttgaaaagagataggcaagcccccaaaagattgaatcttgaaagactcaagaccatgacacctgatcagatgtcgactgcataaaattgataacatttgtcagctactcacgctcaaatctaccaagctcagaaactaatctcatagacgatcagcagggcaggcaataaaggtcctcagaatttccattgtgtacgaagatatgcgagagcatcaactaccccaagtaaggctgaaggttccccggtgactttagtgagctaaaacttgttacccacgacttttatcagtcaagctgaccccagcacctcactaaatgtctgattggcgcctctgttactctcctgcgaatctgattaggtttctatgtattctcaaggtcactagctgtgtttggacaaaacgataataatatcaaccttcaggacaccatttcttgagcatttttgaaagggccagtgtggacaccgttaatttctcaggcaaataagaaaatcattatagaacagcagccaaagaacttgaataaattaattaacatattcaatatttaccgagcttgttgctttctattgaatttgtattgtggttgtagtgatttttgtcatgtactgcaagcatcgggctattgatactgtggctgaaatgcttagactcatgaattgttagctatgttttagaatatgagttgtacttagactatttaattgtatcgttatttaattatatccttttgcttacaatagggtagatgccatatatactatatcaaaggtttttcacatctaaaaatttgcatttctaattgctaagtaagatctttttcttgctcactttctgatctgtccgtccgtccatccatccatccatccatccatccatccatccatccatctatctatctatctatctatctatattggaaccccaaaatcaatcaatctatctatctatctatctatctatctatctatctatctatctatctatctatctatctatctatcatcttggaaccccaaaatcactaagctaaagggaaaaatcaagctgggaatggcttaggctaaacctgccttccattctattcaaagtcatccctctgctcactgagataaatgcatatctgatttcttccttaggaaaggctggtcagaaactcaaaagaatgcaaccatttgtctcttatctacctatgacctgtgaaccctcttcctcactttgagttgtcctggctttctggcctgaaccaatgtgcatcttacatatactgattgataacaccaagctgtacccaaccaccttgggcgcatgtcgtcaggacctcgtgaggctgtgtcacggccgtgcatccttaactttggcaaaataaatttcctaaattgagacctgtctcagatatttggggttcatatatgtatgtatgtgagtatgtatgtatgtatctatccatttatctgtcatctcatctaatctttgctttgtgctaggcactgttccaagtgccttagaaatatgaacttacttaatcctcacaacagcccatatggtgcttaattatttttaccatccttgttttacagatggagaaactcaggaacagagaggttaagtcactggctcagagtcacacagccagtcgaatgacagagcctgaataggaatgcaagcctctggctccggggtcagtgataatcactgctacactgggcttgtgtgtgtacaacattctaatttttgtgaacagtcacttgctccctgtcaccgagagaaaatccttcttctgttgaatgaaacagagaaagttcttgtggggaagcaaagctgggtaagaagtgtgtgtagcagggctgtaggggtggtttctggaaaatgtttggtattcatttacaagataatcttaatagcatctccattgtgtaatggagagactcaataatggtactgaaggaatttagctgaagttaatgttcttgcaaaaaaacagagaatgatgcaattctttaactctgggaggagtgtaacattcatctgagactaactgcattttggagataaaggaacaggccccagggactttggccttacttggcctgtttgctgaaggccatgcatggtgcctgcgaccagaatctagactttccacctgcagttagggttctccttcttatttacttcttattaacaggatgagtactcctcagaaaccatagactgtctcagtttctccttccctctctgcaaatgtgttctccagaggaaataagacggagacgccagcttaggcctgcagtggatacagtggttttggcttcatgtacacaggtgttccatttaatgaggtgttgaagggaaggtggttgaaaaagaaatatacagggtgtgagaagaaggaaggcaaaacgtctattacccacaagcccagagaaatctatttctccaggctgcaaagtagcaagtgccaggattttggagtggaataactgctctacttcctcttaatcaaaggaattatataactcccctgagagaaagcaaaatgacttattttatcataatgaagcttttaaaatggcaacttgcagtactttgaaaaagtcgtagagtatatggggttatactcgtttcttcttctttgttttgttttttagttttcttgctgaaattggacaatcagagcacatgtcaaacacttctgctttcttcaaagaaaacagagctctttctgtgcctcaaattcttctgagctgcttttaagggagtctaacttggttccttatctcttttttcaaaaggcgtttctcatgacattcttcaaaaagctttgctttgttgtagtttccaatatttcaacatttttattttacagcttaacttgtcatcatgaaaattctgactaatgtccttttgtctgtttacaaattagtttcattttctgccaccaaaagggaaacatactgtgatctccatacttgagctattttgtcaaacaagagttaaaatcaggaaacgtttacaaataagttctgcgtctaggcgtatacccaaaacagatgagtccatatgagccccaaaaggcgtgaccagggattttcatagcaggactattcataacagctccaaaatgaaaatgatccaaatgttcatcagaggtagaacaaataaatgtgtagtctacgcataaggtagaatcgtataatgggataaaatatagcaatgaaaaggaatggaccactgttgagttcaacagcatggatcaatcttataagtatttttgagtaaaagaagctagacacaaacaaatatgaattgtgtctttatgtttatataaggttcaaaaacagagaaaactcaactatgctggtagaagtcagaacaggggctatgtttgtggagggagggagacagtgactgaaacgagcacagggagcttgcagggtgctggtgatgctctactgcaagatccttattccagtaggttcactttgtgaaaagtaaagtagaggtttctcttcaaaaattttcctccccgtctaattaggaataaacagaaacttctctcagaagcaaaatgtattcaaagacctgtgctaacatttttaaatgtctgctagccgtaataaagaaatcgatgtactttatgttcttagctcccaccatgtagcctaaatatttgccctggcacgcttatactggtccaagcaagcattaggtcatagcctgttcctcttccttatttgaagttgtttttacctttctcagtattccacaagttacttcctccttcctttgttctcctctgcctttgcctcttttaaaaagttctaagttacaggccaatcaggacaaatacagaatgtgaggtcccgctccagccaatagaaaccagacacagcagtaaagtggacgcgtcaagttataaataacgctggctcctttgttcagtgtactcttgtggcaaaactgctggcgaatgtaccctttctgcagaaagtataaaaatggccttgctgaggaaattaaatttatgttcaagtgctttttcttcacggcaccgaagaacaggcatttcaaacaactttgtgggtatttacgaaggtgtacttgtgatttgtgctctttcctgagcacaggttatacttagataagaaatttatttgaaaacaggccggcgcagtggctcatgcctgtaatcccagcactttgggaggtcgagatgggtggatcattcgaggtcaggagtttgagaccagcctggccaatatggtgacactgcacctctactaaaaatacaaaaaaaattaggtgggcgtggtagtgcaaacctgtaatcctagctactcgggacgctgtaagccaagatcgtaccactgcactccagcctgggtgatagagcaagactccatctcaaaaaaaaaaaaaaaaaaaaaaaaagaaattcatttcgaaacaaaactcagtactgaattctccctggtgcagaaagagaaaatcaacctgtacaatcctcatgacaaaaatctatatattttcatcagacacttagaaaatgttcagatcttccaggtgtagagatgggagaggagagagagaaaaaattttttaaagcatccttttacttccagaaggttaccatgttatctatgtgttgacaaaaacattttcttcaccaaaaagtgtgcacatttaacattaaagttgctgagaattcaatacaaatatatttctgagggatttttttatgagaaattctagccatatgtcccatgttagttctgaaggaattctaaaatttgatgtgtgttgtgtggatataaaggtgatactcaaaggaaatgtctgagaatgtgtatttatattttataacaagattaaatcacatgatttatccacaaattttttttccttcctttaccaatttcactccctgcccactgatttcttgaattctcccatttcatctcctctattcctctctgatgtgcagttgaggtatttgtcaaaattctcccttctcccctctcctgtcctctcactgtctggaaacttgtccactctgatgaggatttctctgtttcctttggctggatgatttctcactccccagcacctgctctaacttctgtccatcactccagcctcgactgcacagctgcctggacaggcacagacaacgacgccatccatcagcattacaatagaagacacaaaatcaaattgacttctcatcaaactagctgcagctttccactgccttacctaggttagtggtaccatcattcaactaggtgtccggtcccagatctctgggtcatcttttttttttcttaagacaaggtcttgccctctcgcccagactgcagtgaagtggtgcaatcacagctcactataacttcgaactgtgggactcaagcattcttcctacttcattctcctgaatagctgggactacaggcacatgccaccatgcctggctatttattaaaacttatttgtagagatggggtcccactgtgttgcccaggctggtctccagttcctgtcctcaagtgatccttctgccttaaactccctaggtgctgggattacaggtatgaaccactgtgtcctgccctttgggtcatctttaacgtctctgctctccaatttcaaatcagttgtccaacccagttgattctaccttttacattctctttcctgtcgcccctttacttcccacagtgttgttactgttgtttgagctctattgttttagccgtgtggctctttgctgatctctctattgccatcttttccttctctaattctttctgcatttggctgcttcactatttagaatagtggctccctgacccccattcctgtctggtaaaacctatgaatgtgaccttatttggaaataggttctttgtacatgtcaagttaacatgagatcatcctggattagggtgggccctaagtccaatatgactagcccttctacgaagagtgaatttggacacagacacatagaaagaacaccatatgaggacagaggcacattggaagaggcatctagaagcccaggaatgccaaggactgctggcaagcagcaggagctgggagagggcacagaacagatttctcctgagccttcagaggcagtggggctctgctgaggcctcaatttcatacttctagacttgggcactgtggaagaacagatttctgttgttttaagccagccagtttgtgacattttgttatgggaggcttaagaaagtaatacagctaccaccataaccttcatagaacattgttttcaaccacaacactgctctgctgaagaatatccaatgcctatctctcgtctaccagattgaattcagcgatacctttgccagtcaggctacattctctggcccctttttctttttcttgagatagggtctcactgtgtcacccaggctggaatgctgtggtgagcagcctcaaactcctggcctcaagtaatcttcccacctcagcctcccgagtagctgggactacaggcacccaccaccgtgcccagctaattttgcttatttttgtagtgacagggcctatctatgttgccctggctggtcttgaactcctggactcgaatgatcctcctaaactgctgggattagaagagtgagccactatgcctggccattccctggtccttctgccatcatgacttcatgtgacttacactgtagcctagcaaaactgcttgctcctccttcagcacacctttgcctttccacctggtgtgcaacatctggtgtgttctcactttgacctcttcccactaacactgtaccgctttttcaaggtgttcagatgccactgtcttcatgaagctttccctaggttcagcaaggtgtgggtactcgctctcttaatgtccactgctgacatgtctattacgcacacactttgccccctttcatggtgagttatatactttaaacacatttattataaaacatttaagatataaccataaatatgtatcgttattgaataatatgtatgtgaatacatattactattacatatttttatatacaataaaatatattactataattatgtataagatgatatacaataattataatcacattcttatgatataattatgtcatatttatattatattatatatgatataattatattataatatttatcatattatattagatataattgtctaccagacatatataatgtaaagtataatatatatctataatcatattatatatgatataattatatagaatagatatgtattatatataattgcctacaaatatatatatcacatataattatatatcatattatatatggtataattatgatagtaaaactatattataattatcatatttaatgtattaatacatattcaattttatacatatgtattcatattattcaatacatacatattattcaatgttatacatatgtattcatattatacatattacatattatcaatatgtatgtattgaaaagtatatttcaatgatcaaatgtactaaaacagaatttatttaaataaatacatttgattattgaaatatactttcacattttactaatcaaatacaataggccttttgggaccatcagctttgatatattctatcatgctcacaaattctgactcactttcctcaacatttgttaaatgatttgttaaaataattcaagtacttatttaaaacacaattggaccttacagtcactactgctctagtgatttacagtgataaggagttgtgacacttttctctatataaaacctagagctgaaagtttgttaatgtaataaaaggagccactattttcttcttttccactcatgtatatgctgtaggaatgttctataatataaaaaaccatacggcaagatacaaagctgttccacaactaatattttgaaaactcatttccaggtcaactgagcccaaaatgcctaatttgatgacattttaagaaaatgaaaggtagaattattttaatattcttaatgccaaggtagaggtaattttcaactctactgttttgctggtgatcttatccctggttgcagcctttctggttcctgacttaatagagaaaatcatttctgtttgttcagaatgatgatcaaacccctgacgtgatggtgctcacggctgtaatgctttgatggacagggatttagtgttctgcctggctttgccctggagcagcctgaagactgggtaaggaaatggttttgtggctgctctgatgaggaaaatctaagttaatccacacatgaggatataaaattcccatccagtgctaactcccaccattgtgaggcatgggagtcgctggtccctcctagggctggtcgctggacatcatctggacaaaagaaagggcagagtctttatcatgtgtggagttacatcctggggccatgttgtccacagtcctgatttgtcagaagatggggtgctcaggcctccacctccaatataactctcagaatgtgaaagaatgactctctgtgaggcatggggacaattttgatgactcttgtgccacgatggcaattccatgaaatagattcattgagtaaagaatagactgtgatggaaattcaccaatgcaaattgcttcattttaccgtctctatcctttggaattttgcttttattgatggtcttgcttggtggaaaagaagaaccaagaaggttacgtgggtgtgatattgcccacggtacctgatgtgctctggttttaatcggctggtacctcacagtgaatctcccaaacagtaacacggttgctatggtctgggtatgaaaggaaggtgcaagaaaggtcctcagaggcctgcctactggtatgtgatccacacacatttccatcattttcagtcatttaagaggccagaggctgatggaggattgataggatctctaggcaatctttaatctgtacaatctttaatgctcaccagctgattatcagctgatggggaagataacttacatattcttgtaaatttctctcctcctcctgttcccagaacccaaagaagagccccattgtactagtcctcaataatccaggaaacaaaactgactgtagactgaaaagtgaaacttcacgtctgcaaagtacttttcatcttagaaatactttcttttgagggacttccaagtccaggaagtatgggagaatggaaccctttggggttttaaccccagtgagtggcaaagcggtgacttggaataggaggaggccctggaattattcagagtggagtcagaattgtgtcattgcgcttcccagctgcagggcctgtgtagactattgaagttaggtcttggctttcttcaccaccaaatagggacaatttccactgcatagagccatttctaccatttaacaacaaatgtataaggcatttagcgcacagcccagcacatagtcactcaataaaaaatagatatcattgtctgttttgttaatcagtaagaacccaagacaaggtgggaggcggtagagatcttgtggaggagaagaaagggtggaaataaaggcggttgctctgagctaggctaaagaaggcagcaccgtaccaagatatcactaggactgattccactgccctgaagatcccagccagtgacaggacccggagtggtccccatggatagtcaagccagagcacacgactgctgggactggaatggatttggaccgggaagcaggaactttgcaaaatctggccagcaaactttgtaactgcctatttgcttcattttcctcttaatagcacgtcgtctcattttgtgggactgattttttgggaactccccactacattacaacattatgccagaatttcacagtagtaaaaacaataatttttgtaaacagaatagggctcttcctagtcatcactaagacatgccttaagtttgctgagaaatatggtgggtgggccgggtgtggtggctcatgcctgtaatcacagcattttgagaggcgaaggcaggcggatcacttgaggtcaggagtacaagaccagcctggccaacatggtgaaaccctgtctctactaaaaatacaaaaattagccaggcgtggtgtcaggcacctgtagtcccagctacttgggaggctgaggcaggataatcgcttgaacctgggaagcggaggttgcagtgagctgagatcgcaccaccgcactccagcctgggtgacagagcgagactcttgtctcaaataaaatagaatagattagaatagaatagaatagaatagaatagaatagaatagaatagaatagaatagaatagaatagaatagaatagaatagaaaataaaatgaaatatggtgggagtaggatgggcctgtaacaacaaagtgtcttattggcaaaatgtggaaaacccacgtgtagcacaaaaagcaggatgcttggaaggattgcagccaccagagttctgtgttcaggaactccagaggcttggagaatcatgtaataagaagttgagaagtaagtcactgtgggaaaaaagtcttggctgtgtctactgctgtactcctgatctagggatgtggcctgttcagttcattacagaaccaggataagagcagctgagacttttctcatacctttttcagataaaaatgaagatggtaataaacagagcaattaaaccgattataattacatatgcacagtggggatttgggggatgaggagatcattgtccatgtaagtaattaatggtgaggcatagaatttcgcactaggtggggttttccaaacaggttgagaacaggaagtcaggagcaatgcactggcaagtattcaagatctttagggaccagaggtggactccgaccttttaaaaactggaattccccacagtttgggtttcagtgtattaggaaagaggtcagcccaactgtgtccttccatagctgcataattcataatgtcgtaaagtaaatatttttttcctctcaaatttcctcagaggcagttggattttatccgtttcagagttgagtcttactgtggaaagatttgattaaaatgaggaaaacggtcaggagtttgagaccagcctggccaccatggcaaaaccctgtctctactaaaaatacaaaaattagccaggcatggtggcgctcgcctagaatcgcagctacctgggaggctgaggcaggagaatcgcttgaaccgtggaggcagaggttgcagtgagccaagatcatgccactgcactccagcctgggcaacagagtgagactccatctcaaataaaacaaaataaaataaaataaggaaaattttggcttttacgcgttgactgtctttttgcagttgtctgatcctgcacacttgccgcacttccgtctagttcatattctcacgtcgacaatatttactgagcacctacgacacggaggcaagagctgcctttgactgtaggctttggcaccatcacttacacactgcatgatgttaggcagtttcctacctttgctatgcctccgttttttccatctataaaatggggctaatgacattcttctcactgagttatcgtgaggattaaatgaattaatacacataaagcactcaggacagtgcctggtagaaagcaaagacacattaagcagtgactgctctcactcaccaaactgtttccctgtgccaggtgctgctgtcctgaggactttcagtgaattaactcatttaattaggacaggaccctgtgaggtaggtatgattattaccccattttgcagatggtaaaactgaggcttagagctggaaagtgatgctctggttattgtaaagactaatagagatgatgaaagacctaataaaatacaaattaccattgtggtataataaaaaataaatatttggtctctgtacccagttcctggtacagggctcctgtcttctgtatgctagtaagattggctcataagatcgttaagggaggctccaggtagcttgggggtgggggctggtcaccagaaggaccaagatgtaattagagggttgggagtttcaatcccactccctgacctccagggagggcagggggcctacggattgaatccatcactcatggccaatgatttaaccaaccacgcctatgtaatgaaactccaataaaacccctaatggacaggctttggagagcttccaagtgggtgaacccatggaggtccttgcaagggggtgtacccagaaagggcctagcagctccacgccctcccgcatgccctgcccagtgcacctcttccatttggctgcttctttataataaactggtaaacataagcaaagcctttccctgagttctgcaagtcattctagcaaatgactgaaactgaggaggggatgtgggaccccctaatttattgccattttgaagtacaggaggcccaggcttgccactggcagtcttgtgtcctgagccctttacttgggggatctgacactgattccagatagaaggtgtcaggattgcaaaggcattgttggacacccggctggtgtcagagaattgtagaatcgggaagtatttaatagcctaaccaaaatgcagtatctagcctttcgatgctctctttctctgtgctttaactgattttttatcttttccaccttggggcagcctctccttaccgagtatcacaccctgtcccttctctgaagctacactcccaggtcatgcttatatgctcagccacaggaatattccaaccgtatctctaatgttcatcctggggtttagatctatcttagcattcttgagagtatctatggcacagccctgccaggtgtcctgaaaataattccaaaggaggagagaatcacgttccataagagaaaaccaaggacgccggggtgagcgcaaggataagcctgccactcagcttgttctctgtactctgtcccgttggtgcccacttggattgcaggaagaggagctggaaatgaaatgctcagaacacagagaagagctgcttccctgaaacctccatggttgacactggcagattcagcagcctggggagcagcagtgacaggtgacaggctctttcatggcagggttggccctgggagagagaggtgagactgcagttctagtgtcccgtgggcagcctagtctggcacagagcactagcagctttcatggcacctcggcagcctatgcagtaagcgtctcttcaggaaagggccctgagcagggcaggaggagatcgcagatgccaggtagctgctgagagatccacggcattgcatttgcatggcatcctgaattgaatagtgtctcaccctcaattaatgtccttcccagaatctcagaatgtgagcttatttgggaatagggtggttgcagatgtaattaaggtaacatgaggtcacactggagtagggtaagcccttaatgcagtatagctggtattcttgtaagaggagactcagagacagacacagagagaagaacaccatgggccaatggaagcagggatggcagtgaagtgtctacaagccaatggatgccaagtatgcctggcaaccaccagaactaggagaggggcatggaacacactctcccttgaggtctccagagggaactaaccctgaggagaccttgactttcgactttcagcctccagaactgtgaaagaataaatttctgttgtcttaaactacctggtttgcagtgttttgttatggcagccacaagaagctcatacacacagctgtatctgtctgctttgcattgctataaaggagtacctgaagctgggtaatttataaagaaaagaggtttatttggcttacagttttgcaggctgtacaagcatggcatcagcatctgcttggcttctagtgaggcctcaggaagcttttactcatggcagaaaagaaggggagccagcatgacatggcaagagaggaagcaagagagtggggaggaggtgccaggctcttttctttttgttttttgagacagagtctcactctggtcacccaggctggagcacaatggcacagtcttggctcactgcaacctccgcctcccaggttcaagtgattctccggcctcagcctcccgagtagctgggatttcaggtgctcaccaccataactggctatttttttttctgtatttttagtagagatgaggtttcaccatgttggtcaggctggtcttgaactcctgacctcaagtgatccaaccacctcggcttcccaaagtgctgggattataggtatgagccactgcgctcagccaccaggctcttttttaacactcagatcttgccgtaactcatagagtgataactcattctttactgcaaggagggtgccaagccatgcatgagggatttatccccacaacccgaacatctctcaccagtccccatctccaacactgcggatcatatttcaataagagatttgaagggaacaaacatccaaaccacatccataccttagacatcctcctaagtgctcccagactacgtgagcaaacgttttgaagggtttctacggagatggtggggccaggaccacaaaaacactgtgcagtgatttatttgttttctctctcaggttaataactgtgaggaaaagaggtcatacacctgttgtttctacagaatggtgtattagcatagacccttggcactgatccctgatggtggagcatggctgatgttctgtgcaaaggagggtgagatccctgtgagtaattctccttccctgtaaacaaacacctctcacaacatgaggattacggggcaagggtgtgcagggggcaccttgtgcagcctgaaaaccatgttaatcttaaagctttactatcagcacagcccagccctgctgatctacccccagtggaagctggaatgctctcattttccatgcccttcacctccctagaactgagcttccaatacaccttgcccattttcccttgcctacctatcctctgccaactctggtaagtgcctcactttactttccaggagaacgtggttttagttattaatttttcacccctattgcctagtagctgcccatctttgacttggaaggaaggttacacttgctttgttgattgttatggcccccatccacctccatcaaaaagacccttgtggctgggcatggtggctcatgcctataatgaaagtgttttgggaggccgaggtgaggtaagaggattgcttgagggaaggagcttgagaccagcctgggcaacatagcaagatcccgtctctacaaaaaaatgaaaaaactagtggattgtggtggtacaggtgtcccagctacgcaggaggatcacctgagcccaggagctccaggctgcagtgagttatgatcaccccactgcactccagcctcggcaatagagtgagaccctgtccctacaaaatttttttttaaaaattagctaggtacctgcagttttagctacttgggagggtgaggtgggatgatttcttgagccaaggaatttgaggctgcagtgagctctgatcgcaccactgcactccagcctccatgacagagtgagactctgtctcttaacaaaaaagacccctgtggtttctcagcacttctggaggccctatcttcagcatgctctgaaacaaaccaccctggttctttgtctctggcctttgtatctcactattatggccttgccacctcttctgtggctgctgaccctggagaggtcacctcccctgccccagcactgtgactttcccagtgtggattcaggaaaacggacgctgctttttctcccctgcatgactctgtcctaagagtccacagccttgccctaatttcccaaaacacagctgaggccagtggaaaagttttcatatggctaaactttaggttcaacgatactccaaaaaaaaatcaaaatttctctacgagtgtggatccaagctagagtcttctacacagccagcatcctatttgatacctgggcagtgtccactgaacaggggcagtccacgcacacccagcacccttgaggctcagagctccctgtgactcattgtcaggagaaactgtcccctccaatgccaagtgatatggtttggctgtgtccccacccaaatctcatcttgaattgtagctcccataatccccacatgttgtgggagggacctcgtgggaggtaactgaatcgtgggggcagggttttcccctgctgttcttgtgatagtaagtctcatgagatctgatggttttataaagggcagtttttgcttttgcctgccaccatgtaagatgtgactttgctcctcctttgccttcctccatgattgtgaggactttccagccacatggaactgtgagtccattaaacctctctcctttataaattacccagtctcaggtatgtccttatagcagtgtgagaatggacgcaagagaagaagtttactccccacctgtatctcaaagccactttgctggatcttcaatttttgcctttccccaggaagatgggaggtgagagcactgaagtacttcagagaagatcccaggtctatatactctggacctctgtccccagtactcaacctcagtcactttgttaataaaattaatgaatagatcaatgttccatcttcttccaaaggagattcaaggaactgaggttttcaggttactctgtatggatatgctttggtggatctggtctttccagacgcagtcttcatcctcacgtctttatgatgtttcccatcaaggcagtaagatgtgcaataatagaaggtaaggcttgtgtttcctctcttctgacttccctgcactctatccctatgctgatctagctacacacacacacacacacacacaaacacacacacacacacacacacacacacacacacactcaagacctaagacagtgaattgcacatagcacaaactatacgatcactagatttattttctcacaaggattctgaacaactgaaaggttaaaaactgtacattatgcctgccctcaggttacagatatttgctcttttcagttttaaaacaccaactttatttcttttatgtaattgaaaattgtttcaactttttattttcgtgggtccatagtaggtgtatatatttacggggtacatgagacgttttgatacaggcatgcaatgtgtaatgatcacatcatggagaatggggtgtccaacccctcaagcatttatctttagtgttataaacaatgcaattatagtcttttcgttattttaacatgtacaatgaaattatcattgactattgtcaccccgttgtgctatcaaataatagtgggtcttattaattctctctcttttttttttgagacggagtctcgctctttcgcccaggccagagtgcagtggcgcgatctcggctcactgcaagctccgcctcctgggttcacgtcattcttttttagagatgtagtctcactctgtcgcccaggctggagtgcaatgacacaatcttgacttactgcaacctccacctcccatgttcaagcaattcttctgcctcagcctcctgagtagctgggattacaggcacgtgccaccacacctggctggtttttgtatttttagtagagatagggtttctccatgttggccaggctggtcttgaactcctgacctcaagtgatatgcccgcctcagcctcctaaagtgctgggattacaggcgtgagccaccggacctgatcttattcattctttataactatgtttttgtgttgattaaacatccccacctctccccaaccccccgtgattgaaaaaaaaatttaaagttttttcccccagtatttctttagttgcagcctctgtcccagcgaatgacttccttggacctctgaataagtaggtctaattcattctttctaactatatttttttgtacccattaaacatcctcacttcccccctccaccctctgtaactgaaaaaatattttaagttttggccccagtatttctccagtcgcatcctctgtcccagctaactgcttctttgggcctctgtggtgtgcatggtgttgcttgtttgctactggctttctaaactgctgcacactcatctttcagcctatggagacctctcaccatctgccgcggctctttcatgtgcaaatagtcaggcatttcacatccaagctctttgctgcttctttgtttcttctagggagagaaacgagcttgtgttatagttcttgttctctgtcattcataaatttgaaaaataaataaataaaaggtattgctggtgagatatttggaaaaattcttgttcctggcatctccccaattaacaagtgagtcttttgtggctctctttagccttgcgaggtctggcaggctatgtttttctcacaaaaccttgaagcctgagtcagtggcaatgttctgtatctcttctggcttgtcacagctgagcaacacatgagaaaaatgctagtcttcttcactcaggcttaggaatgaggcctcaaagggttttgcaattgaaggcattttgcttatgggtcagcggatgttatgtaatgtaatattgtcaatatagttcctaggctcttaattatttgcctcttggttgtggcaacacaaacagagaacacacagtcacctgactactcaaattccaataaatacaggaacatgattcattcaagaaaagcaataaaagagagacttcccccccattcagcataagctgaatatagtatcttcacacatcgtctttaccctagagctggggttataggattaggtcatgttgacaaacacaacaaaataataccaggctccatggctattttgttactgcttcaattcaagaaatttcaaggaaaaggcaacatgagtcaagcaagacaaaagtcaacgcatgctgcagccagttttgaaaccaaaggcctcccttcctatctactgtgtgaatttataatctttttttttttttcgagatggagattcacacttgttgcccaggctggaatgcaatggcgcgatctctgctcaccacaacctccgcctcctgggttcaagagattctccagcctcagcctcccaagtagctgggattacaggcaggggccaccctgcccggctaattttgtatttttagtagagatggggtttcaccatgttggtcaggctggtctcaaactcctgacctcaggtgatccacccatcttggcctcacaaagtgctgggattacaagcgtgagccacaacacctggcctacaatcttaacgctcactggttgtgtcggtttctcttggagccaaattcagtttgcgtgtctgcgtcagtggacaagattttgtttgaaataacaaaactcactcagaaataaaaagagagctctggtcaggaagtaatatatagttacatgcaagtaaaaccattcattaattcccacccaggccttccagggacacaggcatagatgtgtgtgttttctggttcctccaatgagtagaactggagagaaatgattaggaaagtccaggcttggttgaaggaggtgatagtccccaaatgctagcttcccaaacccatagggacaagaaagccgaggggatttgggctatctttatactgaattcatcctcccataaaattcatttagggtcaatctgaagtttgagttacacacctattgctttttttcaaagataaattatcatttgctacatgtttgagatgcatattttactttcaaaatattcatttctcatcctagaatttttttcccaattaccttttaggtacgttgtctagtctagatcaacaaaccactggcaggcaatgggagagtctgggagagaagaaatgtaaatgatgttttttaaataacatccatgttaccattcatatgcaagactccattttccatagtgtggtaaaaactagaaaaaaatgaccacatttcgtaagaaggataaagatagaaattcactgttgactgggaacctgatctagggaggcacagattggattctcaaggtcctttctctgcttcttacatgaccagagggaggttggctggtggaaacactgaacacatccctgtagggtggtccttgaggttacatgaggccctttggtggaagaccatatgccacagggtcccggtgactacagggtctccaaagagctgattggctgggcatgattacacatatccacctgctaaatcgtagctccaaatgcaacatccagcactcagaggccacatgtggacttctaggtcaccttgatcacgcatagtatctacccttggtttagaaggtggtgggatgatcaagggaaaaatgccctggtcaaactaaaaatgattttcattgtcaagacaatgacaatgcatttggatataactgaggagaaaacaaaaaaaaatgcaaagcataccttctttatccagccattttgatgaaaaaacagtgaaaagacaaagagcttactccaaatcatatgagaattgaaagggagtgccaacctggtccaaactgaattcagctctgtgaatgtcattgtgaagtctaatatttgtatgtaaataaaatcacgtggttactgtaactcctccctcctctggaattccagtgctgttacctcctaaatgaagaataatgtacaggctagaggtaggatgtcttagagactatctgctccttcaatacaattcctgtattgaatccccaaccaccagcatggcaatatctggagagggtgcctctaaggatgtaattaaaaataaataatatcatatgggtgaggccctgattggataggattagtgtgcttacaagaagagatgtcagagagccctctctctttctctctctttctctccatgtgtgaactgaggaaaggctatgtgagcagacagcgagaaggtggccaccttaagcaaggaagagagctctcactgggaagtgggtaagtgggaacattgaccttgaactccccagcatccagaactgtgagaaatacatttctactgtttaggccacccagtctgctttattttgttatagcagcctcagcagactaacacaccattcctctgcctgttcagttgtttgactcaataacggaagcttctcacgagcatctcaaaattgttctccatcctcctctaatcaataagcaggatctgacaattgtttgaaatcaagcaatgatatcctttgagtagtcaaaatagctatcacatattttgtattttctatgtgccaggcacccttccaggtatgaatgtatttgataattacaacaatcctatgaactagatgctattattacaccattttatagaaaaggaaaccgaggcatagtggtgctaactcgctaactcaactagtaagtgtggggagaaggattctaactcatgcagtctagttccacagtctatacctttaactactctatctctaagtttaagcagtagctggcgtttattgcatcctccttttgagcccgacgttaaatattatatgtcaattcacttatttaattatcacatacaatactttccattttctgtagtgtggcaaaaaccagaaaaaaatgactacatttcataagaaggataaagatagaaattcactgttgactgggaacctagtctagggaggcacagattggattctcatggtccattctttgcttcttacacaaccagcgggaggttggctggtgggaacactgaacacatccttgtaggggatatcaactctatgaaataggtactattattacaatcctgttttgcataagagaaaaatggaagcacagagaggtgagtaatgtacttaagggcatctaaggtgaccacttttacaagtggactacttgggaagccagccaggcactcttgcttcgaagcctgccctcttcagtagaaggcattttcatgttcaaagacaagcactgggcctattttatttctgcttctactttgaacctcaagcaaagtgctttcaacattggaaaaatcaataatatgtgtcaaatgcctcattttcaaaagataaggtacgcaaatcatttccatatatgggaatttggtgggtgatcaaggcaacattctccaattaatgggaagaagatggattatttgattcatgttttctgggacaaatggctggccacttatatagagaggaaatacagatgaatcttttctgatctttgggtccccatggacttctaagcataataacaaagccaaaaataatataaaaaaattaaaattctgtatggcaaaacctaccatgagtaatgttaatagactgactcactagtggaaagattagcaacagctttgatttttatgtataagatttccttttcctaatatactcagagcacttacaaaccaataaggaaaaaaaaatgaccaaagggcagaggatataatcaagtagttttacaaaacaagagccaaaatcgccaacattttggctataaatgtgcaatatttaaaagcacattctggctataaatatgcaatatttaaaagcacatttaggccgggcgtagtggcttatgcctttaattccacaatttggaggccgaagcgggtggactacctgaggtcaggagttcaagaccagcttgatcaacatgggtgttgatcaaccccgtctctactaaaaatacaaaaattatccaggtgtggtgatgtgcacctgcaatcccagctacttgggaggcagaggcaggagaatcacttgaacccggaggcggaggttgcaatgagccaagattccagtctgagcgacagagtgagactccatctcaaaaaaggcacatttaacgaatggaaaatataaaaataagctgtcattttaaatatattattgattatcaaagggtagaaaaccaggtgctcatgacgtaaacctaagtgggtacaatctttccagagactagtttgtcaatttcctccctatcctgagacttttctatctaatagatcactgatttctgatttctgttcagtgtctagcccattctggctaaatgaaacaagggggattggcagggagcttatgggaaacgttgtccttatgataaaaagagatgcataggaggaaataccccttttcttcccatgggcattgtcacgtggtacctggaactatgacaccacttagtgaccatgaagcccaagccaatacgttgaagataccatatgagccacaggagaaaagactttatgtttggtgacattactgagttgctgacttaggactacaatgccccaacttccaaaatcttgttatgtgacagtcaattccttacttacaaaatttctttaattggatctcttgttccttgcagctaaaggaattctgacaaaataaatcaaaactcaaaatgtgcatacccttggaacacaaaatgtaatttctagagctctgactcaaggaaatattcagacaagtaaacagaggtatatataacatgctatttatagtactgaaaaactacaaagccatgtaaatgcccttcaaaaagaagttggttaaatacgtggttaagtatttcactgttacagagccaataagatgtgatatggattaatatttacagacagaaatgtttatttgaggtctatcgtttagggggaaaaagaagattacaaaagggcacatacaggtaggattacatttatgtaaaattttgtgtatctgattacagagctgcacggaaggctattctccaagttgggagtggggtgggattgatcagccatggacgtgtagaaaggaaactcccagagataaacatagtcaggggctttgtggccaatgctgaagggaaagaaagtcttagccattgaacttcaagcatgtttatactaatggtgaaaccgactctaagaaagcaatacaaataaggcgttgtaaccaacgagcttcaagtatttctggtctcattggcaagaccatctcttgtgagacagtgcatccctctaagtaggtgtcatttgttttcatttggatgccttcagctgcaagttacagaattcccgactttcaactgtgagggaattatctcacataactgaagtcctgagtcagagtggacttcaggtgtgattgattcaagtgccactgattcatcaaagacccagtcctggccaggcacagtggctcacgtgtgtaattccagcactttgggaggttgcagtgagatcatgccattgcactccagtgaaaggggaagatacatggatggtgggtgggcaacctacagtgtccattaatccacaccagttgtcattttattcctccggctctcatgttttaaatcctagtggttttgcctatagagacaaaatgtgctgatcctatcgacgttgaatgtttcctgtttcattgacagtgcttctcatgataactccaattacacaacttagctatgacttacgaaacacttaatatgggccagacatgatattaagagctttacacttaagaagcagagaacgtattttgcagacatgactatttctattgcaaggaataaatctgcttttttttttctttttaagattaacagtatgttggtgcccagctcagactcccagaagttatgtttagtgcgtgttcggttccagcttgaatgactcccagatgttgatgagagtcagtctccgactcttcaaaagaggcaagattcagattcttcctctagcttcagccctgatttggctcatcgaaatgagccagacatttgctgtgccatttacatttattatgttattgttctcttggcaacactaagatgaattttattatctctgaatattttatagaaaattgaggttcagagagttcaaggaacatagcccaaattaaagagctggaaagtgtgataaaaacctgagttcttacattattttaccttttctcattaaaaaaaaaaagtcatatacttgaattgtacaactttagacatactctttgtaattctgttgaaacccactagggttcaactggatgtcgggcacacagttatctcttaataactatctggctattatccaatcaaggaaggatagacaggggatcaccgttttaaaccacacaatcttgtacgtggatttagctaactcccatctggtatgcattctaaactccttaggatttctatctgcctcagtaagaaagataccacagtcaaaacatgcgaattaactctacttgttatatatgtgtcactaaaaaaccgccccaggagttttcagctcactaaaaattaagaatctgaaaatagaaattttacagcttccctgagacttctgagccctactgaacggttcaaaagcttaagagcagcattatgtcaaccagggatttgaaaaatcaagtcatgttcttcccgctccttaagtcaataccaagggtaaagattttgcaatcagaagctcactagcaattttgctgggaagtgctcaccaatggaattccacttaattcctccccagctgggtgggagctacagcccaacagtggccaagtgtgttgcccttgcaaaatgtgactcagaagcattcaaagagctgagatactgaggtcctgaaaataggctatttttatattgatgttttccgtaactacagccttgctgaaagaatgcatgtgttcccagttgcacttttccttctgtagtgcttttaaattacatgtcgttaaggccacttccagtagtctcagaaatatttctccttgtaaaacagtgccctgtgaaaactaccatcaaattcttccactccacattgccgtggccacctgaggggaaggctttgggaaagaataaatgcttattcttgggaaattctgattccttctgcgtgaacttttccaggctctatgctgattctcattactctggtcctcctggtgaacttcagcagtgtattctgcttatttttttatttatttattttgaggcagagtcttgctccatcgtctaggctggagtacagtggcgcgatctcggctcactgcaacctctgcctcctgggttcaggtgattctcctgcctcagcctcctgagtacctgggactacaggtgctcaccatcacactcagctattgtttgtatttttagtagagacagggtttgactgtgttggccaggatggtcttgaactcttgatctcaggtgatccacctgctttgacctcccaaagtgctgggagtaaaggtgtgagccaccgcgcccagccctctctgcttatttttaacagcgaagcaatggatcattcattgaaatggcagcagaggcaatattagaatgcaaaactgcagtggtaatactatattagagtgttgccaccacacatttattgactaccatactgtttttaagcatttcaacgtatactactgaatttgagtggtagggagtgccaaatccatgttgtgggctcgtggggtccttcttcacacccactattgacgaccattatatcagcaacaggaggaaacagatagagaatagcctcgcctaattcattcattgggactttttttttccttcttttttgagagatggaggatctcgctctgtcacccaggctggagtgcagtagcacgatctcagctcactgcaacctctgcctcctgggttgaagcaattctcatgcctcagcctcccgagtagctgggactacaggcattcgccaccatacctggataattttttgtatttttagtagagacagggtttcaccatgttcgccaggctggtttcaaactcctgaactcaggtgatctgccttggcctcccaaagtgctgggcttgcagatgtgagccaccatacccggccctaattcagtggaactttgtctttccagttctcctttgaggtagcatccaggtggtggtcacagggcagcctcctccaattccccactgaaatatctaagacccagaaatcactcactcaagccctgaaaacttgagtaaaatctcactcaagcccccaaaactaaaatatcgagaaacagagtttagagaaatgtccccatcagaagggctgatgtaaccaaaattaaataaaccgtggcccaatcatgcttaattttataaaacaaagaagccccactctcatgaaagaagacaggaacacactttgttgctcccctgtgtgtccctggctgaatgattcagggtctgaacaaaccaagaataaaccaggaaagggggtcacagcattcttctctgcatgtagcaggttggagatacccggggtcctagccccctgttatccttgctgacatcattctactgccatcagcaaactacaacttccagaaaacaacgtatgaggaagtatgaagtgggggtatgtatttgtgtgtgtgtgtgtgtgtgtgtgtgtgtgtgtgtcggtagggggagtgggatgaggatagagaatggtggtagctcagtgcctgcagtatatcctttggacgtgaaatataatagcagcacatagaagggaacaaatattcagaaacactccattgattcagagttgcagaaagctgggcacctgaggaggagatccaccttagtatgtagagctgcaccaggagttggccagaagctatttactgtcacctgctgccaaaccaaagtcacgtacttcctctgacaacttcctcttggtggggggtgtggggggtggtccctgttgtccacacagggaaggggtgggtatggatctgtttcctcagttcagtgccataagatcaggaacctggctgattgtagcttaggtaggcatttaatatttgttgaagaaacaagcaaatgctttgaatctggatagagagaatgagtagggaagataaagagtgtgaagttgtatgtgtgtgtgtgtatgtgtgcatgcgctggaagtgggatgagaactgtgtaaagtgtacacagaagaacaagaaaagggaacacacagcatccaaagaattcagacctggagcctacgcctgtgtgccgcactctgaattcatggcgaaaagcctcccaaaggactaagaaggtcaaagcagattgaaaagagatgcaggatcgacaatggcaataaaagtcatgaagctttatgtagcaaataacctagcataaaaatctgcaaagcaaaacgtatcaaaaaaaagaaagagaaattgaggggaaaatgatcgttattgttatgagagacttaaatggacttctttccgttccgactaatggaatagacaaaacccagtaataatgtcgaaaaatgttaactatcatgaggtattatcagtagacgcacatttaaccttctatccttcaagaaacaaactctttcatgagagctcatacacaaacttgcaatggaataagtcaaatagaaaatattaatatgtctcggctaggtgcagtggctcacgcctgtaatcccagcactttgggaggccgaggtgggtggatcatgaggtcaggaattcgagaccagcctggccaacatggtgaaaccccgtctctaataaaaatacaaaaattagctgggcgtggtggcgggtgcctgtaatccaagctactcgggaggctgaggcaggagaatcgcttgaacccaggaggtaggggctgcagtgagccgagaccatgccattgcactccagcctgggcgacagagagagagactccctctcaaaaaaaaattagtatgtctcattgatattaatgacaagtatttagacaataacaaccagtatagaggggaacaggaaagatttattataacaacacttaaaggaaaagaaagctaaacatagaacaatcggtcagctttatttatgacagcagaactaggaaatagcatcaatatatcaggtcccttgcccactgccttattaataacactgtcatgaggccgggcgcagtggctcacacttgtaatcccagcactttgggaggccgaggcgggcggatcacgaggtcaggagttcaagaccagcctggccaatatggtgaaactccatctctactaaaaatacaaaacttagctgggcgtggtggtgcatgcccgtagtcccagctactcgggaggctgaggcagaagaattccttgaacctgggaggtggaggttgcagtgagcagagattgtgcaactgcactccagcctgggtaacagagcgagactccgtctcaaaacaaaaacaaaaaacaaacaaaaaaccaaaaacactgtcatgaacacacacccaaatgtatatacacaaacagagtcatttcagtagcattagtagcagtagaagtaccagggctatttctaggcatcaaaaataactagcatagtaagacaactagcactggataagtcttcctccactccaaatagcttctccatcaaaatgccattctatctgaaattccaccagtagaagtgtattttattaaattaatcaatgtgctttctgggatcatctttcaaagtataaatatttcggagagcagtaacatcttcaaacactaacatcttagcaggaattatggattatgctatgaagtcaatcttttccaggctcagagccaggctgggggcgcaggggttggggcagaggctcagctggtatcagtaggtaggaagaggcaccatctctctgacagcttctctgggttgtgattgtatcacatatctgaacagagtgtttaggagagtgaaatggttatgcctaagaactgctaatacatatcagatccccaatatatatttgctttcctgtgaattgcatattttataatctaagtgtgaagtagaaagattctagttcaataaagctttgattacttttaagctagtaaatatttatactgctgtattttgttcattacgtttgaatttaaacctaactttggactgtattaagtagttgtacttggagttcttagccttggtatctgaaaaaggttatggggattgggaggaaacttctcctttcctcagtgaaattaattaaattctacagaaacaaactttacatttgacatcacttacatatgtgtgagttcaaagttcccacacatatgtcatcatagagtgctgtgtagaagccaaactcaagatattcacatattaagacacttactatattaggtttaattggagtagtttcctgtttgtttgtttttttccacttaggctaagtgagatgaaggaagaaagctgtcttatttagtgagttcattctctctctctctttctccctccctccctccctctccctctctttctctctccctccctccctctccctctctttctctctcttaaatacgtctcgaatgttttgtgggtatattcttcactcatgttcaatgcatcatttttgttttctgtcctcagtggctctcttgtttccaacacctccatccccacccccaataccagcttctgcccccagggtaggaagagggtagatttggtgattcactttttagggaaatatcattggccttctgtgttatattctcaggatgttaagtagtttggctaagtcagtgttggacttgtgacttgggtcatgtgaattttatttcttggtctgccactaattcatatggtgatagactatgttattgaactgccatacctcaatatacacagctataaaaaatgacagtagccatggcacgtttcaatcaaatgaccatctctgtcaacacaatgggtcctacgcagcataggtgcttgccttagagatggactccttggatttcttcatggaagcttgtgtacatatgcatatttgggggtcagggagagggctcataagtttgataagagttcactgtgacctgtgtgccttggggcctcaaaaatagctgttcccaaacactgctctggggagccatgaagaatttttcattgatctatgacagcatgcagaaaatactgtaagaacaatttaaggggatttccacaaagctaaatttagtaagctttaaagactacactttatttaaaatatatattttctgatttttctgctggttaatttactattatatgatttactatttacttaataatatgatttactattatatgatactgttaatgtaggttagttctccctgcccctgccccagtggcttcccttagcaaaatctaaaagttagtttcaaaaagctttttaatatttgcacggcccatggaactaaatatttgggaattacagcttttatagagaattctcctggccctttatttgcctttctaacttttgctgtctgtctttggctatttcaagaataatattaaggaagtattattaagctgcctctggggccaatctgttcaacacaaatcaattgccatatgccttaaagaacaagtagatcttcaccaggatgttcttggtgggacagcttatacagcacattgctgcatgtagactttctcttccctcaaatcacacatttaccagagctgctcagtgtctgtctctctgtccccacactgtcatattgcccctgcattctccacctctctctgagtgctatgacatgcccatcccttggaagcctcctcatttgggactctccaccctgcagggacccctgtgaggtgtaatccagcacctcctctatccacacttactgctctcagcagtcttcctagaattttgggagataaactctcacaaattgtaatgtaatttacagctcagataagtgacactccaaaatgacaacctcaactacaatccgcatccttcatcttcatttgtctccctcccctccccaatatcttttggctatcaatattttattatcggtttagaaagtcagcccattggaaaataattgaatggaggtaaaatgaccaaggaaggtaagcattgaagagatggggtattagaagagctggcagaagaagggacatgatgatggaatgagcaccttctgctttgggtttcagagacactggaaccctcattcaccttagggctctgaagcttctttggtctgttatctatgttgtagtactattatttgttatattatattctttgttataaccacaatagatgtttatttaacatctttctattaagtgctggttgtgtgctagacatcatgctaggcactgggattatgacagtgaaaaaatgcagacatgtcactgcaaacactgttcatactgaccctgaatcatcaggactggggagaaaggtatatttaaagatccctgacttgtttttgacagattcaatgctaaaggaagtttccatagcctgttaaaagaagattcaaagatttcaggacacaattgatgcatccaatcaaagggaacagatggattgcaagacaaaattcatgccagtgaatcttcagtaagtattctctggaaaaaggcttagacagagatcgctgatgtaccaaggcaaacgccccttaccagggaaagaacccggatccctggacacgagtccttcttactttcttgatttgcctttctgatgcctatgtggctgttccatgcatgaagacttttagatctcagtttctcagaagccagtaaagagtaaataagattccaaggctaactaagtcccctctgaaactacatgccacattcagaaacgacattaattctctaagagaccaagattaaatcaggctggcatcttggatctgctggggaggaagtctgtttaatgcaattgacctctaaacagagttcatattaacagtgaccactgtgtacatcctgcttttttagctgaaagataaaccgtatgcccatgttatagagaagcatgagaaaacattggtttaggatgaattacatttaaaaattgaaatggaaagatcttctttgtaaatgactcagtaattttccatcatccgaaaacattttatataaagaaacaatttaggaagaaaaaaagacctactttagattagaaaatatttttaaattaggagataaagaggtggagatgggacggaaaaagaagttaacatacaaattattactgtccttaaactcagtttttaggaggtaagtggactgggcttgggtgttcttggtggcttaggatatgggtgctgatggggcagagaggaccaggtatgtgtgcagaaagatacgcacttagtgggatcttctccaagtaagtgttgaatgtagaagaattagacttgatgagaacactgggtgagggtggactcttaggtggatccttggatgaagtaggagcctgcagctgaaagggtgaaagaaggaggtggtaggaagggtttccttccccgtgttgcaaggctgcttctcttaattctgtgactttactacaaagcacagaggactgtgaccaacatttaataagccttcaataaatgttgatattgatacctaaaattccacctattagacattgatttatgttaacaacttccttcttaaagtaaaaattctcttgggaaggcccaagtcaattgaccattcattctttatgatgaatgtttaataagactgctttcttctggatatctagttgagatcagctgaacaacgagagttttatggctaaatggatatgaagacacgaggcaatttagggtcacggagatgctcggctgagttcaggcacaaatggggccttgagaagtcagaagttcttacttctctagataatatcctcaaaaagccaagtgaagatattaagaagaaaaagccaaaaataacaaccgtggctataccattttgggaacagagttggattcacatatcctccgtccttctactttataaacattatttggaaaattaaaagtcgaaaatattataagattaaaattctgtgagttggagtcaacttgtcttctaaagcctaacgctttctgagcctcagttaagttaccacaagaagcaagccaccaaatttgccatccagaactgtgatgcatgctctcatttccagcaagatgtaaagcagggttttcataactgttgaagctgcatcacaaccatctccacaaaggaccatttatcagttattttgggaaaggggagggtttttttagaagagaagaaaccacgctaataagctttttgtctgcaatcatttcccactgagattccatatcagtacatctccatttgctacatatttagctttaaaggaaaatgaggtgagatggagatatttgagtcataaaagcaataaaacgtgcttccggaaaatagctttcctttcagtccccagacctgcacttcccagatataaagtttgtttctttaacaaaagtcttggtcaagtatagccaggcatactgattatcagagaaatatatacatatgtttataattcatatgaaaggaaagagagaaagagccaaaaagaagggataaaaaaataatagctttagaaatagagaaaagaaacaaaaacaagacatacactacgagaaccccttgtaacctgcacccttaccagctgtccaggaaacccagggtacctccatctctcagctcagaggttggtgacaggtggtgtcttttattcatatgccctccctggggctcttaataattggtgtatttcttgtagtccctttagtaggctgggggcagtagtgggagtgagggcgagttggatgctggcttgttaatggagctgaagggagggctacaaggtgacagatgggatgaagctggaagcttctttggtgggaagggagggtgttctaggtcatgaagaattagatccattgagttgctgcaagaaatgtcccattccttgagttcctaggtgattgacttaatctgcccatcagtctttgtgtggttggttttgtggttgtgtggataaatctagacaccaaggaccctggatataccctcccaaagcaaaataacactgggggctggggtcacttattacttggctggtgtccatgatgggaaagatctcagggatgatggctgatgttgttggcattgtctttgcttgtccaagggctgctgtagaagaagcgaacggagtgaggggaagtccaggggtatgaatgtgtcgtgttcatgggtttttcaccaccaccgggatcctgttgtgacctacccactggtcaagatgaaatccctaataacttaggtgttaaaagactggaggttgccctgtataaattgggtcaccaaaagttccttttaaattttgcatagggcggtggctcatgtctgtaatcccagcactttggaaggctgaggtgggaggatcacttgagggcaggagttcaagactagactgggcaacatagtgaaactctggttctactaaaatacaaaatttagccaggcatggtggtgtgtgcctgtaatcccagctactcgggaggctgaggcaggagaattgcttgaaacctggaggcagaggctgaacagagctgagatcgtgcccctgcactccagcctggatgacagagcaagatagtctcaaaaaaaattttttttgtttcatatgtagtaccatagcaccaagaaagtgcttaggtggtaagtacaaaggtggccaaggtgagttctgacagtacagaatggggtttccatggagacggcaaataatgaagcagtggatgggggagggggatgtatgctccaaggttgtgcccactcggcacgacccaggttccatgctacaggcctctacttgtccagacctgagggtcagattcagatggtgcaaatgtttaagacctgggtcttcaacgagatgaattatcagctatttcatagctgcagtgttggatatgccgagacgataaaagcaacagcaatcagaatcaacagttgaaacgacatggcagacgctgtgaatgctatgaactgctgtgctgagcagcaggattcctgtgtcctggcgcaatgcccatggggattcatgctttcagagggtcacgcctcaggaacacgtagaagggcaagcatttcatctggcagggcactgatttaatctgcacgcatgtttggctgtaaaactagctcctcccccttaccatttttgagtcgctgccggactcaaattccacagattctggaaggtgtccaggaactcgttgatttgtcaaacttatggctacacacagctggaatggagacggactccactgaggagactcatacaggacaggagggaattttaagaggataaccctggtaagccatggtggattgggtgatgggaggctgtgtaagaaaagctctctgaccttgacttccaggaatttactcttagatggtttaatctagatactaccagagcttgtaatacagaaaatcctgcaggtagggagaagagattacccagaattagttgacagtctatgtttcatagagtagaatcaaagaaagatgtccttatgaattaaaaaagcaagcaaactatggtaacttgaaccagtttccagtgctaacgtagcactgccaagaaaagacactgtaaggtcaccactggtcactagatacagcttgttttaagttacaatcacatttacataaaaacaataaatggtctacatcaccttgaaaaatggtttttccttccagttgtaagcactttatgtcctggtgaaatgctgctcatctgattattttactatattgagaagaggaaaggggaggacatattattttcttaacacctaatggatccagacacatgttaaatgcttgacctccacaaccatgtttaactgttagaacaacatgatgtgtgtgtggtttattatttctattttccaaatcaggagaccaaggtctatagagattacgtagccttcctgggcactaggaacagggacagaactggaacctgtgcctatctctttctgtcgttgctccttccaacatatcatgttgcttctcaaaaccaacagtgaaaaagtattctttagcctaacctgagctgaaatggcttagatatgaaagcgtaaagtttcactggctgtgcatgatgcaaatttcttaaatataggcaaatataagcatgtgtgggtataatttctgtattatgtgtatacctttatatccatatgctgtatagtatgtgtgtatacatatagtgtgtgtgtatattttatatttatacacacacatatgtatatgcacacacacacacatatatataaaccattaatctaggaatcaacaaaccacatctgatgatatttctgcattgtcataaagccggagagagaagcttcccccagttacaggaagagattgtgtgattgtgtctgtgcttgctttttcctaatgtctgcatgttggacagaacttggcctaactctcatgttcatggtaatgtagcatctattttgaaccacaggaggatggaacattgaccagaagaacctgaccttagttgatggcaactctgttttatttccgctgctcacctgggcctctgaataaccgggtttcattactacaaggctggctcactatgcaccccttcacctgttcatttgcccagtgtgtgtctaacccagccatccacagctatgtcatgaagacctgtgcatggatccccacctgcctttcccatgttacctgcgagcttaccaaagacttgggatttttccagcatggtgaaagatgaaaatgtgcttgggtttactttgtcatttccagggctgggttaaagccatcatgtaatgaagccagatccacattaaaatgtggatcatggccaggtgtagtggctcatgcatgtaatcccagcactttggggggccgaggcaggtggatcatgaggtcaggagatcgagaccatcctggctaacacagtgagaccctgtctctactaaaaatacaaaaaattagctgggtgtggtggtgggagcctgtagtcccagctactcgggaggctgaggcaggagaaccgcgtgaacccgggaggcagagcttgcagtgagctgagatcacgccactgcactccagcctgggcgacagagcgagactccgtctcaaaaaaaaaaaaatgtggatcattgttagatgcattactatgaactttggggtgggggaaagggtcaacgtggaaaaacatccaggcatttccctttttctacacttgtctgtatctctccccaataattcattacttgattactttcctcattcattcattccacagatattccctggccattgaaatcaactacttgtgtcagaatacaaagctacatgagatgtggtccttgtcctcaataagcacacaagtcagggagttggaggggagattatgagtaaggaagagatacagaggtgaagaggggaggtgtccaagctggagggttctcaagggagagggaagagtctggaggcttacagagaagatagctcttgggggttttgccctttgagcctctcacagaggtcctgggccaaggaggactttgcgttttccatcagggtcagcctggtgtcacccaaacacctagaggagtgaggagacaccagaaatcccagattgtgtgacagcacctgggtaggcactgcaagggactaaagatgctacttgcaaccaaggatgatccccaagacaaaaaatatgcattataagaattatattttggtcctcaaacttctggttctataaatgctgttctcactgtctgggaagtaagatttggacttggccagtggaaattcagtttcttcatttgtcactcgatgcctgtgaaaactttgccaaaagcctgacttcttggagctttggttttctcatctatcaagtgagaatactaataatcataacaataatgcctacctcactgatctcttagggttgttatgagacttaaagtgtgctgtgcaaagtctgaaactgtgccataactctttacggtcattattattagtattggcaaaaatgtccatttctgcacccccttccatttgagtggtgagcgttttccttgccctgctattaagaggtcactcgtgtcaatgctgagaggcccatggaagcctgacagcttgatgttgcatctgtgagaagtgattcattggagcaatctccccttaagttctgatgaatgcattaagttttagaaggaaatctgtttgaattgtggcttgatgtctaatgcttggaggattatataattgaattgtagatgctaaattgcatcttctgaaatactgagaaatagtcccattctcatataggcttaacatccatctagaatattccaattgcttgttactaggagatatgtgtgttacatggcaagcatgtgctcatgtggactcacccacctgtgaggatggcataggtgaggaaagaagaagatgagaaaggttttataaggtaaactcaattgtgaaaactattacatgatggtggacaatttcagcttcaattcacctgatgatgaccctggcttcaataattaatgaccctgttattagatttctgaggcagacagcatctcattgcaagggaccactttgatgaatgaataatcgtaataaatacaaaccactggccagagggtcaacttctactgtctgcttagctggaacatgaatgaacccagccatgattgcaacattctcatggccattcttttggaattccaagtaggagaagaacctggagggtcattaagctgtgtcctttgtcttcaggcaagattatctccaaaccaaccaaatggggtagaacccacattgacactctcctggcaacaggctcaaggctattgggaaatcttccgacttgtgtcaaatctaacatttgtctttcatttagttgagaccaatctacataaatccaggttaaagggaagcttcttcccgccctccagaagacacaggcagtggctcaggtgacctgccagcatggaacctgtctctctcaacagtaagttactgagcacctactacgtgtgagatgctctcctggatgtgtttcattttatagtatttgacatctgttttctcatgtgagcctcacaacaattttatgtgtttaggtcatggtggggggtatgaccattataggatggatgaaaaaaacgaagcttgaagaagttatgtgaatctcctgaagtccagaaatggcaaagttcaaactcaggtctcctggctccaagcccatgtgtttccccttctactatgtcaacctctccctgccctgggctgccttgtggcaccgtccctttctgtggagactggtacatctgccttagtgtcttccggctgtgtgatgcttgtgttaaggctccatattctggaggtgtcctgcgaattctccactggaaaagggaaacaggactaaccctaggtcttgaagggtttccctcagagcttgagatagtcagaggaaaggactgagtgtccagggtttggccatctctaagtgctcttttgcttttgaaacagaaatagaccttgcatctgttgggcccatagtactagctcctgctgtaggtgcttttgtgggcactgcatgttaaatcctcacatcaacctcatgaggtgctgctgttacctccagttgtggatggggaaggtgagctgtggggagtttacatacggaggtggaaaatggccaaactgggatttgaacccctgccagggatctgctcttagcctctttaccatgttaaggagcctgggctccagcaccctctcctcctgtctgctgcccttggtccatagaaggaaaagcccagacctcctggtgtcctgggcactcagagataaccaaagcctggaaactcagcctttccatctcaaaagtgaaagaaaagtcaatcaaacaaaaatgaccgaagtgttttctaatattttcattaattaaaattatggttcctgatttcatctttttgacatccaacaccaatgtactaataatcaagcccctggaataatggtgtttaataaaaagggtgaaacctgcaatgcttttaggcaacacatttaccatggctagagagtagtgggatgtgttggtgtgattctgtgtgtcccttggtacgtcaaacacccacgacacttagtaagactgtgtgacaacagcgctgagcagtttaagtgcttgtaatccgctgcctgggaccaggctgagactcagaactgggtgttcttgctttttcacatttgctgctgattatgctgaggaattagatgggaaggtgggccagggatggggcagatagacatattgaatgtgtacccagaaacacagtgagggtctgtggtcaaggatgtggagtttctatccacttggcaaggggtggggagggtgagtctatacaatgaaatcactccctgtgtccattgcgcccaacaccaagcataacatgagcagctgcagttaggaggaaaaggccaaaacctccccttggacctcctgcctggacctccctgctttaagcaggaattgaatgtaaaatgctgtctgggccagccctgcctgggtctgcaaaaggagaggtgcctgcagcaatggctagtgggccagcccctggcagcacatgaagccacaaagatgccccagctactgggcttgtcacccacaaaggcccccactctagcctgccccctaccctgcagctggagtgtctctggagaagtatttccaaacagcccattccctgcccctcttcatttttgtgttatgtgccacctgaaggtctttatgatgttctatatccccgcttcttctcccatgttgttttgcctcctatgacattggaactggctcctgaacaaggggttaatgtaggaagggagcccccacctgccataatgagaacccccccagcacctcagactctttctcatccaattcatggggaggaatgatttgacaagcaggacaagttctatcctcaggccatgtgagtgctccagccaagatgattgagcctcttctggggtgggactgtttgccagtggtttgctgcatcagatggccttttggatcctggacacagctacaatcacagaagcgatcttggaagccactaagccagccctaccattttgcagatgaggaaactgaagactgcgagggaggatattcagcttgaatttagggtcagcaaaaggatgcattgaggaaagagcccaaggtgatcagtgtccagttggcatctctatacctcatggtgctgtcttcctgccccattgccaggcttggattgtcaaaataaggaactgatctccaggagataaattcgtcaagtagaagacaggcttcaagaaaagaaaggcactctgttttgcagtggggagcactctgctgggggcctatgtggctcagacgttgatggaaccgtcatctctgtaagtggagacagtaagcactgtcctaactaaatcacagctctttactgcttttatataaagattactcaggttgtaataatagcccataaattagtaagtaccattaagtttatgggcttctcctagtcagagtcctttctagctatcaatttggtagagtttaataaactctccatgacttataaaaccacggtagtcaagttttggtctgtactgagtggcgtttctgatactgacttccttctctacttgcgtgaaatgaaggcaaaaggacccataacaacacaattagaccacaagacaggtgtcagcttatcacattagacagctgcattaaagccaatgtacctccttcagggtctgggtgcctgcaaccactgggggtcttgcaagcatctagcaggataggagaacagctcagatggaagaacagacaacaaacccactgcccactgagattctgtgaaggagaactcctgtgcagtggcagaattgagtgggaaccatgtctgccccagcaaggaacttaacttctcatctaaaaatcacaccagtcctgcatacctcataggagcaattgaagataaaaataagtcaaggttcagtacaagctcaatctcatggaaaatatgaaagtgccatcatccaataatcataataatccagagctatgatatacaaaatgtcttttatcatgcaaagctctgtgccaagcactagacattcattcttgttttgatccctgctgccctcctagcaggcaagaagtctcgctctaccaaggctcagagaggatggcaacttgcttaaggtgacatagccagcctactgtggcaaattcagacatccaatgcaggtcattgactccaaagaccataggcctacactgccccagactatttaacacatcacttttattaggttgtatttgtcctaattcactccatacttcttaaagattttctatcaatggtcaaaaatacaaatacaggttgggcacagtggctcacgcctgtaatcccagcactttgggaggctgaggcaggtggatcacgaggtcagagatcgagaccattctggctaacatggtgaaaccccatctctactaaaaatacaagaaattagctgggcatggtggcacgtgcctgaactcccagctacttgggaggctgaggcaggagaattgcttgaacctgggaggcagaggttgcagtgagccgagattgcaccactgcactccagcctgggcaacagagcgagactccagataaaaaaaaaatacaaacacaatctaagatatttttattaatagcccaggcttggattctgcaaaagatgtggaatctctgttgaaaaccaacataagtaatttcagatagaactactaccaaactagatatcaacttacttaagtaggttgatggaacttaacctcactttcctaggagtagctagacgtcctacagacttgaaggttaggggatgaggggtagacattgaggatcctggaaatgaattagtgttctttcctccatgctgtggtatctgttaggctgggtggtataaccagtcgcccatagttctgcatttcattgcaatccaagctgcagtgaggtggagctgaggccccagcactgaagttgagtgacgaaaaggcacctgaaactcaggtgcatttcagttggtgactggttttcatgggaactgctaaaatgtaaagagaatggctttgtagcccataacgcggagtctgcagtcatccctcccatggcatttttggagctacccatgaccatgataggttgccattaacagggatggatttggctgtgactgatctgcagtgccctccaaaggtctgacaaagatctgagcaaatagattttacaagaatgttcactattttgttcccagcacctagcagagtgtcttatacatagcaaacactgatacatatttgccaaacaagatagatattaatgtcttaatttattgaaacaaagactccaagaagctaaatgcattaacttgttgcacatcacgcagatctaactaaggtgcaaggtaagatttgaagttgggtctgtctgactgtagagcccctgcctcgatcactaaaacacttctggaaccttccgtggagactgaatctgtaagatccttgtcacaagcacctcaggtaattttggtgcaagtggatcacacttgaaaaaaggccattgtagtgacatttgaatgacagctgacatgtttgagctcttactctttcctcagcacagctgcataatcttctcaccaactctacgactgttgcattctagagattgaaaacatcaaaccaaacctgaagcactgagaggttgggtaaccagctctggtcactgagttggtgagggatggattcagaagaggtctccaattgtgacaccgcagaggacctgctcttggccactacactctaccagctctgcaagaaggtgagggagggagggtggagtgtgatgggctcttactgtctccattcggttttgtcttagataaagggaactgagtccttaggcccctccagcaggaaaggctcacaacagcagcccctccggccctggggtcagtctgtattcacacctaagggcaagctaagttgtgaatttgacagaggacttggacagtgtctctagttgtcccggttatagctgtggttagtgtccaccgatggatgaggagatgcttccggcagattgctctcttagccacaattccctcatttatggcagcaaagcaggccaacgattgcaaaagacagaaataaaacagaaaatcttggaatgagcatcatcctgtaaaaagcatagagtgacatcaataacgggtagacaccttctccccaccttcgcacaactgtaactttttggttgttaaaggaacagataatcatatttctaaagaaagaatgccatgattcaagccctggagtgaataaagactcatttatgggaggttataccaagaggaaaatagtaaacgggcacgtgttttagcccttttagacttgtaaatggtccacatgtaatgtgctccaaaaatggtgaaatcatccagtaaagcactcacagccctgactgctgcttgtggcatcatgggggaaagtaaaaaggcccatgcacagagggcttttttaacttttcctctagacagagtcttgatctgttgcccgggctggagtgcagtggcatgatcttggctcactgcaacctccgcctcctgggttcaagtgattctcttccctcagcctcctgagtagctgggattacaggcatgcgccaccatgcctggctaatttttgtatttttagtagagacggggtttcaccatgttggtcaggctggtcttgaactcctgacctcaagtgatccgcctgccttggccccccaaagtgctgggattacaggcgtgagccactgcacccggctggggtttttaattaatatataccctcctgtactaagtatattttaaattttctatgttatgtgatgctttgacatctcaggtcttacagactggaggagagatgtcctttcctggagttagctaattcctagagatcccaagcaacttgctcataagcacacttttgatatgcaaaccaaccggttcagagttcatactcctacctgcctcctttatcagggtcctgccatatgggacacaacccttctgccctaaatcgccccagggccagctaccagacaactaggaccccccatataacccagagcccacgggacatatttgaactcgtttgaaccaaccctaagcctgctcaactgcttaccctgcctcgactgctccttctcctgaaaaccaccataaagctgtctgtccgtgctttttcctcactccttctgcctcctggctgaccctggtgcttccccgcatggccctgtgtggcgtggcttgtctcctactcttgggaattgtcaataacaaactattttttcaatggtaatgatcccctgatctgttgaccttgccacacctgaataaaaacaaacccctcgggtacgctctgaatcacctccttactgaaaaccacaatacattcttctaattcttacaaagggaatcccacctccatctgtttataaatcaagaagtgttcatcacatgctctggaaactttcatgcaaagtagttttcttgtgccatcgtagacgcatggttatgtctagggatgtttggagatgaagacgcacaactgactcctgactcctgtttacttaactgtgtggccttgcgcaggttattcccttaagtcccagctttgtcatctgaaaatgccacggcagatgcgcacctcacgtggttgcagggtttccacgagccgatggatgtaaagaacccagcaggacgttggctttcagttaatactgcaaaaatagtagcttttcagcagttcttctctccccaatccacagctttggtactgtcactccacagcccctggatgaggctctgacactttgcagggaggacgcattctcatcagaaagagacggaacgggtctcagaagcttgctttcagagggcttgcctttcaactcaaagcccatggggatgctggggacagagcctgcctcccatgtgagaggccaccatgcgccagagagctcagcctgtggaacacagagcaaaatggcaactatcttcccatcttcatttgcgctcgctgtcctgtggaaacctcctctctgtgaaactggtggagtcacgattttggggctggaccatctgcctggtcccaaatgtaattcatgaacttggagggatctgcattactgttcatttcagcaggaaaaatgatcaatgtatttcacagctttgagaatctgcaccttttttctggactgcggcaggcatatatgggttctggcattctgattagtaaagcagccaaattttcccttttatttttttgcaaaatcctctgtcttccactttaatacgagcgccagtaaatattttatgccgaggtcttttcagagcactgtttcctatctaaaggcatatacttccaccctagatatgtatttctttagttaatgtacacatgtaacacacatataaaataaatgaaagtagtgtatttttccagttatctccaaagaagtaaaactaattagatagaatggagaaggggctatgctgattaatttaattatctgtttaactaaaggctaaacagaaagcttattgaggtttctaccctggtaataaaaaaaatctttcaaatgtacaagcccacttgtatgccttccgtagactgaacatgtaattaattttgagaattcagctctgagcctcaggttcactaatgttgaaatcaagtttgttgatataaaagatttgattggattttcatgcgttctaagaagtgttagaaaaaaattatgtaaaaaaatcttcatagcttattttttataatttgcatcttatgcttggtaagtggaacataggattatttcccactaacagaattggggataatcaagtttaattaaaaagtattttatcataaactcttctcatctccagtgcaaaaggtaacggctctttccaacaatgactatattgccatttttactgccctccttaaccagggtacggtttaacatcccaaagaaagcctatcttgaaaaccttttatgactcaatctcttatgagagcttacttatataatgtatgggttttttttgttattgttttagaatgatgagtgatcaccataacataaacagacaccactgagcggactcattcttggtcttctgtctgattctgggagattcagagctctggctctgccactaacagcagggagttggagaaacgattttgctgctctggagctcagcttcctgattttgagggggatgtcttggaggttctccccacatctggaattctgggattatatggtgccttatgctagtggtagggggtgtgtattgacaaccaaacatcccgatttgcccagcattgagagagggttcctgggacttgggaattggggtatgaacactggaaactgccagggcaaattggaaccagctggctaccctggttgcggggggtgggcatgtggtttggtgtgtgtgggcacagcctctgatttatagaattataaattatatgttaattatatactacataaattatatttatacacttataggattataaattatatattaattatataatataaaaattatatttataaaattataaattaattaatatatgtgttatatatctataaaattataaattatatattaactttataatatataaattatatttatatattataaaattatatttatagaattataaaatatatattaattctatttaattccaagcattgggttgagaaggaagatacacaggtaaagtactttgtatattttctggcacagaagcactaagtaaacattagctatgattattattgtttttgtttttctcaagcgcttccacacttttcatctcagacccacagagccagtgtgtgcggctgaggtgctcagactggcaggtgaaatgacttcattagtgccctggctcctggtgggatgagagtggaaacccagccttctgagttgaagaactggaacaaacatcagccctgacacattgatgtcagtttacctttgtgagaaacaggaacgaaatgtgaacatctatttcaggtgatgtcataaagcccgactcagaagatggctatgatttcaacagcctgtcggcagcacggatttcagagtaacttacaatcagtaattaatctaaacaacagtgccgtgtgcactccattattaaaacagaaggggaaacaaaaggagactgagaggattgcttttgaagggtcatgttgcagcggcttctgctggatactaaaaagcaaattattatcgggggttgtttgtcattcacaggaggaattggattcctttatgtttataaagtcaccttggtatctggaaggagagcagaaactaacagagcctactttacttaggaatgtaggatgctaatttatttgcctttttcttatattaatatccttatctgtaaaaagggggaagaaaatagggctgttttgaggagatgtggctgagaaaacagaaaaagagaattacaggcctgaaatcccagcactctgggaggctgaggtaagaggaacgcttgattccagggatctgagaccagcctgggcaacatgacgaaaccctgtctctatttaaaaaacgacatttagcgggctgtggtggtgtgcatcagtggtcctaactactcaggaggctaagttgggaggactgcctgagcgtgggcggccgaagctgcaatgagccatgattgtgcctctgctccagcctgggtgacagaacaagactcttcctaaaagaaaaaaaaaaaaaaaggaacgacgaatcaggccaggcacagtggctcaagcctgtaatccctaatcctagaactttgggaggctgaggctggtggatcacctaaggtcaaggggtcaagacaagcctggcctacacggcaaaaccccatttctaccaaaaaatgcaaaaactagccggacgtgatggcgcatgcctgtggtcccaggtacttgggaggctgaggcaggagaatgccatgaacctgggagcttgcatgaacccaggaggcggagcttgccgcgagccaagatcacgccactgcactccagcctgggggacagagcaagactctgtctcaaaaaaaaaaaaaaaaaaaagtaaaataatcacttccactcaaatcctgggttcacactgttttccccaggagggactagaggtccataaagaggcagtcacggtcggggctcacacagctaaggtgtggaggagcaggggcggggaccaggggtgtggctggaggctgtgtgcttgtcagttctccagctgcctgtaataataagcctgatgctagcttacccagaaggggcgaagataagcgcaggggtgggatgggggctgctgagcagagcctggaagatgagtcctcattgaggaggaagcccatggagttggcccagtgatgataaaatcagctgggaaagtcgatggagtttcccagcgcttgaagtccattgactttcccagctaatgttaccaaagcctccttctgactgtacctgttttcccacaggcccctggcgctggttctctctggaggttgagtttccgtggggagagaagagtgcccagcgtgaccaccgttggctgacttcccatgccttattccttgtttcccccgctggggcccagcccaccagccccgcagtgcatgaagccacttatcaccacggttcccagagaggacgggctggcccaagtctgcattgtcacctgctctggggaaaacaaagccctctcccccgccctccccgcagcatgctgggcacagggccagcccgttctatgttttcagtaaattttcaaacatgctggttttggtggcagcttttgcagtgattatctcattaggggcttggccctgaaacaccttatttattgtggattgaaaaaagttcaccttttcaagcaaaaaaaaaaacaaaaaaaaacaaacaaaaaaaaaacagaagaaagaaataaaagaaccagactgtagtttccctggaaaattttcgcttgtgggaaaatacctccccggcccgtagagagacgccatcaccaacagtgtggagttatcagatgggactggtccagctttgtggggccggggcacacagtgccaatgtccaggtagtttccaaaccgtgttttgtttcctctgtcctctttataaacccacggattgaacctcatgggcccacaagttcctgattgcttcgtatatattgtacagattttttcaggaaaataaaatagatcttgctctaccctgacagagcagggccgatattctctagaagagaggagaactctagaatggatggcagcactctgagtgtgtaacccaaacagcatgctgaaatagtaaaactctgccgcaggggcagatggctgctgggagaatatttatagcagggatctagaaataaccgtaagggaaaagccttctgaggaggaacggaacaagagtcttcggggtggcacttggagacactcttgctcttgcctgaggtcctggagggctgcaggccgaccgctgcacgggagagaatatacgtggtattcacagggtacacagaagtcataatacttcatgtagatctgtgccacacagatgtgagagctaggacttggaaacaggaagagaagtgggaggatgattaggagcgtaattggtaaatgtagtacagtcaaggcagacgctgtaaaaggaccgggcactgcagagctgcaggacaagagcctggggacacgacagtcaaccagcccgtgggcatcatggaaacagcactttgcaggcacctgagtgaagcacaggaaggaaatgcagacacaggtgaaggagcacggggttgggttagagccaggcagcatccccccagccgctccatgctaaagccttcatcgattgcccagagagtgggggttctcagttaacgttggaaccatacagcaatgaggcctgggtactacttgtaattttctgtttatttctaactttatgaactgcgtcaagtatacttcctagcatgggttcagtattttgcaacaaatctttctgccgtggatataaattcatgagcttcaggtttcattaaagagaagtacacaaatgaagtacccagactaacatttgaaaatttaattttatgtttgtttttattttttaagggacagggtttcactatgctcaggctggactcaaactcctgggcacaagtgatcctcctgcctcagcctcctgagtagccgggaccataggcacacaccaccacgcccagctcaaactaacatttgactgccttgtgaaatattacctagtcactatcccaggtccctgacagcatagaccagcaaaacattagaatgacaccagacctattataactgcaagccatgaacaggatttcaagaaaagagatggaagaatgttcagattcctaaaaatcttcttaaaagagaactcctagctttccacaaaattcacttaatttcttaagtgatttttatcttttaaaagcacaataaaaagcaatcagatgttgtgtgtctgtgcatctgtacagcagtaaaggtatctctcacatggcattaaaaaaaaggcaaacaaatccaacacaccactagaactcaaatttggagaaaatagctgcaggaaaaaattgcgctgtgtgtataaaggttttttttaaagagtgtcttttcctgaactgacatttccattcttagttttttggttttgttttgttttgttgttgttttgagacggagtcccactctgtcaccaggctggactgcagtggtgtgatctcagctcactgcaacctccgcctcccgggtttaagcgatccttctgcctcagcctcctgagtagctgggactacaggcatgggccaccatgcccagctaattatttgaacttttagtagagatggggtttcaccatgttgaccaggatggtctcgatctcttgacctcatgatccgcccaccttggcctcccaaagtgctgggattacaggcgtgagccaccgtgcctggcccattcttagttttcttacttgggtatttttccctgtctgcctcagggaaatgaggaaaccaatagaagcttggcacttatttacttttcagttagtatatgatgtgatttattaaatgtatctttaagtctccaactggaatcacccatgttcttaacaacttaggttactcctttcaaggaaatgaacatattattacaagcacagccattctggaaaatacaactgtccactacatatagaaacttggcctcagatgattgtgtcttcttagcaagggacagtttctattcccctgaaccccacctcacagctctggatgacatgattgaagctaaggcaaggtcattttctaccccgactcaaatctctcttacagcaagttaaccaggtggggcttgagtggtcccaagcttcacactccgagtcaggcaggtttcttaggtctgctcccatactgaaccggctactaggggcacctgaccacgtagaacccaacagacagtgaccgggtaaatactcagcactcgggttctattctcctattgaataaaggcagcatcaacctgcctatggacagtgattgaaagcatttcactccaaattgagctgcacactctggtgtcttcaggcacagccaggcatagccaggacagttggttgcaacaggactgggccgactgggagcccagtgaggcagggctgggaatggactctgttgctggccttgggagaacacacaagggcaaaatgagaaactggaggtagctgtaatccctctgatgtcagggactgtgtcttacttccactgtgtcttcagtgcccagctcggagtctagcacatagtaaccttccatcagtgttcattgagtatagacatcagagaaagctggagtttgcaggggtgatcctcatcgaagggatacatcgtggtgacccacttagtggaggacactattggggccctggagatggtgatactcagcaattcacaggcatgtggctggcactcgaggagggagtctgtcatcaaataggtgggtctcgggaccaggctgggatataaaggtgggactttaggccttggagactctggccacagcaagataggactagatgaggtcaactgctctccagaatgggactcaggcctaggggacagcagagacctaggtatagagaaacagccaggaatgcggagcagtccagtcatgaggactgaagtgtaaagtcaatatgattggcccagtgatgctgctgtgcccaagagcattcagctggaactagagctccctgcatcacttctgctaaggatccaaggccaaggccagggtagggggcacggacggggatcacatgagagaggggaggtacagaggccgtggaatgactgtgcctgccttcctgatcccagcaaggtgggtatttgcaggctgcctgcacggctcagcagtttctggaaactgacttttcagtttatttatgattgttttcttcccctctgaacaaagtgcatttaggttaaaaaccaggcagcacataaataaactaattggaagtgtgtgcactaagattttagtgtcttttaataaattcgaaattttagagtcttcccaaagcagaagtaatataggatcctaggctttacctgctaggaaaacattgagtttaaaaggaagaaaaagggttcttcctggttgagaaagggagatggtggttatatggagaaattaatcaaagaataatgacacttaaatccttgacataatcatgaggttcacttgccatctaaagaaaacacacactcacaatgctcacacccactcatacataataaaggctttgacgggatgagtgggacctgcttgtatgcactattttctgcaaagaaaatatgtttatggacaataaacaaatgtctttgatttcaaccatattatgaataaaattatcagcagagtgctaagagcagatggcatttcatcatttaatagagactagatatcctgcttaaagctgcagtttgtctcttattagttacaaatgtcacagcccatgactcttagaaggaagtttacgacccacaattagatatcctagaatgtttaattctgcttgcctttgaatttcttttcaaaagcagccctctttccctcactgttcactgccacctagtgaatttatctgggaaagaaaccatagctgggaagaagatgcttttttaaaagacaacagctttcaccagtgacttgccttgtcaaatgataatggagcaggaggatggaggcttttgccgaaaaggccgtggcaaggacaatgaaattcgacccatcagagcagaacacattaacaaagcccctgcccgggggaagcttctggaaggagcagctcaggtgagcaacttctgacagctctgggcttctgatctgacagtctggttcaaaagaaccaaggactgttccctttgattccccttcggttgaacccaaatgccagacgacatggcgcgttgcccatcctgggcagatgttaagggcttggtatagagaaagggtgcgtggaatgatgaggcctgtgcaggagccccagtcaacatggaaggcatcaaaaccgtgttaacgagaccccctgggggacgatcacagaactgaagcaagtggtaattagaatggaaatgtaatgatgtgccgctatcctgctatcctgcttcccaaccctggtgtgggccagtctcctctcactgtgaatgcaaaggctgtagtctcctttcaaacgcagagcagcttctacccagggtcacccatgctgttcctccaacacccaaacagaaaactgcaagagagaggtgggcatggtactgattcagtgagccctgcatggctccatgtggccctgctggaaaaatcctgtctgcttcagaaaccaccttgcctctctctattgggcatgcagttggcaagagtgatctttggtgactctgttctgtccaggttctttgcaagagctggagaagtagattgctcaggttagaggtgtaattaatacctctgcagccccccagaaagatgcactgaagatttgcagtggctactgccattggcccatgtgtgtgtatgcatgccaagtgtgcatgtgtggacatatgtgcatgtatgtatatctatgcctgtgtatgaatgtgtatgcttgtgtgtgcccatgtgtatgtatgtgggtgtgtgtcaaccaagagtgtgggggggaaccaagagatccatacatccatatgcatggatgtatatctgtgtgtgtgtacacatgtgcatgtgtgtgtatgaacatgaaggaactgaagattttgagtctcttattgatgtgaattgactctgaagggtgagttttaacgctgtgatagttaaggggaaaccaagacaaagaaaccaatgattttaataactaaatgaggccgaaataaaactctaagatttatttttttcactcaggagaccactggccattcagctcatgacacttctccccaccagctcttcagagtaaatgtttctctccccaggaacgagttcaagttttaaaagattctgcatgggactgcctgggtgcttcctgctagccatcactttcatgctcagaatagatgtgccccattgcaaaaatggcactgtcacttggcactgggccactcactgatttgatgccatttttattgtaatttacagttgtcgattgaattggaaggcttgaactatccgtggggacataagctattaatataacaatgcataaagagccgaagcacctcgccgggatactgcagtttgaattattttacatacgcacttctaaacgcactctcaaccttagcactttgcagcctgtgggccagtgttgctcactgcatccatttctccaaaatcatcattcctctccagcacgctggatcgaatccacgttcaataggaagcaatgaaacaaagaccacatgtgctggttttagcccatatatgatgtggcatataaataagcatagctaacatgctttccaaaacacgacccacttctccagagtttaatcatgctgaggcctcttccagagggtgggagtccctttccagggcaagtccacaccaatagaaatggccagagcactcactgtccacgaatcaataaaaccagaagatgaacaggaagacataaggagcgcaagtggaaaactggaatgctacagtaatgctctgaatttggatcatatgtgcccagttgtgagaggctgtaaaaataaccctcgccatcctgttcttggggaaaaaaaggcaccaagccttctgctgtgatcaggttgttcccctccaaaattcatatgttgaaatctaattcccaacacgtgggtattaagaagtgagactttcggggctgattagatcatgaaagtggaatcttcacgaatgggattagtgtccttataaaacaggctggagggaacctgtttgtcccttctgtcatgtgagggcacatagaagggacaatctgtgagaaacgggccctcaccagacaccagatctgctgttgccttgatcttgaacttcccagcctccaaaactgtgagcgatcaatttctgttgcttataaactacccaatccaagatattttgttatagcagcctgaactgactaagccacctgctgaattgacttctttccctggcaacagttatggagagagacttctgatctcaaaatcccactcgatgtagggagctcagatgtgagttcctaacagaaatctaggcaactttggggcaaataattacttcttaacccaactctgcaaataagtaagtttttcaatattagataattcaccccaaagttacaaaacataaatcacctaaagagggaaaggttgaagcagctaattttgcaggggactcactttgcttggccatgaaaataagtgggcagatctgaactctgctctgcaggagttgatgactcaggagagacacctgagcatgagctacagaagcagtgaaatgggaacattacaacaatgcattctttcccacctacattatgtttagctgcattacatcttattcattcactaaagaacaaaaaaagcaggccgggtgcggtggctcatgcctgtaatcccagcactttgggaggccaaggcaggcagatcacctgaggtcaggagttcaagaccagcctagccaacatggtgaaaccccatccccgctaaaaatacaaaaattagacgggggtggtggtgggcacctgcaaccccagctactcaggaggatgaagcaggagaatcgcttgaacccgggaagcagagattggagattgcagtgatccaagatggcaccattgccctccagcctgcacgacacagtgagactccatctcaaaaaaaaaaaaaaaaaaaaaaaaaagaaaagaaaagaaaaggtgtcatttgtggaagacatcctggcatatatgctatggattctctatctatagtaaattttagaaatagaatttttgaaaaattttaattgcttaaatgagtcacagtgaagttttaaaaaattcattctgattgcagacttttgttctctggctaacaggaaggattaaggaagtaagaaataataattattgtgatgataataaagtagctcatatttcctgagcactaactacgttctaggcaactgtactaaatgcttttaagtgaatcatcttttaatcttaattttcacaatgttctttaagataatcttacctgtctgccttaccgaggaggaaacggaattgcccaaggttcaacagctaacataggacagaactgagacggaaactttggactgttggattccaaatttagtgctcttaattattatacttatagatatattatgtcttaggtatttagttttatatatactagttagttttagtttatatataaactagttttagttttatatattttagggtgtccagtaaaacactcattctggtctaaatttatagggcagagttagcaaatagatgagagataaaagagaaaaaatcagaaaacttccaagataattatgataagaatagctatgacttcttgaacacgtatatgtcaataataatttataaattatagattatataatttacaatatgcattatataaaatataaattatatataaaaattgtatattacatatattatatacaaattatatatattatatacaaattatatattatataaattatagattatatataaattatatattatataaattatagattatatataaattatttattatataaattatagattatatataaattatatattatataaattatagattatatataatttatatatattatataaaaattatatattatatataaaaattatacatattatatataatttattttccaagtctagaatactctcactggattattgtggcagccttcaaactggtcacccctaattcctgtctctgctctagtaaatccattcctgtacatttccattacagttgtggttctaaaatgcagatcatatcattctctccaatattctcaacgcaacatttctcaacatttccttgactgataaaggaaatacttctgaatatggttctctctttttttctttcttttctttttttttttgaaacagagtctcgctctgtcacccaggctggagtgcactggcacgatcttggctcactgcaagctccgcttcccgggttcacgccattctcctgcctcagcctcccgagtagctgggactgcaggtgcctgccagcatgcccggctaattttttgtatttttgttttagtagagacgtggtttcagcgtgttggccaggatggtctcaatctcctgaccccgtgatccgcccgcctcgacctcccaaagtgctgggattacaggtgtgagccaccgcgcccagcctgaatatggttctcaagaaccccccaatctagtctcttaccctagtgcctccctagcacccatgtggacaactttgttcaatggtcacaaggtctgagaccttcgctcacaccatggacccgacctgtcctgctttcctggcacagtacaacatagcgggcgtgcatatgaactttggagtcaatggaacctggattggaactccagctctgccgcttttcagtggtaggaccttggactacctgtgtagctttcctaagccttctgttcttcatctgaaaacatgcattgttgagagcatccagtgaaatcccaggagcactccacttagcacacaggattcaggaaatggaagctgtttgtgtttgccttggggaattctatgccctttcttagatccggtttttgaggacatccaggtatataggcctccctccacctcggtcaagcctcagactccatcattgtcacactcaggcctgacatttggcctaagcccatacccatggttcagctttccttttactcctagtcctgatataattccaatgacctcttcctaatatgtacagtaaaacgctcaatatagtctcaatttatagggcagagttagaaaagagatgagagacagaagagaaaaaaaaatcagaaaacttccaagataattacgatcagaatagctatgacttctcaaacactatgtggcaaatcctgctttaagtgtgtacgtgcatagccatccctcggggtatggagaggacttattccagaacccctgcctatgtccaaatccaggcatgcccaactcctacaatcagccctgcagaactcctatacgaaagttggccctgtttatatgtaggtttcacaacccgtgaatatgatatttttgatcctcattttggttgataaaaaaaagcatgtgtaagtggacctgtgtagttcaaatccatgttgtgcaagggtcagctgtatttacttaataaattttcaaaagagtggtgtaatttttaatggtcccttttatatctactacttagagagattaaataacttataaaatgatggagcctgataatttctttttaacttttttacttttggagacatggtctccctctgttgtccaggctggcctcaaactcttgggctcaagtgatcttccagtctcagcttaccaagtagctggagcctagtttgacccaaggcaacctggctttagggcctgggttctgagcgagtaccttctccctccgttccctgtctgtctctttcctcagttctctgtccctgccatttatacaaacactggggtacagcacagatctctggttttcacccccacgtgccagacaggcggctcatccactccttgttttgcagtcagctcagcaaacccagttgtggtgcctggctggctctgtcctttatgtcaacttcatttccactgtctcgatttccagtgtctcgattcacctgaacttatgaatttaaaatcacttatcgcatgtggtgaaaggaaacgtctccattttctatcagttttgtatctgaagtagcatccatgctggagcttcaaagaattcattataaatattcgatggcagccagagcttgagactcttggatgcttggaaaaaaacacctagaaaaactcctggtgaaaaatatttccaaattactctatcattataatgattctatcattatctgcaaggataggctgggtttgggtcctgggaaacttagagaggtttttaggaagagctgtttcaaatgacttttccaccctatttccccccgaccccttaaaagtctgaataaatgaaagacgtcaacctttccatatgcagttacagtctaggatctgggatattttattttatatacttgccggccttaggataagctgcacagtgaatcaatatgagaaaagccaatctgttcaagattgttgaagttaagattattgaagattatttcatgctgaaaatagaacatatatatatatatatttctgattgataggattttaggtggatttcatttcccccaccctacttcctatactttttagcttttctagaaaagctatttacagaaaaagtaaatatctaagggaaaatcaatcatttgatgactttagtggaaaaactctgaactagaagttttgagtgttagatacagttttaactctgtgttaactttgtacaagtctttcggcatctcagagcccaagcttttgggtcctcacaacgtgtgggttggatggagctgtgatgtttggacttcaggccccaaactccagggtttccccaagaacctctgacattccctaaccccttagccctgaaccaccccaggtttctaccaaaacggctctgtgttatctattatatgttttaccttttaagattcccccatactatttctatttaaaaacacttgacttataacaaaaaagtttgaaaatttctgggctaggtgtcttctcacctgtgatttcataatcctcttgtcaatattatagcacatgacgactgcaggatctcccagaactttctacagtgatccttcctgcgggcaatgaaactcacagaattggtctgcaataattaactttgcttagccacttcccagacttttttcttaaaataattacttgctgcggggttagtcttacgagtagataaaataggactaggtagtctgctcctcaagagaccctagatactcaccattggctgaaattccacggacattcatttatgctctattccaatttaggtgtgaattagtttcaacacatcttttgagataggaggagagagggaaaaataacagtgggaacctagggatatagcacatcagatgatggggaaaatggtgaagaaaggagaagaaaagaaaattgatgacacgttctacttatgtcataccttatccatatttggacctggtctttatggtcaccatctccatgctggtgagcttctaccttcaaatatgcctggcttctaacacaacacaacacaacacaacacaacacaacacaacacaacacaacacaacacatctctccttctgaataatgcccataaactcttcacagagcaaagcacagaggtatattctcttcctcttcccttcctcttcattttgggatatcctctcaggagcatcttgtctaattttagacatatcccccatcaattattggatgaccatcattactcagttatttatagaacttaatgaaaaaaattaagctgcttttactggatttaagtccaacccgtagactaccatgctttttgggaatagaagatgcacgtttccacccagttaagtaccttttgggaaaacgcaggatgcaaaggagctcagaaaaagctacaagaaaagaacacaagtgaggtggtccatagattggaagattctttcctaaatgacggagcctaaggtttcctcaccagctgtaagtctcctggaataccttcacagcatgcagcttaatcacattcaacagatgcactgggccagacacggtgactcacgcctgtaatcccagtacctcgggaggccaaggcaggcagattacttgatgacagggctttgaaaccagcctggccaccatagtgaaaccccatctctactaaaaatacaaaaactagccgggtgtggtggcgcaggcctatagtcccagctactcaggagcctgaggtaggagaatcacttgaacccgggaggcggacacattgagtaattccctacttatttctcattcacccagctcttcattgcacaggtatgtcagggtgctctggacacagagggccgagaaccaagccgacctcccacaatgcagtggttatctcacaacccaaagtttgaaacgctttggaaatgaagggacttttagtgggaagggatacttcagagaagcttttccttgtaaattctctcaattttatccacagcaaatatctgaacttcaaaagcttactcaaattagatggatttggcttctagtacaactttcttgagtcttgaagatagtgagaaaaaaaaaaaagtcctgcagaaatgaattgcgaagagaagggcttgggagttctcattttggcatgtagtccttaaagagatctgacagctcaattttccaatatgataggcaggaaatatgaaattagctctcagttatatctggcacagtgattacgtgcatgggaggtttcatgtggggcaacctgtcacagccactttctgaagctttattttcctggaattgaaaacccagcctataagaaattgaaagcacttaggagaaagttggagggaggaaaggatttactttttgttctacgtgggtgtcgttcctatctaatctcataacagaagcctctccgtcacataggtgccttggccaacagcaggccctactgctgaagtgaagagatggccagcatccaccccaagatgcttcattctcttctccatgtaagaaaacattcattttaatcagatcagcaatatgcccatctaatctaaaatattgtacaaatgcatcctcactcagatgtgttctgtgactaagctttacctaatggggtcttaatagaaatctcctgaaacaggtagggggtaaccttctctctctttttcctactgcagcctggaatacagatgtgatgcctggatctcaagtagctatttggggctgtgaggtgatccactgaggttggtggaggagcaaaattataccagaggcctgggtctctgttgactacagaacttccaaaacagccctggattaactacctgcagactgtttttgtcgcaaaagagaaataaatatctatcctgtttaagccactatcagtacatctagtaagcattagtttttttattatgtgaagctgaatgtaaaatgaactgatatcattagtgtatttatttcaaatatcaggctctcattagtacataattgctaagataaggcagcacactctaaggggcaccttatttcacttgcccgccctatggccagagtcattattggaataattagttggaaggtcactgagatgtttttcttccctccctccctatcatctatcttttttctatgacaatgagtagaattttttaaactctaaatttcataaagatcacattgaaatgatgaatttaaaatggctgaacccatcctaagctaaaagaattacgtaccgtcagcgattcctactaagctgaagtcaaccaactacagacaaggtatggtaaggtaccaggtcctccttgctgtaaattggagcaaatgctggcttagagaaaggtcttctctcattttccccccatgttttatgtgcttcccacattccacctgccatcgaggtctacatcgccatcaaggtctacactgccattgaggttacgctgccattgaggtctacactgccatcaaggttacactgccatcgacattacagtgccatgggggttacactgccactgaggtctacactgccatcgagtttacactgccatgggggttacaccgccattgaggtctacactgccatcgacgttacaccgccatcaaggtctacactgccatcgaggttacactgccattgaggtctacactgtggtgctcacttccctgctctagatctcttactttgatttacaccagacctcagtctctgcgcatataattgctcaagtctagaaccccaatctacttctctaagcgggtttcctttctttccagatgctctactccccagaaagggaaggtgaggccacacagagcctatctatgccttcctgtccctgaggctctacggtggccccgctcagtggccctggccccatctgtgctgtaaccccagcccgacctgagtagaaaggccagtgagacacaaagccaagagaatttccccagccactctggtctccacgagccagtcctggcactcagaatgctgaggttagagcaagggaaattgccaaccttcggccagtgtgggcccatgaagctggcgatttcgtgtggttcaacttagtcctagagctctcactgtgtgtggttctcccatccagggaaaaccaaaccatctcaggcaagcctaacagagcagctgcctttgaaagattctgagttgagtgtggtatgggggcaggcctgagaagtgtgcccttagataccttcaagggctctgggcagtgtttgagggatccaaatgaactcagttacaccaagctctcctccactgtggcaggacttctggtcacggggtccccacgccgcagggcccttccatcatcccagatccttacgcgtggagtctctctcattctcacaacctcagcttacatgttccacttattcatcactgcatctctggagccaagcctggaccataagagatgggtcatttgaagagctataggtcgtagctcttttcatggtcacttgttttcttcaggcctcctgacacccaataaatttattgtcatttataagcttgaaaacaataagtttaagcaataaaataaagtttgttagatggctgggcatggcgcatcatgcctgtaatcccagcactttgggtggccaagaccagaagatcacttgagcccaggagtttgagactaacctgggcaacatagcaagaccccatctccacaaaaacaaaaataaaaaataaagtttattagatatgcatttccatatcttctctctataaaattattaatggagttactataaataattttaatggactattatataaattaatacattgtcacttataacattgtagtttacatctctaaaagatagagatttaaagaaaatgaccataatgccattcttatacaataatttcttaatattctaaaatggtgcttagactttcctaattgtgtgtgtgtttttgaaaaagttggtttgtttgaagcaggttccagataaggtccataaatagtgattgactggtatgtctcgcttcacttttaatctatagatttccccaatttcttccttttttcttgcaaatctttttgaacacactgggtcatttgcttttacagtttcctgtaatctggattttactaattgaatctctgtggtgttgtttatcatgttcctctgtttcctgtatttcttgtaaatttggcaagactacattatcagtggtggtatctccttccacccagggttatatatgtctggtttgctctctttttgtgatatcatcatctgttgatctctgcctaactccattaattctttagggattgcaaatgttgtcattcttattctatcattcctatatcatttattagttagaatatacccacaacaggaaactcccctttattcaccaattttcaaaattcaccaatttttaccatgcctagcatcatccaaatgtgactgatgaatttatttaaagcatcattattcatttatggagtcaaacaaatttgatatgtttcaattcatccattacagttttatcctaatttgggatcaaattgtctgaccccaggaataagaactattcagtttctcctgaatctgtttgaaacactcttagtagtcatttaatttctttgcttcctggtgtgaccatttatttaagggggttggttctttttagtgggaaatagtatctagatccatcactggtgagtgaggaatactaattactactggattggttgtttctaggactttgcaggatacaaaattgggacatttaaagtattttcttttaagtataaattaagtcatacatttatgctggtatttccatttcaaaatcaggactagagttttacacaatctcatcaatttcctttttctcacatgataaaaatctggatctcaatgtcaccaacaccatttctcacttgctttatccacactactcacatgacagcctcagaaaagcaaaatcaccactaccaacaccaaagtgactggtaatcatttcagatttttttaaaaagatctttctgtcttttgggatgtataatgaaatcgctatgacataaaagttgctttgcagtttggagatttctgaaggaacttaaaatcgagctaccgtttgacccagcaatcccattagtggatatatacccaaaatcattctagcaaaaatacacctacactcgtatgtttatcacagcactatttacaacagcaaagacatggactcaacctaagtgcccagcaatggtgggctggataaagaaaatgtggtacatatacactatggaatactatgcagccatgaaaaagattgaaatcatgttctttgcagcaacatggatacagctggaggccattatcttgagcaaattaacgcaggaacagaaaaccaaatattgcatgttctcacttctaagtgggagccaaacactgggtactcatggacataaagatgggagcaatagatactggagactaccagagaggggagagagggaagggacaagggttgaaaaactacctattgggtactatgctcactatctggctgacaggatcatttataacccaaacctcagtgttacacaatatacctgtgtaacaaacctgcatgtgaacccccaaatctaaaataaaagttgaaattgtaataaaataaaccaaaagttgctttaaatagttcctccctgtgtgtttatgccatcaaccgatgtatatttaggattttttaaaaaatatttaggagttgtttaaagttaactttttaatatttatgcaacatgtttatatcattctaaatctctgagacaagatacagccaaagctcatagcttctatcattatctcattcactttgctgcatcatttttcctgtgggtaccagttaaccattctgtgtttgtgattggtgaactttgctgtattttaaaaatataaataaaagtgtgtatatattcatatcttcccttttctagaaaacagcatatactttctcacctcacttttgcatataataatatatcctgaaaatcactctatggttgtacatagaagagttgctcatttctttttagagttatgcgatattctttcatgcggctggaccacaacttatttactcagacaccaatggatagacttttgggttattccaggttgcttttcttttgctatgataaataatgctgcaaagagtagccttaggaataagtgtttttgtatttttggcaatccatcttaggggcagatttccagaagtggaccaaagagtaaatgcatatgtgattttgctatacatgttgtcaaattccctttcatagaagctgtaccttcttacattcccaccagcaatctctgcaagtgcctcattcttcacggtctctccaataaaattcattgccaacctgtgggctttttttccctctgtagagagaaatggcattttcatgtcgctttaattggcatttctcttactattagcgagaccagcatctttcttaagtttcagctctattttcagataagtgcattttaaaacaactcataagctatgcatcatcacttagccttaatttatgggttgtattttgtgatactgattaagtgcatttgagcagactattcagcagatccttgggggcactgatcaccaaatctgtctgaaggttctagaaatctcttctactttaggacagcacacttgagaagtagtattatgaggactgaggtttaaactctttggcatatctggggtatgtgattggaaatgggtctgaattggaatgttgccttaatgaacatgtgtatacagcttcactatttactcaaatgagaattctgtaccaacacaaaccagatacctcttcatcaagaacttaacccaattagggagtcctgtttagcaaaaagaaggactggggaaatggtttgcttaaaatagccttggagaaagaacacacttaaaggctgggttttcgcataggaaaaataagacagagaattgaagaatcaatgatatgcccctcatatttgctaaagagatgaaatagaatgaattcctgaagggcagggataaaatgaaaaaggactgatagaagaaaattactccatagaaacaaaaacaaactcaatggggaaaagtagaaagaggcaagagcaaaattcctatggactcctacaatctcaaagtctctggctgccatgagaccttcccagatctttgtaggtcatgtaatttttcacacttttctgacttattgataaggtcacccatttttgtactttcttgataacattcaatttaccaccttattgttcatatcctatctcttattactttctatttgtttcacttacatgaaaggctctccaagggttgaagagcccaagagattccaagctcctcaccctctggaagattagacatctacatagtttcttgactgagaaacaaatatggactagggagatactggttgaataaaagcatctcagaaaaaaaaaaaaaaagcctccaaagaagcttctcagaagaagcaatgggtgagatattgtaccctgaaaaacctgagaaggaatcattcatttgttctcttccatagtcagttccttagtagaccataatttccagtttgtttcactgttggatgaaagttacaaagaaagtgaaagttctgcaaagaaggagaagagagtagcaaaagaatgtaaaatgagtgttacacgaaaaaggcaacagatatatagttgtttcttttaaaggacataaaaatagagtgtcccaattgctgtcatcccctgcacttaaatttgaacatattctcctgccgcagaacaaaatacataatccagtgtgtttccctttgtgtctaagctgccagaaaaattggagcaaaattcatcaagaatttgtgtcaacttctcaatgtaatgcctagaagtttacattatttccagttcttaaaaatgctttgaccaggttcggtggctcacgcttgtaatctcagcactttgggaggctgaggtgggcagatcacttgaggtcaggagtttaagactagcctggccaacatggagaaaccctgtctctactaaaactacaaaaattagccgggtgtggtggcgggcgcctgtaatcccagcgactcaggtggttgaggcaggagaatcgcttgaaccgggaggcagaggttgcagtcagccaagatcacgacactgcactccagcctgggccacacagcaagactccgtctccctcccccaaacccaccaaaaaaaaaaaaaagtaaaaaaggttttcaactcgggaggctgaggtgggaggatcacttgagctcaggaggtcaaggctgcagtgagctgagattgcgccactatattccaggctgggcaacaaagcgagatgctgtaaaaaaaaaaaaaaaaaaaaaagctcttttctttatttttaagtgttttatccatgagccatagaaaatactacagatgtggttaaaaaaaaaacaagtatgcatacacaaactgctgtccaatatagaagaaggattttataaaaaggtcatccaaaactttgtctagtttagaagatcaaataaggagaaactggttcatgaaaataatgaaaagaattcactcaaaagaaaaaaaattccttcttgcccatgatcaaatgtggaaacgggggtgctgacacggacatccctgtctttgaaaacagcaaacttgagagattttataaattgtaagtgatctgtaaggctattctcttttataattattcaagatgagaatgcagaaataaacattcgggacaatggaggcattcacccatttattgagacggcaagactggaagatactccaaaaaatggtccatctagtcacctgaaatatattagagcagctttcttgctaacaaaacaaaacaaaacaaaacaaaacaaaacaaaaacctgtaaattccttgttatctgaaaaccactgcagaggcatttttcttctgccaccattgaaatgttttaatctgccaaacatacctcagaattctttcacaagcagttacttttttctttttaatggttatttaaattttttagttctgtgtattttattttattattattatttgttttagagatagcgtctccttctgtcacctaggctggagtgcagtggtgcagtcataggtcactgcagccttgaattcttgggctcaagctatcctgcctcagcctcccaagtatctgggactaaaggcatgctaaaaatttttaagaaatgtgagaaagtacacatatcataaaatttaccttctttatttttaagttcagtagtgtcaattacatttatgttgttgtacaagtaatcgcctaaacattttcatcttgcaaaacagaaattttgtatccgttaaacaattattccctctctaccctagcttagcccctgataactatcattctgctttctgtctctgcgaatttgactcttctaggaattcatgtaagtggaatcctacattatttccttttatgactggtttatttcacttagcataatgtcctccaggtgcacaggcaatattctaccctcgatttatttattctgctttttaaaatcatgagtctgtctatgccatgggtttccctgaggcatggatccactgagaatgatgaaataacatcccaagctgtgatttggctcaaggctttattgttgccattggacagttataaaatgcccagatgtttagctcaggaattacttcaccttacacagtcctctaccctgcagggatagctaagcttgcagcactatggttagggaaagatcaaagtacagaagtcattaagaatgaattttaataaaattaatccatcaattcactgtggattaattcatccacaatgaattcatacatataagaaatgtctatgaaacctacctactatgggcaatgcattacgtcatgtaccaaaaagaataagccatgatcctggcagggagaaatcttattgagagattaggtaaatatatttttgagtagcataagaggtggttacaggattttatgactaactgacaaactaatgacaaaaaattaagtggtgtgtgctgtggagggggaggacatcctgcagggcaggtggaggagggagtaggattcacccacagctcctaatccattgtagatactccatgattatggaaggaaggaaggaaggaaggaagggagggagaggaggggaggggaggggaggggaggaaggcagggaaggaagggagggaaggaagggtgggagggagggagggaaaaagacaaacagaatgatgaaatagctttatggcccagggaatagagtgagcaaatgcttggtgttgagaaaatgcacaattaatttgagaaacggtgagcagactcatttgtcagaaggaagggtagaaacacagaaagatgttggtaagggggccagccatggaatgtggcccagctggggagggcccagagcagtcaagtccatgtttgaatttaattctctaagtaattaggagctgtgtagatcagtgagcagcagtaacatgattaatgtggcattttaggaggattaatctggcaggtgtgcctgatggaggagcacagaggagagggtagaagacgagagagcagtttgcggcggtctcgatgtggttgtgtctattttcttgcaatttatttcaaaagaataaaatagctttcaagagataacaatagctccaccaggacctcacccatcttcacactgggctttgcttataggagggaatgattaaactttcttcctttttttgagatggagtctcactctgtagcccaggctggactgtagtggcgccatcttggctcactgtaacgtctgcctcccaggttcaagtgattctcctgcctcagcctccagagtagctgggattataggtgtctgccaccacatctggctaatttttgtggttttggtacggacggggtttcatcatgttggccaggccggtcttgaactcctgacctcaggtgatccgccttcctcggcctctcaaagtgctgggattacaggcatgagccactgtgcccggccccctgattaaactttttttctttccaaattcaaaaggaaactatgcttccaactcccccttccctcaatgtgtgtaattattacaattacagtgacagacaaagaggttattaaataatggctcggtgtaagtgtgggttaagagtgaaacactcactgagagggcagtcctgagcagcctggaggagaaggagcttggggacctagtacaggttcggactggaatcccctacagagttgtattctgtggacttaggagaaaaccagctcaaagaatcctgcctggtgtgctgattttcatttcatttgtcatcattattattgtattttcaaaaatagatatacatagatacatcgtttaaaagttatacagttgactcttgaacaatgcggttgagctgccagggtccacttacacgtgaattttcttctgcctctgccatttctgagacagcaaaaccaacctctcctcttcctcctcagcccacccaacgtgaagatgagtaggataaaggcctttatgatgatccagacccacttccacctaatgagtagaaaatatattttcttccttgcaattttcttagcaacattttcttttctctagcttactttattgtgaggataaagtatagaatgcatagaacatacaaaatatgtgttaagtggctgtatgtgttattgataaggcttctggtgaagatcaacagtagactattagtagttaaattctgggggactcagaagttatacctagatttctgactgaaaggggtatcaatgcccctaacccctatgttgttcaaggatccactgtacataaaaaagccattttcagaaattatttgttgcttatttcttcaagttatccaaatcgaaggctatttagtaacactctaattggtcaaaggctattgtaaagccctatttggaaatgcatgagtgtgcgcgcgcgtgtgtgcgtgtgtgtgtgtgctgccattgttctcttcttcctcttctttctcctccttctcctccagcaggttcctattattgaaaagcacacctttatctgtacctgaataatctgggagtcacatctccgagcctctgctgctctgcatcccacctcacccccagcccatcctatcgccaaggatgcgagagctactgtgagtcggccagactccagcagggcatagccttggcctgcagtctcagtagggggtgccttcaaaggctcaagcacacgtacttgtgggtatggctgcttttggaaattttgtcttctccctgtggcttctctgaaaggtcactcactgccgactgtgtgcgccagcaaaagttctgggaagatggcttgggctagtttcctgcagacttgggtggattcattcccaattccttttggttattttcctcaggctctcttctttgtgagtaagctctggcctttccaccagccaggtcctacttcggagacacaggtagggcttaaggagcctcatttgagccagctggggtcccagggctcacttccattgatttcaaaaaccccaggaagagccagcggaaagggcatatacccatgctccaaagcttctgtccatcatttggaagatggttcttcaagtcttcacttggaatggatttattcctatttttagccataattctaataagcccatttttccgtttcctcaattctcattcatttaccacctgtaatgtaggagaggaagacccaaaaagagcagaaaggaatgaccactgcaaatttgacaatgagggaggggcgtggaggaagactcaatgcagagatggcggccagagaatcactccctaaaaccccagctatcagatgaaagagagaatggcccaatgcctctttggggtcagctgacatttttttggagaaatttgagaggtaccaaacagggaagaaatctgggtgtctaggcttaagcccctttcagagagtttcagaatcctgcagatccgctggtaggcatctcagcctgcaaaatcccatttaagctactgggattagcacatgctgaggggttcagcactggatccatgccggccctctgcatactgaatgccaaagagcaagttgtgagtggatgtgggagaaggtactgaagtactgtaggaggagaaagaatgggatagaaagagtgggcacacagtgacataagacatgactgcctacctgctacccatacactcactcccccacccaccaagcaagcctcttagaccacctaggatattccagagactgtgctgtgttctaaggagaccaaatgagagcctgtcccctggaagcttgcagtctagagcaggtcaccttcaaaatccaatgtgtgttttatagtaacagcacacctcatttcagagtcactctgcaagtgacaatagacacctgtgctgatggctactgccttgcacgctgcaggtataggcaaatctggctattccttgatcacaactaatgcaaaagtcccaggccatctgtggttggcctcttatcacttatttcatagctctcacaaaatcacaaatatatacgaaaaataataattacttttccctagttagctatactatgactagtcttagagtcttcttcccagagatgaggatattgcttatataattgttctcctctcccttactcatagacattgataaagtttggatatttgtccccttttaatctcatgtggaaatgtgactcccagtgttggagggagggcctggtgggagatgtttggatcatgggaaaggatccttcatgagtggtttggtgctgtccttggggtaatgagtgagttctcgctcttagtttgcacaagaactggtggttaaaaagagcctggtacctccctccccgctctctcttgccatgtgacatccctgccccctctccatcttccaccatgattggaagcttcctgaggtctgcaccagaagcagatgccagtgccatggttcttgtctgcagaaccagaataagcctcctttcttataaattacccagcctcaggtatctcttcatagcaatgcaaatggactaagacagacatcaacttaaaactccactgagctccttggaagcccacacccttaactatcagcattgctggctgtatagcattctctgaaagaagcattgcccataataaacactcaataaatagctttcagtgaatggctgaagaagtagttggcaagcatcattttcaaggcactaggaaaacaggaccaatattcagaaacacatcagatcatgcgtgccttagttgtttttctcctcgggctattgcaccttctgtgcatgcaaatggaagggttggttatgaaaattgcatgccttgcatcattactctgttctattagaaaccagacccgaaagaaacacagggacatgtttcacttcagaaacgtgtgtagcatatgttaggaagccctggaaaccgccacgacagtttattgttcacctcggattcaagcgaagaatgcacactggtgggtggtttttgcatgttcattcctctgttaagatcacattgagcccattggaatgggtggattgaacagaaataatgcagtgttttatttcttgtgtattctaccttggctgaaagcagatacggagagttaccgccaacctttgcttgccttggggtccaccaagttctgatgctacaaatgaaaaaggcttgacagctgagatggccataggggtggaggaagccttacaatcacagggtctgggggctaaaaggagactcagtgggttacagaactcagcttcctcaccacggagagaccccatttatagcagctttaaaaacaagcagtaaacaaatgccatgttataaaaatacttgcccagtcccctggccctccataaataggacagtgaactcaaaccagcacctgacataatttatcttcacctgccataatttttccttgcttccagaagagaggaaatggctattggcctagcaaagctacaccatccaaagaagaggtatctaacttcctgttatgttacatctgtcttggtgctgaaatttacttgtgctttcttggtttgtttttggttaaaagcagggctctgtggccattgggagaatgtccctagcagacctcctgcagcagagctcatcactgattgagggcccagggctatgcattgaaatgcatctctgtgcttgcactgaggccctgcctcctgtgggctgttccatgtcagtgactgagtacagcagagatacctaaggtagctgattcctggaagacactggcatttcccctactaaaatccttgcatgaggaagtttgtcttggtgtcttcttggaggacccagactaacatggactctattccatgaatccagaagaaggcaagagtccatcacaaggcagagcctgaacagagcctagcatgtgacaggcactgaagaaatatttactgaatgaatgagagagcctccaacagctaatgaggtggccctagcaaggaggatggatctttttataaaattgtacaagcaacaacctgttggcctcccatcattgggaccagtgccctctacttctgagctagcaggagccccatttcctagaagttgataggggtttctcatgtcatggagatgcagactctgggtctctgagattctcacttagaatttagcagcctgcttcattgagctcagggttcccaaagcatcagacaatgagaagagaaaggaggccccaaccaaatggcagcattgctaggtgaaggctgaaggtcactagaagcaagataggctggtcacctgtgggagagagaaggtggaaggagggtggaaggagaatggaagtagagtttgaagagctggctacgttcattcattcagtcaatatttcttgtgtacctgtcacgtgctaggtgcctttcaggccgtgccttttgatggacttttgccttcttctgggtgagcagaaaggagtccttgtgagtgtaggtcctccaagaagaactgaattgcagcacaatttcaacatgggcaatatgggcacctatacttgcagagaggtgtttatctgtccctagaaagtaccctcgtgcctcatggggacacatttagggtcacctggaagcctaggaccattgtcttttcctggctacggaagtgtggccctgtttagaggatggggtgaggcctggatgccaaaattacccaagcagtcagcgcagaccctgccacatggtgatattttaaaagactgtgaaattgccaaagaatttaaactccaaacctccatatgagtttgaccaaacacctactaaactctaatctctggagctgaggcccaggaatctgaattttaacaagcaccttggagattctggcctctcaatgttgcctccactgccagagttaaagatgccatgcttggcaaccttaggtgagagagagccgttcttggtagcacactgaaaaggtgagaggtcacagagagtcttgggggacccagactctgtaaatttctgcagaaatttgatggaaggaacttcagtcactggccaaatagaatcagaaaccccaggatcttcttcccctgaatgcccagagtcttgacttacaaacttttgttttctggcacaggcattcagtggtgggactttgggcatcaattcctggctatattcggctgttctcacactgctaataaaggcatacctgaggctgggtaatttatgaagaaaagaggtttaatggactcacagttccacatggctatggaggcctcacaatcatggtggaagatgaaggaagagcaaagtcatgtcttacacagtggccggcaagagagcttgtgcaggggaactcccatttataaaaccatcagatatcatgagacttatttactacaacgagaacagtacgggggaaactgctcccatgattcaattacctccccttggccccacccttgacatgtggggattattacaattcaaggtgagatttgggtagggacccagccaaaccatatcactgactatataaccctgaatccccacaactctctggctctcttggaaattccatgacctcctgagtgacctaccttttaatgaatctccttcctgcacagccagccagatgtatttctccagggatgagctaagaaccccaacggcctgagtaggcctttgttggaggaggtcttagtttccaactgagcatgcagatcaaggaggtggccatgagtggtgccaaggaacacaagagtcacctgaaagcactcagggcaggccaagtgagccctcaatgcagagggtgatagacacagcagagggtgactcatttccgtccctgctggcacctgggctgcagcttctgtgaatgaagaggtgttagaacagcacctatcgggagcatccttaggccagaatgaagaggtgcaaagtgagcggttcatatgctcaaacaagccttaaaactacacctgcagtaacagaacctgttaccagcaggagacggaatggtggggccaaaccccaggtacctgaacgaggagaagggacagagtgaaatgccttgatgtgcagatataacgttccccttcctaagacgttcatctaggaatgaagcctgggctgctgatggtgatgtttgccgtaacacattggcagcatttggaagcagatcagggagcagtagtgaggttatcgcaacaccaagcttcaaatccacctgtcccttttgcatgcagaatgtcaggatctgtgattaatggaggcctgtagcccaacaaatgagaggaggtgtcattgtttgggctgctctctgctctgattaaataattaatcactccctaattatgaaagacaaaactttgcatcctgccccacagaccttccaagggacttatttggggagtaacaatttagaggagatgtgatttccagcttctcagaaagcccatggccaagcaaggctgagggaatatgtggaatgtgcatatccctctgttaggtaatgagttctccagggcagagcaggtgacagctgttccaggactataaaatatgggttaatttgaagcagcttgcaccttgattcttgcagacttacaaaggacactttagggaggaagttcaatgtcatctgctttttttttttttttttttcctgggcaactaggcatgaggatgacaggtaagtgtgtggacagagctatttgcatcttttcttgccaggatgggcctgacaatgggtccacttccttccatctcccaggagataggcaaatcatcaggaattatattcctttatacctccatcatccctgacaccaccattcggcctaccgacatctgtttcccaagccgagttcctccatccctttacgtacactgcttttttttttctgaagtcttgagccttcatatgtccctctgcctagtttatttctttcttaggtctaaactcagttcagtgtcacttccttcaggaagccttccttgagttccctgcctgatgccaataccctctcccatactcccagagcacttatgcaggttgcttccctctagatgccaagcttcttggtattttaagttcctccatacagcagctgttagcaaatgtttgctgaatgaataaatgaacacatggatgtataaatcaatcttattcactactcagtagattattaattcgttgaatgaataaatgaacaatgtgagctaaacgtttccagagaactatggtagagactggtggctgttccccaaaccttcttcctgagcatgcattttccacctttccttgcagttagtggagggtgagggggaaaacctgggatcacttctagttttttggggagcagagccctccctgctgctttgattttacgtgagtgagaaataaacatctatgacatgcagacactgagacccagggggcctgtctgttacagcagctactcttgccttaaccagcacacaacctgctagctgcaaagcctgtctcctggctgatgtcccttcacatggcactgaggtgtgggcatcttggctggctgtcagagagcagctttgctctcctccctgactggaaagcaatgggatttaagagcagttttctgggtgtgatcttaccctgctgtaacctagatcagtatgcctcaccctgtcatgtactttatccctgtaatgtacatatgaatcacctggggactttgctaaaacacagattctggccgggtgtggtggctcacacctgtaatcccagcactttgaaaggttgagttgggtggatcacctgaggtcaggagttcaagactggcctggccaacctggtgaaaccccgtctctagtaaacatacaaaagttagccgggcatggtggcgtgcacctgtagtcccagctacttggaaggcttagacaggagaattgcctgaacctgggaggcggagattgcagttagccaaggtcgcactactgcactccagcctgggcagcagagtgagactctgtctcaaaacagaacaaaaaacaaaaaaaccaaaacaaacaaaaaacacagattctgattcagtgggcccaaaatgggcctggaaattttgcatttctaacaagccaccaggtgatgctaatgttgcttattcacacaccacgctttgaggagtaagagtttaaaagaggggctatcagctacagtcacctgttacctggagtgaatgccactgagaggtgtgaaagggcaaagcaacatccctggagcaggtctcagaatcccagaaggctggtctcaaacaggtcgctccctcctcccctggaacttctgattttactggtcgggcctgaaaacctgcatctctcacaagcctaagagcatgtcgatgctagcattccagggactccttgctgaaaaccattggctttagggttgacagcgtgaacttgggggccattccggctggctttgaacctaggctttcccacctacaactctgaactctggaaactaacaagttacttacactcctcatgcctccattttctcattggttaaatggagaggatgctagtgatggtgttcacatgagaaggttgcagtaaggattatgccaagatatggaaagcctgtgtctggcacagaatggttttctactagcattagctagtgctgttacactattagaaagtgcacctgtagatgttagagagacttaggttctaactttagctcatcccctaacaacgctgtctctgagcaaattacctaacctctctaagctgcattgtctccatttgttaaatggaaatcaaagcctttgctttgtaaaggatgttgtggggattaaacgagaaaatgcatataaagcatcacataacacaaaagtagccattgctaaaatcaattacaacaagactgacttctggcagattgacatatgttcttgccctgccataaaaagccaccaagctcacaaggttttttttatacgtaaaaaacgtttttaattgacaaataattgtacatactcatggggtgtgtattagtctagtctcgcattgctataaagaaatacctgagattgggtaatttataaagaaaagaggtttaattgcttcctgggtctgcaggctgtgcaggaaacataatgctggcatctgcttggcttctggggaggcctcaggaaacttacaatcacggcagaatgtgaagcggggagcaggcatatcacacgggtagagaaggagcaagtggggtggggggtaggggagggctgctacacacttttaaatgattagttctcgcgagacctcacttactatcatgaccaaggtggatggtgctaaaccattcatgagaaaccaccctcatgaacaaatcacctcccaccaggacccacctgcaacattggggattgcaactgaacacaggatttgggtggggacacagatccaaaccatttcagggtttatagcgatgtttcaatacatatactgtatagtgatgagatggggataattaacatatccatcatctcaaacatttatcatttccttgtgttgggaacattcagtatcttccttctagccatttgaaactgtttaatatattgttgctaactatcatcatcctacagtggtatagaacactgatacttatttgatgattatagaagctggggaatgaatataaggaacttcattatactattctatttttgaatatatttggaaatttcaatattaaaaaaccttttaaactatttgcaaaaaaaacaaaaaaacaaaaaacaaaacaaaactaaaaccaccgaggctgcatgacccttgcaagttgctgaggtaggcagtcagctggagcgaaactgttgcaacatttcttgtatattgagaggccgcgagtttgagccactcctgttagttcgaaccagtcctgttcccaagactccctgcaggcacaggcttggccatcattccagctctgccccagcagtattccttcatgccagcatctttgggtttctggatgaagttttcagcaactgcataaaattccatttctcttgccagctgggcaagagatagcttcatgaaaacaaagccagaatacatggggccagaaaactcctagccttcttcctgcataggaaaactggatttctctagaaggctcaagctcctgggtagagctcctgggccacttaattgggcagtcccccatctttgtttctggtagtgaaggggcccaggttggtctcctttctaagtctctatacacaaagcccttcttcagtggaaaagtcttgacatatactagaagtctcattcacctttcagagccttcaagaatcctgatgtgctttgactcctgttcctgggagaggccacagaactgttctggagctgaagttcaagttcaaatatccatcactgttactaagcctttacatagcatgttatttgtttccagcgggctccgtggtcacttaagcttgcttgtatctatctaaatggagtgtttttcaccctcatttaggtaacgtcttgcacctttcatactgagattggccattttatttgcaactcattctgcaacccatttgctcctccaatgtcccttataaggatgcagaggattccgtaaaatgccacagagacctgcgtttagggcaaatatttgatcaaaagtccaccaactcacatgagtaacacttctggcaacctgtgcaatgctggtacaaagtaaatgaaactgtcctgagcaggtgttacaaatgccctccctgagagtctccagggcctctttattcaagcacagcagtgtggtccaaccagatcagagtcaggagacacaagttttaattccagctttctcaaaatctccttttgtgagcttagacataattacagcacctgggtactaaacacctctgttccaggtgccatgatcattgcctgagttgtaattctcgcagcagccctgcaggatacctgctattacccccatttcacagataagcaaactgaagctcagacgaatttaagtgggccggacacggtgcctcatgcctgtaatcctagcactttgggaggccgaagcgggtggatcacctgaggtcaggagttcgagaccagcctggccaatatggtgaaacctcatctctactataaatacaaaaattagccgggcatggtggtgggcacctgtaatctcagctactcagaaggctgaggcaggagaatctcgtgaacccaggaggcggaggttgcagtgagccgagatcatgccactgcattccagcctgggtgacagggcaagactttgtctcaactacaacaacaacaacaacaacaaaacaaaacaaaaataagaatataagtggctcaatctgtaacaagtggtacaatcaagattgcaacccaggggtgactgatcaccaaacgggattgtatccagcactgcattacctttcctggcctcatttttctcacctgtaaaaaggcatgtttagagtgtgtgtaatttttcacctctagctgagcccttccttggtgacccatgataacacccatgagcaactacatatggttacagacagcatttggagaaggacagaaagacagaagatagtgcttcctttgacaacgtcaatttttcagtgcatgaagccctgtgtagtgctgttttctagcttcccctttacaaatgaggtcgacgaaagtaaagttaatgaagcaactcagctatcaccggaatgcagcagaagtaatcaagtccaggactaagggacagttgccatgacatcccaacgcatgcaccatgatcaccgtcgatgactatgctcttctctgattgatggcagcttgcctctctgttcttgtaagcaaatgtgataacaatattaaacaattacaagtagtgtccccagctgcttctccactgcctttgaaatattattttagatctgccaaaataattgcaaacccattaacatggaagggggtgcgtgtatccctgccctcctgagtagtacattcacccaaagacaacaggatgacaagcctccttccaggacattcagagacacagtcaccctgccaagcagactgagacttgcaaaggtccaataccctttttaagaagcttgctggatgacctctttaaacataccagcatgaagaagaggaacaatctgggtgagaggggcgttttgcctgctctaaggttagaatgcaacttgttcaccaaagtgtggttatctgacctccacaatgctggagcccagctaaatcctgcaaatgtgtatctaccactgactatggaaaaaacaataatgtgctgtggggaatccagtctctctctctctcacacacagacacacacacacacacacgtgcacactcatgcgcacgcgcacacatacacggctcctgctatctcggaacttccaggctgataaggagaaagtgcaagcattagtaggtaagtctgctaccaggaggaatgtgattaaaaacaaaacaaaacaaaacagaacaaaacaaaacaaaacaaaaacagggtacaacacagtatgatagaagcaaacaaaaggctgagatgagctctaactccactttatttactaaaccgatgataaaacagtgtatgaaagacttgcctggatgaatctcattttttccagtgttttctatcacagtggttggaacttccatccatccgtccaaccatacaattgtccaaaaggaaaaattagggttttctctaagatcatcttctctcttatcccttatgtcctcacccatcacaaaaccttgcccactttttttttttttttttttgagatggagtctcattctgttgcccaggctggagtgcagtggtgcgatcttggctcagtgcaacctctgcctcaagggttcaagcaattctcttccctcagccttccgaatagctgggactacaggcgtgctccatgacacccagctaatttttgtatttttagtagagacggggtttcatcctgttggccaggattgtcttgatctcttgaccttgtgatccacctgcctcagcctcctaaagttctgggattacaggcgtgagccaccgtgcccggcctgccttgcccacttttacctactcagtttctctccagtccctccgctttctccataggcactagcaataccttggctacacgatgaccaccagcagcagctggggaaaccagcaccctgctaacctccaagcaccttctcccatctgcatagaatacgtcttccctttagttagcttgggtaacctcagattctggaccacccctgggctgatagcaatttctagtgaaatgcctcaaggtagaagtataatctgaatcaccttgcagagaggattgggtggctatctgaacaaaatgtgggtcttataggaaggataaaggagaatacttcttggggagaagaaatcaataggaatgtgcctcagggaaaaaatgtgtaccagaggagaatgaatcgtaatgagtcatttgcaatatggcatgtttattgtggctcgggttccttggccctgcacagagctgtcattcactcacttgacaaatatttgagtggcagactctagggtcacaacagtgagcaagaatgcacagttcctgcccttatggagcttagagtctaatagggagggctgacattaactgcagcatcatgtaataagggaaactgcagcaaacccaggtgtgatccaagagctgggaaaatggactgaccacaggagggaggcaggaaagtctgcccctgggaagtgttacctgaactgaaatcagggaggaaattaggcaaaggctcagcattcaggtggaggtggaagctggcccgtgaggagggtggcctggagaggttggaaaacacccaggtccttggagctcttgctgagctgctgaattagccagtgctggctctcacctgacctctgctcttcttgttttgcaaggtcgtacattttcttttgtgaaaactagtttgagttggggtttgttagtgttctgagtccccgtcctgcgaggtagacaggaggccttgctgtactctggagaagcgaaagatggagaaggtttttagggcctggagaagaggccctttaagggagcattgaataagatggcactacagctagacggcccagattcacttcctggctttctgtcttgtctctgtgcctcagttttcccatctgaaaaatagaataatgatagtgtctgcctgtgcccgtaagacccttcactgtgggaatggctatcttttttgccttttcactcacagctctgttcctgactatatccccactgaaccactcattaacgtttaaaatgggcatgttttctctgcaagattttgctaaaggtatttccctcctcaaaatacctttggtccatctcctcctcttggaatccatccttcagaaatcagttcaaattccatcactctgaagccttcctaaattatccccagcctcttttatggtttgagccattttccccatatttatattttgctttctttctttctttctttctttctttctttctttctttctttctttctttctttctttctttctttctttccttctctctctctctctctctctttctttctttcttccttccttccttccttccttcctttctttccctctttctttctttctttctttctttctttctttctttctttctttctttctttctttcttttcttttcttttcttgagacagggtctcactctgccactcagactggagtgcagtggtgtaatctcagctcactgcaacatccacttccgggcctcaagcaatcttcccacctcagcctgctgagtagctgggattacaggtgcatgctaccaaacctggctaatttttatttattttgtaaagatagggtttcaccattttgcccaggttggtcgcaaactcccgggctcaagtgatctgtgcacctcagccccacaaagtgctgggattagaggcatgagccaccccgcccagcatattttgctttctggttacataaaattataagtacacatggtctccccttccactcaaatgtgaagttattgagggcaagccctattagcatagccatatttcaagagtcctgggcgctcaaatctgatgcaaaatttgccatgcttttcctgtgacgatacaataaattggcttgtttgtgcatggatttacatatcatacctgagcaaatctaagatctaagattttctgcctcccaactcagcgggccgtatgttactgcaggcaagactcctagttttgtaatgagaaaatgcacgtggtaacatcttgtaggttgcaaagcaccacatgcatattaaataccttcatctttaccaccaccattatcatcatcactgtcagacccgacaccactttcagcatggcctcagcactcctttaacctcacttccttccatctgccctacactctcacccctgagttgtgacagtcagacgaagtaaagaacctgaaaaaatgctgggtgcacggatgcatggatgggtgcctggatggaaggcacgctggtcctggagacagactcaactatgtatgatgtgttttgttttctagctgagaaaataagcttcccttgcaagcttatgcaaattcacatagcaacagtgcaggtgtggcccccccaataccctatttcctcttcccttctcaaaatcttctccaaacccatgacttgcctgatgagaatcaacctttccatgaacagtggcttccatctcaatagcctctaatcattctgtctttcccctccactgtgaacgatagtgaagtaccttattaccgtatatctagttagcaattcaaggaaccaaggcacagagacattttttttctttattcattagaaaaacaatgaaacaaaaaaatcgctctgagagcctcaggggttgcaatcactaataatttaaaacaacacaattatgattcatatatatatatatatatatatatatatatatatataaaaaatatgagctgtagaacatacttagaaacattgatttagaaacgagcttaagatcacagatcacagagagggtcaataccagggtagcacccaggacagaagcctgactttagacaatgccctgctaggaaaaaaaacctccaggtggctcatctgctgggtgggaggcccgcccctggaaacagaggtatcaagagaccatcactctgggaacaaaggtcattctaacatgcctgtcagtggagtcttgcatgggtcgccttgggtaattagttctgtgtgctattttgctgggtttatgtattcctattccttcatctttcaggactcctgggaaatatctgaaatataagacaggaactctgacctttgggtggtattaatagctttaattaacactcaacaatgagaagtcagtggttgatatttgaaactggcaaacttccttgcctgcaagctgccagattttccatctgtgggcacctggcacctggctttccatggctggagctggggcgagatgttccattccctcttccctgtggtggccctcttggttgtcttgctatggttccaggcttgttctcactccctgcctcccaggctgtgatctgtcactgtattctggctgccgcagcgcttgcgggcctgctttgctctccagcccaaggttcccagcctcctgagtccctggtgatgttcatggatggagggaacccacagataccttccattcttctctttgctttagccagataccttttgccctccatcaaaccagagactccttcctccatgacactggccacagtaaatattctttttaaattttttattatttttaaaaactaatttgttaattttttgtacagatggtctcactctgttgcccaggctggagtgcagtggtgtgatcatagctcactgtaatcttgatctcctgggctcaagtgatcctcccacctccacctcccaagtagctgggactgcaggtgcatgccacaatgtcaggctaattaaaaattttttatgtagagatgaagtcttgctatgatgcccaggctcctggccataaacaatcctcgcaccccggcctaccaaagtgctgggattacaggcacgagccatcagacccagcccatagtaaacatttttaagtttcttctttaggatttgttggcatgtttggtgtgtaaaaagcagtccccggtgatattggtaagcgcagactgacacatggctggtagtttcttattcaaatttgaaaaacgatgtgatgatcatcgtacctaaaaactgtacataagccgtacaagctaagcataggcattgctccctatctgcgtgcctatatcggtaaatacgagtatatttatttgacatagggaataaggcgtttacatttatctcaaaactccgtagcccctggctcttactaggcccaagctgtttggcttgggattaagcctccacacaatttaaaaattctccaaagtgagattcaaattgtagcccaagtcagagctcaaacttcagtctgagtttaatgcaccatggtggaaacttagtatccttggtttgcatgcctgacaccaggaggagaaagcaaggactattgttctttcagaaaaggttagcagtgtggaattcccaggtaacacctccatgttcttctataattggccctgttacaccgtaagctcccagttgcagcatttgtagtagagaatgtaaccacacaaatccccaaattatacttttgctagagaaaaggaaacaatgaagcacagagttcacaaatctctcctctaacgacaacacatctaaaagtacaaggatgggcaaaaccaccagcaagaagagaggctcaggcgatgcagaagcttcatttgttgagggaggaactctagaatgaacagaagatggcagagtagaagcaaagccaaccttccggctgctttagctccttagcccaactcactgtgccccccccggccgccctgttgtctctaggtgctgagtcactttggttcaatacccagcctcgaagatgaagtccagttacgtgtgactgttctggagactgtcgggaaagacacagattccaaacatgaacaacacagacagcataacttagttaagtgcctgtggctccatgatgtgactgccccaactcccatgacaaatgtcaggcttccatgtgaggcttctgatccacttgtcagttgattaagagatatttgggcatagacaaaaacatattttaaaatcttgactcaggaaacagaggcaaacaagataccacgccacgagatgaataaggtcattttctgtactctgctgactcaagacgtctggcccttcctctccttccgctcccgctagaagctgtcctagctgggagctggactgttgaaatcatgcacctctggccttttcttataatcacacaaggacctcttcatcctgatcaaaacacctgcacctccatcgccctgaccgaagacccctgctttgttcacagttactctttggtctacagtcatgccggcaatttctaatttcttatccctgaccaaaaggcataaaattcaaacataaggccaggtgcagtctgtaatcccagcacttcgggaggccaagacgggcaaattactggaggtcaggagatcaagaccagcctggccaacatggtgaaaccccatctccactaaaaatacaaaaattagctgggcgtggtggcacttgctgctgtagtcccagctacttgggaggctgaggcaggagaatcgcttgagtctgggaggaggaggttgcagtgagccgagatcatgcctcagtactccagcctgggtgacagagctagactacttctcaaaaaacaaaaacaaaccgaaaaccaaaaatcttaaacatccaatcgtgggagctcccagagccacagttttctccccaagttgtctaacaaccagaatgagaagtattgagggaaaaagagggcagagcaaatgtggagaggggaggctgcctggggtctcctgggagcagacagcaagctgtattccccttttaatgtccacgactgaagaggttgttatcaatctggctggcccctctttgttccccacgtgtacctgggaaagtgatgtgactctcatgatggaaaggggaggaggaggagagcagagacagtagatctggagtattccccaccacctcccattcctcctctttgaatcctctcatttgatgttgggagttttatttgcacatggcaggtgagcagcccagggctgtctgggaagttgaggatcaggacacatcatggccactgtggggctcccacgcaggcccagctgccagagggcctgctggtgggaagctctgccctctgggagtcacacacgatgaatggagagaaactattttatcctgccttaagcatggtatgccccagggtgatctactcaatgggagtgtatttcaagcagattcagcaacaatatttcctggtgccattagaattctaaagacaaggcagccatcctggttctctgttttacgaagaggtaatcctattttatcctcatgccatcatcagtaagatcagaataaggataatatcagtgaagtaagagtaagttagttttttaccaaacttcaggaatatttgattcaagatttcatggcagaaggaagtgcatttttgataaaaatgatttcaatttagcacatgatgaggtgaatgaagttgaattagcaggattagatgacattttgctaaagagcacttgagacactgctatttgggtcgtgaggccttcaagaaaataccactttgttaaagcctgaaggctttaaatataaagctggtatcaagtaaataatgaaacagtttgcttttaagcaccaaagcgatgttgagaatgtattaggttggtgaaaaagtaccaaaataattacttttacaccaacctaatagtcattctggtgtctggccatatgttttgaaggcatttgtgggtcccttatgcatgacagcaccctctctagatgcttgggcatctcaacaagaagcaggactacacccacttggccaccatggggagggcttgatggccatggctggtgacagtctgagcctgcaggacctcagagttctagcagctgctgagtctgggctgccaacacactcatcctttgctggctggaggaggaaggaccaagctcccttagagaaccattctgttccctgttctcactcccatgtgctatatcctgtgtggagagggaggagtaatcaaccttcactaccctttttgtctagaatctgcctgtttcttctccacaaagacttggagaaccatatcttatgagtctgtattccctgagtaaaagcccatcatttcgaggacaaggggccaacctctaactccacctctggaatgaaaagttagtctcacctatgatgaattcagatgggaaaatagagtttgctgggggcatgtggtgatggacaggaagatggggaaataaggtgaagttagaagaacttgtttcttggtatctgattggagtctatcttgtgaagcctctgagtctcggccaggctgggttctcctctttgctttaactgctagaaaatatagagccatatctgtgatttaccttttgataatttctacaaggtttctggtaaatagtcttgtggactgactttatcttgggcttcattttaccattttctctttgtctttttttgtttattcccattctgctgtatagcatatgttttgtaacatgtcttgaaatctttttggaatgagaattggaaagaatggatggatggatggatggatggatggatggatggataggtagataaatgggtgaatgggtgaatgggtggatagatgtatggctagatgagtggatgaattgatgaatggatgggtagatggatggatggataaatgggtgaatgggtggatggatggatggatgggggataggtggatgaatggatagatatgtggatggatgggagataagcacatgaatggatagatatgtggatatatggggggatgaattgttggagggatggagggatgggtgaaaagatggagggattggtgaaaaaaatgggtggatggatgggtaggtgggtagatggatggatgggtagatggatggataaatgagggatggatgaatgggtgaatgggtggatggacggatgagttgatagatgggggtacaaatgaatggatggatgggtgggtcaatagatgggtggatggatggatgggtggataagtggatgggtgagtggatggatagaaagtcatagagacaaagataaatgaagttgggaggtgtggagacccaaggagtgattggaaaatcatgaaacaccattgtctggctgttgacaagtgtgacaaaagaaaaacagaagacttaccaaagataaagactcaaccaaggttaaaaacacatgaccacaaaccctgttacagttgacatcagaataaaatgcccttctcaattacataaaagggaaattgaagagatgttgagggactaattttttttgaggactagaggttgcacatgtaacctacaattctatttccataattgtttcatgaagaaatattttaaaagtaagaaaacaagcattctgtccatcagcagtattgaactggaaattctcctttcagattcactttttcaagttttcagagtgttaaagcaaacttaatatggcctgagaaagaactccatacttctatatttgagtccttgtggatgaactgtaacctagcttaatagtcaaacaagattgaaaacctaacttaggagtatgtgcctgtaacaatagctgagtcttgaccaatcccagcagccctacttcaaccactcgttgactgctaagtgtccaaactgtgttcaaataaggcaaacaccatcctgtaaccaatccagctgtttccataccttactgccagtttctgtacatcatttcccttttctgtctataaatcttcttccaccatgtggctgcgttggagtctctgtgaatctgctgtgattctgggggctgcctgattcacaaattattcattgctcaattaaactcctttaaatttaattcagctgaagtttttctgttatcaagaggcataggggttcacagatgaactctcacaaagacatgaggaagattcaggtttgtgcaagcacagaaaaacatatatgactatgaagatatatcacagatgcaaaggggaacaccagatgatactttctatgaaaatatttatcaaaaaccaaattaaactatgatgcctgattccacttatggaatataaagtgctttattttattttgcgggatctacttcccgcaaatagaacattggactgaatacaatggtcatggaaaatatagaaattattcctggtattaggagaaactgtatattctaacaatcgcacaaataaagatgctatattgaaatgcatgttcaacttattctaaacataccgtggttccccctgacactgaatgttgcttgtcaccaaggttggccctgactctctggctgccatgtctagccaggccgtttaaggttttcctatcatcttgttaattaatccctaggaaccagtaggttccaagtgctcataattcgtgttatgcattttacaggaatgagacagtgagagaaactcaggtgccaccactggggtaagtgagaggaaaataaatctcgggaccccataatcaataagccaaagcgaaaagtcaggctgtgaactgcatcagacaaacctgcctcccagtttactcctaaatatgacaactacaaagataaaaaggctacatacctccctcgcaatttgcccacaagaaaattccttgtggaccttgagatgttaaccccaaaacagttctgttgaatttcacccttgaaatgtaaatggtagcttatcttcacagggacagaaagttatccctctgctcacctgagacaaatacatgtctgatggcttcctctgccctattgcttatgtaaaaatgcagatttactgagccagactgaggcataagtgactattcctctaccccccaaccccactcgtctcatatgtaaactgtgtactcagtgcaaggctgatcaaagacccaaaagaatgccatcatttgtctcttatctacctatgacctggaacctacccccacccctgcccatccccacccgcttccagttgtctcgcctttcctggctgaaccaatgtacatcaatgtacatcttatacatattgattaatgtctcttgtcttccttaaatgcataaaagcaagctgtaccccgaccaccttgggcacatgtcatcaggacctcctgaggttgtatcacagctgcgtttttaaccttgacaaaataaacctaaatggactgagacctgtctcaaatacttttgatttcacaggtaattaacgccaaattgtggtatacctcctgtggatacacatttttgtccatgtcatactgccaggtaactttctgatgattcatatcactcacctgctccccatcaattattgtcgtttgctgattattcccattcaacaagagccctgccatgaggcaaagccaacaagagtcctgctttcctgatctctggtgatccagcagacatgagcaaatgttcataaggcctcgcctccacaggagtctcctcacttcagctttgcctcccttccactggaaagggatgcatataatttagacctttattcattaaaaatcatcttcctctgtgggaataactcccccttgcccagtggaaggatgcatcctgactctgaaacaagatttgcagtctacacacaagcacatagagctatttgatctgtgcttttaattctgcctggcaatgtgtgtgttttgaagctaagagtgataaaaatgtgctgcatttgactgaaagaaagctttgagttgatttggtgtcttcctctctttcttcctctcccattgagattcccatcctttgaattttgccttctgacttgaatgctatcagcacatactgatttcaacatcaagtaattgttggctaatatgagtgaagtgattgaagttgagtagagaaggtagagaggcatgatgaaaattcatgctacgtagcccaggaaaacctgttcttggtgaatgtaaacacctcccccaccccagtttccttgagtggatctctctcttgttcataccccgcaaccatctctcttcattagccatcaattgcatatatgtttttcccacctgttaatatgcaatggcactccctgccctcctttgctacgcactaatttaattttaattctagctaaaagcattttttttccttgcctctcctctttccccttctctctttcttttactttcatgagatgagattatgtaagcccccagtgctttttctctgtgaagcattttggagatgagcaacccaacatactttgaacagagctgctctgcaatcaccctgccaataagcaagtgtgtgcctgcccttcacaataagaaggcagttgttagatacaaagaccaccttggcatcccattaggtaagcaaatggggccaaagtgcttagaacatctttacctaaaaggaatggaaaatgggtcattgcattttctactagtgctggacctagaataaatcaagaataaacttgttcattcattcacaaacactgattaatcactttctatgtgcccggcccagtgtcaggtgttggtaacaccaaggtgaccaagacctgcctttgctctcaaggactcacaatatggcaggcaggaggaagcagctgagtcctactgggtccagctgacaaagcctctctacagcctcttcctacaaaaagataatgatctatttctagttatgaagtaaaggtttgatggcaatgatagcaaaataaataaattcaacctgctttactaacttcctaacgcgttgggataatagaccagtagaaaattgggggccaaaggccggacgcggtggctcacacctgtaatctcagcactttgggaggctgatgagggcagatcatgaggtcaagagattgagaccagcctggccaacatggtgaaacaccatctctgctaaaaatacaaaaattagccaggccgtggtggtgcgcgcctgtaatcccagctactcaggaggctgaggcaggagaattgcttgaacccaggaggtggaggttgcagtgagccgagatcgcaccactgcactccagcctgggcgacagacagactccatctaaaaaaaaaagaaaaaaagaaaaaaagaacagaaaattgggggccaagtaattttaacccactgctagcatcggtaatattcaggtagggcaactgctgagataagctgttaaaatacaggaacatttttctactgtttgtagatagccattgtccttgagccctgtgagtgtcctggtccccatagcctggaatgactggctacccctgccccttccctgggacctctggacctccaagtgatccatcatggctaggaatctcaatgatcttgctctaatgcaatgagtagcattctttctgagtggcaagtatctgtgtcctattgtttgttaacattttttgtaatcattcttgtttgtattgttactacataaaaatagcagaagcaggaagaaatgtgcatggggaatgaagccaattatttttttggaatttggcagtcaaatgatggttataacaatggtatgatgtcagagatataatggctatgaaataagaagtatcttatgaatataacttagtttacaatttctgtatttgagtcaactgtgtcattccactttttaaatggtccgtgctaaaggttgctgaagtcataagctaagcaaccttatgtccttatgtccttatctatattgaacatagaagttaataaatcctatcaaaaacatatttctttttttattatttattttttttaatttttttgagacagggtctcactctgtcaccaaggctggaatactgtggctcaaccatggctctctacaaccttgacttcctgggctcaggcaatcctcctacttcagcctcccaagtagctgggaccacaagtgcataccaccacactgggctaatttttttgtgatttgtagagatggggtcttgccatgttgcctgggctagtctggaatgcctgggctcaagcaatcctcccacttcagcctctcagactgttaagattacagacatgagtgacagaacctggccaaatatgtttcctataagacatattgttactcttgggcttccgggacagcagatttggttcaattatctttctagaaacccctctatgttaatctctatgaattttctacatataatttttttctttacctttgtgtatatccacacactactagacaatttagaaacactataactagaagatgggctttcacaaatgcattgtgtattttctttataattcacattaaatcatatacacgtaaattttgaaggctacctaaattcaagtctctaggatagcaggaggaaaatgcattttattgtacatattttattttattttattttgagatggaatctcactctgttacccaggctggagtgcactggcatgatctcggctcactgcaacctctccctcccaggttcaagcgattctcccacctcagcctcctgagtcgctgggactacaggcgcacaccaccacacctggctaatcttcgtattttttagcagagatggggtttcaccatgttgaccaggctggtcttgaactcctgacctcaagtgatccacctgccttggcctcccaaagtggtgggatcacagatgtgagccaccccccttggccggaaaatgcgttttaaacaaggatttcagtacctgccatatgtcaggaaatgtctcgaacgttttgtacacattattgaatactcacttccaacccgttgagatggtgttattttccctcatatcatttgggagggctttgaagatgtgagatgttaaatggtacacgacctttccacttaacctctgaggccgggcatcagccccttctccttgaaactcttcccccatttccttggtatcatgcctggttcttctccactcaatcattcatgtgcattctgaaatgttggtggctccaaagttttctccttagacctattctctttatggatccatcttccctctatatgcttgtaattcaaaatctatgggaatggagaggaatatccttcacatgtaggtatatatatatatctcacacctttgctccactcaacattttcaaatcccccatttgttacagaaaaggtctgaacttttcaggaaactagggagtttgtcaccacctctcccaaataaagcaggggctcagggagactgaagtctggcttgagagcctggattaggcaaagtggcagggaccggccagcaattgtagaaggacagcagagattcagccacagggaagtggcagtccaaccctagggacaccacccagggagctcagctgggaggtggagcacaggcctggtaagaggacagatgcccaggagagggaaggtttcaaggagaagcaggagatggagaatggacaagttcatcagcgtcagaggcagtagcaatctggtgctttatcgggtacctgtagccttggaaatgggtagagaaagggccttcgaagtctccactcagaagacacaaagcaaggcacaaatatctacagggcaccctggatgtgcccacaggatccaagtcgctgaggtattgccaaaatctcacaataggcatttttatcatcaattttacaggtcagaaaatgaggctctaacagcagggcacacaaccccttcaccatctgccggatgctatccatgcactctcacctcctgtgattccttgcccattgtatgattttatataggatgtatgtgacatcatgcaatgtcatgagacatcatgaaacatcatgtgacactctcgccccaggggacacatcctgaaacacactgagcacgtacatcacattgctccaccttctgcccctaaccccttctctacccctgccatacccccttcacctagtgagatcctatttctcctttaagcgacatctcagaggccttttcccctgtccttcgatgatcactccagcctcacccacttctcacttggggtgaaattaactgcatgtttccttgcactgcacctggtggttgcttccactttcttctctccagcacttctcaccatgcggtctttctgatttagagttagaggtgtacgtgtgcacatgtgtgtgtgtgcctgcttgtgtctgtgcatgtgtgtttcacccacaacattacagctgcttgtatctttggctcctctgatgcctggcgtagtgactgaattcaataaaggtcgatagcctaaaaaatctcgtttccctttaggcatccgaaaatgtgtatttgctctaacaggctatgttgccacaaagaaagattcatgagaaaggcagggtttgagtgactggttttgattaggatcaataatatatgacaaaactctaataaagatggagacattataagaaatagaaaaacatttttattttaaaaaaaaagctgctacaaacaaaaaagttttttttttgttgttttgtttttgctagaaagtcccagctttcttaattctctgaatatgcttcttctctgtcatgcaatcgtggttattcaatacatgtgcatcatttctatacatgttctggtgacagtctccaagttgttgagcacaggttttctaagtaaagcgcactgttctgctattaagggaaactgtcaggcaatttaagcagaaaatttgatctagtaaaatgctgacccttccaaagctgtaatctcatggtgactgcttcttaaagtctgactactgtcaaaaattcatcatatgccctaagagatttaagagaaacagaagcactgagctacgcttgcatcctgaattggaaatctggctctaagacatggatttgaaaagttagtgtacaataagcaactcaaagctaacgtttgaatcactattaccatccaggactttgtaacatggaagagaccttgaaaaattatataatccaatgcagtcatttatagatgagggaaactgagtccagatgggtaaagagaagtacttaaagccagatagtatttcaatgggtagaatgaaaacgcaagctttttagaatatctgaacttggatcttcccactacatttggctgcctacatttgttcacatactaaaaatggaatccaattaaaaaatgggcaaaggacttgaatagacatttctccaaagaagaaatatgaatggccaataaatacatggaaagatgctcaacatcactaatcattaggaaaatacaaatcaaaacaacagtgagatgccacctcacctcattaggatggctatgataaaaaaaataacaagtgttggcagggatgtggagaagttggaatccttgtacactgttggtggaatgcaacatggtgcagctgctgtggaaaacagtatggtggtttctcaaaaaaataaagagaattatatgattcagcaattccacttccgggcatgagccaaaagaactgaaagcaaggactcgaagagatagttgtacgtccatcattgcagcattatttgcaataaacaagaattggaagcagtccaagtatccaccaacagatgaacgaataaacaaaacatggtatatacatacaattaaatatcatctagccttaacaaggaaggaaatcctgagacaggctacacatgggtgaaacttggggacatcatgctaagtgaaataagctggtcacaaagggacaaatactatatgattcctcttaaataagtttactgttatagttacattcatagacacagcaagttgaatggtggttggggagatggaattgggaattcttatttaatagggacagagtttcagttttgctaaatggatggatggggtgatagcagcgcaacaatgcgaatgtatttaatgccactgaattatgcacttaagatggttacaatagttttttgttgttgttgttgttgttgtttctgagacaagagtcttgttctgtcgcccagggtggagtgcaatggtgcgatctgagctcattgcaacctccacctcgctggttcaggcaattctcctgcctcagcctccccagtatctgggattacaggtacccaccatcatgcctggctaacttttgtatgtttgtagagatggggtttcgttgaccaggctggtcttgaacttctgacctcaggtgatctgtgtgcctcagcctcccaaagtgctgagattacaggtataagccaccatgcctgaccaatggtaaattttatgttaaatatattttgtcacaattaaaatttttttacattgaaaaatggagcaaaatgttgaatatatgcaacttttccactgagctagtacaaaggggatgggaggttttaagagttagaataaaatgctcaaaccaaggagacgctaacatgtggggcagtgcacatgacgggaaggaatgctgtctacacgctcctgaggatgggtcggtgtcctccagattcctccccacctgtgggttgaccttcaaaactttttccttgaagtttcatttttctttttgacaggaggttgtgttaaaatgcaaatcagtgtcactcttgggagctgcagcagtcacattacctgagcctttaggaaccccttggagaactggttctgaggcaagaaagaggagaggggagtggaggagagaggaggggaccgaaaaaggaatctacgcatccgaagaattcttgcttgtttctctcactcctgtttgctgctgttgtttaaatctacagtgtggtcaggtgaatctttcaagcagtgcaagtaattatctttgctctgcatcgtatgcaggtttcattatacaaactgaaaattggaaaaccctgatgagtttctgcttgaaaccacctcactgacaatagggtgtcttagcagcccttttctacctactgtctgtggcactattctatgtgtgatcattgtctcagcacaatttgtgtcactcagaagggtgatctcatgctggggtgccatctgggagtttgttctggtagagatgggatagtcgtccaggagctggcaagagacacggtgatttcccaagccttgggccaaatagggagtagctttggaagcggaaacacctagatgccttcctatgatgcttggttctggggcaggtgatgaagagcagcagaggagagggtgaaaccgcagagaaggacttggggtcaagaggagttttggaggcagcaaggattggatttaggcaaagacgtggaaagaaactctcagctgagaggtccttagaaaccatctactgctgcttcttcatttgactgatgcctggtggaactgtgggtggttgattagattgtggtgggagcaaaaataaaggaagccaaagtcatttcaaggttttctgggtgacttggagaatggcattaccatgagcttacatagaaacagaatggcagaacaaacacaggcaggtgaggacacatgcggaggcatcaataatacccacaaggaaggtgacagcacacagcagaatcgctaagtaagcaagaaagccccaggaacctcgaattctattcctaactctgctgctgatttactgaatcactttggaagagtcacttaattaacctcccccagatcaaactcatctttctcttctccatatcaagataatgtatacaattaactaatacagatttttaaaacgagttctatttataggtcattaagagactcagtgtctcagaaccacgtctgagcgctgctctttaagagggctgtggacaatgaccagtgaccgcatatgtccagaagatagacccaggctgggggtgaatgggcgataatcacacatctattgttacggtgccaggctctgttttacatacacaaatgatttaaaaatcatgacaaggtgatttcgcagatattattactagtttagtataactagtttagtaatactatctgcaaaaattatattgactgttactggatatagaaaccgaggcacagagaggttaagcaacatgtcctgtgtcacacaactgatggctggcagaattaggatttgaacttgtgctgcctagacccagaagacaggatcttaatttctcactatgctgcctgagagagagagaaactgaccaaaaacactgggggcatgttcaccttctttataagcaaggatgtaaatctctgatccagggttgcaaccatttccatttagagtaacgtgcttattttgttctgaaatgatgataattaggaccagcggatcacaggcacttgaaggcagattccagatgaagcttaaaacattttcctaacaatatcacctagaaatgaaagaatcattgcaaacggcttagtggttaaaagctctgcccttcgctggctgtgtgaccttgaagaaattacttaacatctctgtggctcaatttcctcatctcttaatgaggagagtaaaaggactcttagagtcattgtaaggattaagaaagttgatacatgggaaatacttaaaaggtggctcatagtaagttacaacaaacatctgctcctgtcttcgtcatcatttctctactgcactgaatgtggcagctagattatgtgacaggaatgttacagggaaaaagtgattcctacaagacgtggaaaatagccaggatgtcctttttctcctaacagttgtgtgagttcagaaacattaaaataggatatgatgtgatatagtctgatacaatataattcaacacaacacaacacaacacaacatgacttaatgcactacacagcaaaataatatctagcattttgatcccctctctgttcatcttacaactgttgatccccatcctggctattatcgataaccaacacgtgaagggaaaactgatgcctattagaagagacatctgatgcctatagaatcatgaatctagagatttgccctcccagaactgcctgactttttactttcagaatccttacttatgacactaatgactcaacacggcactaagttccatggaatctagttctcagctcttgctccacctgtgccagactttctccaaggctagctgtcagcttgggggacagggacaaccatgaattaagtacctttgtctcaccaagagcacacagcactcaccaggcacatgagtcaactgatggactgaaaataaatatgcagttctgcacgtaatcagttgaggcaaatgacagagcaataactaaatgtaatgcttaattacagcaaatatcatcatctatttgcttcatttcctcctcacatttgcaattttctatttttgttttaataaatgtagatatgcatgtctttaagttgcttcaactcctttttggatgcaaggtataaattagaaataaacaaacaaatgccagacaggtaggttcattgaaagatggcctggatcttgcagatttggtagcctagggcatattatcttttcgaaaaggaacacattttccttttcttatgccaacctgcagtagaaggaaagctgatgagtcagatcaggtgagagtctaaaggtcagggagggggtcagacagttcagagccaaccctgatggtcattatattcctaagagtgggagagttgcctccagatgctggggccaaatggtatctgcaggccagagatactggtaatcagtggtccctgaccattttggcatcagggactggttttgtggaagatactttttccgtggactggggagaggggaatggtttcaggatgattcaagcacattacctttcttgtgggctttatttgtattattataatatgtaatgaaataattatacaactcgccataatgtagaatcagtgtgagctctgagcttgttttcctgcaactagattgtcttatctgggggtgatgggaaacagtggtggttcataaggcattagattctcataaggaacgtgcgacctagatccctggcatgtgcagttcacaacagggtctgcactcttatgagaatcgaatgccgctgctgatctgacaggaggtggagctcaggtggtaatgttcccttgcccgccactcacctcctgctgtgtggcctgtttcctaacaggccacggactggtactggtccacagcccaggggttagggacccctgctgtagagtgctgttgggtcagtgggccctggtaccacacactgcctagattcaaatcacagatcttccacttactatgtgatcttgggacagtcacttaatgtttctgtgcctctatttccttgtctataaaggagtagattatataaacaattcctacctcaaggtgttctaggataattcaattccagtaatattcttagatctctgtctgggacgataaactcagtaatattggccgttctcattcccttaagaggaaaaccctccattaatgtgtattgtgcaatttgtacaatgtcacgaggtgttggagaaaattcagacccaccaccaagcatttgatgtgcatccaccccctcttactattctggagtccacaagaggtagtctgatgttgaaaggaaataaaagtgttttaattatccccctttagtttccaggttaatgagctctatggagtttatatgtcgtgactgttttaatcttttttatagaaactatcattgcatctttcaacatggttgactaaaacagggccaccatcatctcaaccaggaacttgcctttgcaaacagtgaatgaacagagaagacattctcaaagggattaagaatcaagagaaaaacccttttggttgttgtttaagaaacaatgagaatggccgggtgcgctggctcacgcctgtaatcccagcactttgggaggctgaggtgggtggaccacaaggtcaggagttcgagaccagcctggccaacatggtgaaaccctgtttctactaaaaatacaaaaaattagccaggcatggtggcatgtgcctgtaatcccagctactcaggaggctgagcaggagaatcccttgaacccaggaggtggaggttgcagtaagccgagattgcgccactgcactccagcctaggtgacagagcgagactctgtctcaaaaaaaaaaaaaagaaaagaaacaatgagaataatctcctccaccctgtttccaggaggacttacacacctagaaacatttagctttaagatcttgggcaagaccgtctagtgttaatgtgatttgtaggatattaggggtttacgctaggattttacttcctgcatacatacccagacaaatatggatgctcacacacttgtaattagaaatgagctataatatgcacatcactgaaaacaaacctaatttacacaccagagcacagaaataacaaaatattgataaggatgtttctaggaacccataaacatcatgaatgagccagatccaagttcttaaaactttctgggctgtacctatttacagtccaaatacatactttcatagaccattgtttttatagaaaacccatgctatgtaagtatttccatgaaaaataagttttaagattcatcaggcaaccatatgtctcctttaatatgcctaatatttaaatattagttataatggagacacagaaatacgtagtaagattgatgaaaacgtcttttaaatactccctgctcatcttttatttatgtatttatttttagagacagggtcccaccttgtcacccaggctggagtgcagtggcatgatcatagctcactgtggtcttaaactcctgggctcaagtgatccacctgcctcagcctccaaagtagctggaactagaggtattgccaccatgcctgggtagtttttgtattttttgtagagatggggtcccactctgtcatccaggctggagtacagtggtgccatcatagctcactgcagcctggaactcctgggttcaagtgatcctcctgcctcagcctcccaaagcactggaattacagacatgagccgccacacctggcaactgcttgtcattttaaacacattgttgattcatcagtccatcaacaccatatttcccaccctcaggaaaggtgggagatgggctgtgactatcagagatgtatatgggcagttgagtgagtgtgcttcatgtcccgaggtggcacacctcatcccggccagctctccttcctgtaggtcctgttttagtccattctcacgttgctataaagagctacctgagtttgggtaatttacaaagaaaagaggtttaattgattcacagttccacaggctgtacaggagacatggctggggaggcctcaggaagcttataatcatggtggaaggtgaagggggagcaagcacatcttcacacagtggcaggagagagtgtgaagaaggaaatgctacgtacttttaaacaaccagatctcatgaaaactctctcactctcatgagaacagaaaggggaaatccatccccatgatccaatcacctcccaccaggtccctccctcaacactggggattacaattcagtatgagatttgggtggggacacagaggcaaaccatatcaggtcctagtctacagtattgatcctaaaaggaaggagacaaaagagcttggacagagaagtgcatatttcatatgtggactccattggtaaaacaaatcagagcctgtgaactgctgataagtagtatcggcttcattctcagaggataattagatcgttatttccatttataatgcaaagctgaaatagagataatgttattatttcatctgtaaattgcttaattttttgcatattaattgggctgaactgttctagattacattcctgtccagccaatggatctgcttgtacttcttctaccctctcccagcctcccccaatcctgcctctatctcatcagcagttcctaaagatttcactcagaatggagtattttctttattaattaaagacctagaggctctgccagtgatttattttttcgtttctctgtgcatattcactttcatatttctcccttctctcacccttcagagagcctgctgcactcaatcccaggaggtttcctaggaaacacgcttacagccaggaaccccaaaccacacatttccattttcctcccgctcctctcccaatgagcattagctaatgaaacaaggtgaaaacacatcagcgcttttagaaattactccaccaaggcaggttatcaatttcatattcattcatggaaagatgaaggaatttgcagactctgggctttttctggagaaatctcagtttagcatcatatctaataacctaagcattggatttgtcacacgcctaggaattttacatgtgctcagagtctaagattgaggttattaaaattccttgacttcttgattccaagctccaaaaggaagttgcagtagttcctatttactgatccctcctgagtctggtagggtatctgtccactgcagggacagcaaccccacttctggctatctacccaaaggaaaataaaccattatatcagaaagtcacatgcactcatatgttcatcgcaacagtggttacaatggcaaagtcatgtaagcaacctaagggtccaccaatggctgattcgataaggaaaatgtggtacatgtacaccatgaaatactatgcagacatgaaaaaatgaaatcatgttctttgcagcaacactgatggagctggaggccattatcttaagtgaactaacaggaagcacaaaagcatgttctcacttttaagtgggagctaaataaagggtacatatgaacaaaaagatgaaaatagattctagtgattcctaagggaccaggacaggagaggagagggttaaaaaattacctactaggtgcaatgtctaatatttgagtgatgggtacactgggagtccaatcccccctttacacatgtaatacccatgtgataagcaaggacatgtaccctctaaataaaaaataaaattcatatatatatatgaaaaaacagaaccttctgcgatgagagcagcccttccttcctgcagccctttctgccttcctccctccctcccttccccagggaacatttcttggaaatgctgtagactaagttttggagatgtttaactaatttattttctccctttttctctcctttgtttttaaagggcagcaggcccctgttcccttcacttaagatgagttcccacttcagcccaaaggcagaaactgcttgcaggacactttctaccccaggttctagtttctgagaaccaagctcattcaaaagatgttgccaggcttcctgggggagaagacagagaggggaggggacgtcacacagcatgaagggagggtgatgtaatgggttcgtgtcagtctcaatacactacagtttgctggaaaataaataaatacatagccaaagcaggatatgtttgtgtagtgcttttttttttttttttttttttttttttgagacatagtctcgctctgtcgcccaggctggagtgcagtggcatgatcttggttcactgcaagctccacctcctgggttcatgccattctcctgcctcagcctcccgagtagctgggactacagacacccgccaccacacttggctaacttttttgtatttttagtacagacggggtttcaccttgttagccagaatggtctcgatctcccgacaacgtaatccgcccacctcagcctcccaaagtgctgggattacaggcgtgagccaccgcactggccatgtttgtgtagttctattggaaaagtctaaagacagttactccataagtagaaaattaaaattaaatatctgaccagcatgttggttgcattgaccaagaggacaatggggaaccaataatgtcctcattctgacctccattgtgaagcctgtgcattaagaatagagagaagccgggcgcggtggctcgcttgaggccgggagttcaaaacaagcctgggcaacatagcgagaccctgtctctacaaacaaaatttttaaaattagctgggcatggtggtatgtgtctttagtcccacctactcaggaggctgaggagggaggatcgcttgagcctaggaggttgaggctgctgtgagctatgattgcaccactgcactccagcctaaatgacagagcaacaccttgcctctgagaagaaaaaaaaaatgcagagaagagagactccttcagctgggaagagggggaacccaggcatcctagagcagtagaaatctttaccttagtctctggcagagccccaggaaggaggcaagatcccaggcggctcctgggaatgctggatcctgagcactagtgccccaggcctcggcagagactcgtggactccacacaaggcagggaagctgagagctgccctactgccctactgtggtctttccaatgagctgtcagcagggacaacaatgtattgcagtgcagagggcttttcccattttccatgaaaatgaagagtgacaagatggaaatccctgctcatccagagaagtgagggcttagattcaaacgaattcaatttaatagaataaagacattgacattcttgcacacccaggtttgcagatatattaaggttcacacttgctccacatggatgctaacttttgtgttgccttctgcatgatttttctgatgaagccaggatacagggatggtctacaccaaatgatgcgtgtactccccttctgtactcacagcagacattattaatcaatatttcattcttttctgactacacatgcacagatggagccacaggaacctccacacagggctccaggcaaccgcagcaaccaatcagaactggtataaaattggaataatttgcctttcctgctgtaagatgaggctacaccagtgtgtagagtatggagtcatatacagacggtcactcctagcatgagttatctgagaggagtgaagggtcaggcgaaaaggaaaccgagcttaggaggcttgtctccatgcgcctgctcccctcccgtctccagctctgctctgcatcacaggaagtgcattccctaggttctctggccaatcgcctttggcactgggaagcactggcagaaagtcggagggcagaataagacagaaccttctctttccttctcatagcacggcctcccctcccagacattattaatcaatcaatcgttctttcctaactactcaggcaccgatggagcagtccctgctgtaattctcactcctggcagatggctccgcctctgccctccagtaacctcctttcctggctgtgtcccaacggccatgacggggtcgcggcttcctgctgtcacctcgccatcccctgcttggcctcttagctcttccagcgcctgagggacccattccctgtcttaaaccatctgtgtttgaaatacttgactggaaagtatctggcagtgacgcccgataggttaggcagggaggttctgtctttctctagacttcaaggtctagggtatggattttgaaaacccgcatcggctttgagggagcttcagggtgctgaagaccaaggaagggggcaaatggtagaccagatgaggagccaaagctgaagacgagtgaattacccccttgtaatcaagattagcattgcaaatctgtctgtttccattttttgatatcattgagattttagaaagccttatttaaatgctccagctgggtctcagctatatggagaggtttgatttcactttaaatgtatgatgtatggatccctttcaaaaaacaacctacttctagacccccagtgctggcttaacttatttttatcttaactttagttccttaaatatgtctaaaacaattaaaaatacaatctcctcatgctgaagagttcttacgtaactagaaagtcaaacaaaattttaaattaaatccaaaaatacataaaattaacaacgttcaaatttattgctttaccctgatattgatattttttggctgaaatgaaattgcagtttttagcatgaatatgtttctgactcctcttctgtgggttcttttgagattggcatgtctatattgccccgtgctgggttaggagtcaattctcctattgcttttttcctacccaaccttctgcaaaccttgaacaatacagcgagaggcccttagcttacatttggcagaaccacatcatttgttactaagtaaatctctagtctttctttgttggtctgaaagaaatatggcaggcaaaacaatcctgggccagtactcaactatgaagtggtcatcaggtggtccccaatcctcttatactctttgtgtctttaagattattgtggactgcatgtggtggctcacacttgtcatcccagcactttggggaggccaaagcaagaggactgcaagccaggaatttgagaccagcctgggcaacccagtgagatctcatctctacaaacatattttttaaaaaacgtagtcaggtgtggtggcacatgtttatcgtcccagctactcgggaggctgaggcaggaggatcacttgagcccaggagttggaggctacagtgagctatgatggtgctactgcactctggcctgggagacagagcaagaccctatctctaaataaatacatgaatagattcttgtgttgaaaatataaaatagaaattcttatggaggccctctgagagacagtactggtaagagtcaccttgatcccagcccagcactgggggcaataaataatgagtaatccccagggaagccgggcctcaaaagaaaggaattaaaactccagggcttagcgtctgtcccttcccatgtggcgattctccttcctcaatagccataaaggatgtgggcttgttttcagtcacagagtctagcaggtttccttacattgttatgagttttatgtacagaaaaataaaatcacatctcctctgatcaggttatatggattaatgccgcatacaatgcaatgccactggagagggctctgagatattgggataataaaattgaaagttagaaaatttaaaaaatgaaagtaaatgttaggaaagagtgagagtggttggaggtttggaggaaagccatcaagtaatctctctttactcgcattttcagaacgcaataaaacaagcataataagtgtgccacatgtagatagaaacacattctttcttttttgacatcatccttaattatacatagatacaaatgctacataacacagtgaagatataggtgccatttagagaaatagaacatattttaatggtcaccatctttggagagcaatatagtaaatgttaggacacctgtacctcacagcccagcaatttccctcccaggtgcagacactgggaaactttttctcatgagctcaaggagatgtatatataaatggtcatagcagtattgtttgtaatggttaaaaaaatgggaaatgtccactcacaagacaacggatcatgacttgcggtatattcacacaatgttgtactcaatcaattcattcagtagggaaaatgaatgaactacaacaatacacacccatgatgagtgaattacaacaatacacacccatgatgaatgaattacaacaatacacacccacgatgaattaattacaataatacacacccattttgaatgagttataacaatacacacccatgtcagtgactctcacactaaaactattgagtgaaataaacaaatcgcagatgattcatacacttagatatcatctcttgagagcaccaaaatatacttgcaatattgtttatttttattacaaacatatttgtaatataaataacggtatcagatgataaataccaaattcagggtagcagttacccctgggaggggagagggagggagataatgagggaaggtacatggagacctccactctactagtgatgtttcagttcttaagctacaaagagatctacgtgggtttatacccttcgtatgtttctgaaaacctggactaagtcatgattttagcaaatcagccattttgcataaaactcaactctacttggaaaacactttaatgggaaccttagacgcttccacagactcctggctgttcctggaacatagcttataaacctgagcacacgtcctgctcaatgacctcattgggtttctctatcaaagaggcttcttcatcctttgttagtctatcaagactcttcatgaaaacattagtcagtaaagcaaaatagacttgccagaaatctagatagtttctttaagctgatacacccttgtttaaagcagtcgcttttattgtattgctggttcccttgtttgataaaggaaaagctccttggagcagaggaacatgttttcaactccccaccccacagagcctgggggttcaggtctgaaagctgcagcaaaagtctagcctgaatctaaaactaagttacaaaatgactcttcctgtgctccttaggggaatagcccatacatcagaccaatttactaagaggtcacaggctggttgccctaaggctgtgggacctgaacctacacagtcttcatatctgctccccacctctctttctctgtctctgcaccctagtggaccccatgacctacagctctctggctcctcccatactctttcttcctgaggaatcaggtcatcatcgcctgcatatcatactctgaataccaccaaccacggcacgaatttaggaggtatttggtagagtggaagcggagtgggattggcagccaaatatcccttagtggctgttgagccttcggcaagcaatttcactttttgagtcttcgttttagaatggggatgatcacatttaactgatgcactgatcacggtgactggaactcggcaaatgtcatcattgtccccatcaccccagagtccagccaacacagcccttgctgtgggtgagcttcacttctctggctgagttaagggccacctggtcttagcatcttgcactcacacatctgtaggtgaatcttagtcttctatttgtacagcacacacaggacacaaggcggatttctaacaaatgaaaatttgactctgcatctggccaaatttactacgaatgtaggacaagcctgagaacttaatctttaaggatggtgagtggagatctaggaagagaagaccctaagtcttaagaccctaagtctgagcttcaagtcaggaaaggattcatagaaaaagctgagttaacttctggggacaatagaattttcagcagacaaggaaaagggcagaacccaggcacaaagctcagcatggacagagacataagggccagggaaaccatgaccttctggtgaagcaccagcaatactagagtaaaacttcctgaagaaggagcgatagctcaggctgaaaagacctgcaggggcctgatcataaagagccttgaatgtcatataaaggtggggggtgggggaaatctccttgtataagcaatgggaggagctggagaagaatttggagaagaaaaattgcataattagatttgtgtttcagagtagcagctctaccagtaagaaattgactgactagaggaaatgagtgttggagatgagaaacttggctaggagaagggcaagaattcagtcagaagatagcctctgtggtcaagattagtggctcatgcctataatctcagtgctttgggaggccgaggcaggaagactgcttgaagccaggagcgcaagacaagcttgggcaacacagcaagaccccacctctacaaaaaataattaaaaatttgctgagtatggtggtgtgagtctgtggccccagctactcgagagctgaggcaggaggatcgcttgagcccaggagttagaggctacagagagcaatagtcatgccacagctttctggtctaggtaacagacagagtgagaccccatctcaaaaataaataaaaaaaaagaaagaggagaaggaggaggagaaggggggcaagaaagaggaggaggaggaagagaagtaggaagaggaagaggagtaggaggaagaggaggatgaagaagaggaaaaggaggaggaggtggaagaggatgaggaagaagaggaagaggagcaggaggaagaagagaagaaggaagagaaggaagaagagggaggaggagaaagaggaggaggaggaggaggaggaggaggaggaggaggtagccttctattccagaaaaatacccaccatgtggatgaagaggaaaaaacaaatacatgatatcttgaagaaaggaagtaacaggatatagaaactgactgaatgtgaaaaggaagaaaaggagagtatataaaggcaagttgttggcttgggtgcatggatggaatggactgccacttaacgagacaagggagagagagaggggagcagcccgaggaggattatgatgaggtcccaattatagtacattaaaaatgtctctggaacaatcagggattgctggaaaatataaaaacaaatcagaaaactacttgggcatatagccattaaacttgagggagtaaatgttccctagctcaaggctgtgcaatacaattatgatttgagccacattgctaattttagattttctaatagctacattcaacagcatttctatatgccaataatgaagtcgctgaaaaagaaatcaagaaagaaatctcacttacaattgctgccaaaaaaaataaaatactgaggaagaaatttaacaaaggaggtgaaagacctctacaaagaaaactataaaatgctgatgaaagaaactgaagaagacagaagatacaaacaaatgaacatatcccatgcttatggatcagaagaactaatattattaaaataatcatgatgctactacccaaagcaatctacagattcaattcaatccctatccaaataccaatgacattctttacaaaaacagaaacagaatcctaaagtttatatgaaatcacaaaagaacctgaatagtcaaagcaatgctgacaaaaaacaaaaaagaaaaaacaaaaacaacaacaaaaaaagctagaggtatcacctgatggaacttcaaaatataccaaatgctggctgggcacagtgactccctcctgtaatcctcgcactttggaagaccaaggtaggcggattgcctgagctgaggattttgagaccagcctgggtaatatggtgaaaccctgtctctactaaaatacaaaaaattagccaggcgtggtggtgggcgcctgtaatcccagctacttgggaggctgaggcaggagaactgcttgaacctgggaggcagaggtcacagtgagccgagatcatgccactgcactccagcctgggcaacagagcaagactccgtctccaaaaaaaatatgtaccaaatgctataatgatctaaacatcatgatattggtataaaaacagacacatatatcaatggaatggaatagagaacccagatataaataagtctatatatttacagccaactgatttttgaaaaaggtgccaagaacatacattgaggaacgaacatcctctttaataaatggccctgggaaaactggataccctctctctcaccatattaaaaaaatccatgcaaaagtgagttaaaagcttaaatgtaagacctgaaattataaaattactagaagaaaacaggggaaacaattcaggacattggtctcggcaaaggttttatggctcagacctcaaaagcacaggcaacaacacaaaaatagacaagtggaactacattaagctaaaaagctactgcccagaaaaagaaacactcaacagagtggagagacacctgttgaatgggagaaaatgtttgtaaactattcatctgacaaggaactaatatccagaatgttcaaggaactcaaacaactcaacagcaaataacaataataataatcccattaaaatgtgggcaaaggatctgagtaattatttctcaaaagaagacatacaaatggccaacagatatatgaaaaaatgctcaacatcaccaatcatcagggaaatgccaatcaaaacccattcagtttctcctgaaaacaaatgggaacacaagctctccggaagccagaacattctggatattcgcttcacaagaagctatcattttaccccatttagaatggggttatcaaagagacaaaaaataacaaatgctggcaaggatgtggagaaaagggaattcacacactgttggtaggaacgtagattagtacagccattatggaaaactgcatgaagattttttttttctcttgagacgggagtttcactcttgtcgcccaggctggagtgcagtggcacaatctcggctcactgtaacctctgcctcccgggttcaagtgattctcctgcctcagccccccgagtcgctgggattacaggcacctgccaccacacctggataattttttgtagttttagcagagacagggtttcactgtgttggccaggctggtcttgaactcctgacctgaggtaatccacccgcctcggcctcccaaagtgctgggattacaggcgtgaaccaccatgcccagctggtatgaagattacttaaactagaaatagagctaccatacaatccaacaattccactatcgggtatttatccaaaggaaaggaaatcagtgtatcaaagagatacctgcacccccatgttttttgcaggatgatttacaatagccacgatatgaaatcaacctgagtgtccatcagtggatgaatatataaagaaaatgtgacatatatacacaatgaaatactgtttggccataaaaaagaatgaaatcctgccatttgcagggatatggatggaaacggaggtcattatgaaataagccaggcacagaaagaaaaatatcacatattctcactcatatgtgggaactaaaatagttgatctcgtagagacagagagtagcataatacttaccagaggcttggagaggtgtgttggagaggggacatgaggagaggttggttaatgggtacaaacctacagttggatagaagaaataagttctactgtttgatagcacagtagggtgatgatagccaacaacattatatttttgaaaatacctagatttgaaatgttctcaacacaaagaaatgataaatgttcaaggtgatggaccccctaaaagtcctgatttgatcattacacattgtatgtatcaaaatatcacatgtatgccatgaatatgtacaaatattatgtatcaatatgcaaaggcaaaaaaaggaatagttaaaagtgattctaataatatgtttatattaaattactttaagttatatatattagatattttatataatttatttagacaaataaatctaatatattttcatgtcatcatgtaataaatagaaaaattaaggtattttttatatatacatattttttgtataaaaccttcaaaatctggtgttcattttatgcttatagcacatctcaaggcagactggtcacatttcaagggctcgatagtcacatgcagttagcggccaccacactagacaaggcatctctaactgattcattggccccacccaagaagccataaagctgggatgtgtctacttctggtaaattgtgattgctgtcttaacagcttatttcgacaatgtagttgctcccagtgacattttgtaagtgggattttggcatatcctaggtcctctggtacaagtgtatatgatggcatgaatgcccgaagtgctttgacctctgcagcgaaagctgatggtcacatatgaggaatgaacgagctcagcactctcattgtacaggaggaacacggggtctgattgaaggggatgtgtggggcacagctaaattaacccggttaacttggtcctgtaccccactctcatcccagccaattgaacacgagtcttgagtttctctgttttttttttgttttttttttttttttttgtatatgttttctgccatttgaagtattgcatcagatcttccctttttatttaactggattcctgttgggattttcgttagctggttgctgcaggtaccaggacactaggtcaagctatgcacagcatagagtaaatgttaatctctttcaaatccacccaggatgacgtgcccaagagccttacccaagagcaatgcatgatttactcaacctgtaaaataaattacaagttgctttaaagcctgtgtggtaatatgtaaatcctgctccattccttccacacacaccggcatggccattcgaatctctttcacattaagtttgaaagtaaatgacagctgcacacacaggctaaataggaatctccagccaaaaatctagagagaccaaagaataatagaaagtttgtggatgtaatgtgggggttatttgagttctcaatgctaatttaaacaaaacaaaacaaaaaaaccccgatgaagtaagactttaatctttgttgagtttcatggtatcctacactgtatttttaaaactggtttctctagtgttaaagacattgttttactttgaaattttagaagaaatgtctaaatttcagtttccccatttataaaatatgtccaggttcatgctctttgtgtaaggcatttttatccctttgaagatactaagttattatcattaacgtaattccctttgaatatcaatgtagagttaatttacccaatcgctatcatccacttgtaataaaagcatcacactcagtgaaaagtacgcagctttggaaaaaatcatctgcttctagcttccggagagcttgtgttcccatttgttttcaggagaaactgaatgggtcgctttgtcttgctggtggactctttgttaaactttcccttttgtttgcacatttctgacagaaggaaacgtgtttattgcctggcactcgttacgagcacttaataaatccttgttggatgaataagcaaatgagattccagaacggccaggttacctttcccttcccagcagcttccaagcttctccccctgcctgagacgtagcagacaggtctggcccgaaaaggaacagaattactgcaaataaacggctacatgtttgagacatcagaaatccccagaaatcttcatctcactcctcttgcttcccgagtcgtgttcccttcttcctgctacactcatattccagcgtgaggtcactggcttggggcctctccgaggtctttttctcagtcgaatgagtatctccctctgcaagtgcagtgtggtccaccagccccgaggcgtggctacccagcgccctgtgattccctagatgaggccaatggcccgtgtattttctcattcctcagggccatccagacagctcccacagaggcttcctaatgtctcctgggccaacaggatttttgttggcacgtgatggaaaaggctgcaaaccaaccatggctttgaaagcccagcagcgacatagctggtatatgtggtctgtttctaggtctttcgtctaccttctgaggcatgagttttcatcctgtatttgcccaagcctcatcttcaggcacaaaagccttcactgttgagaaataggccagccgctctggctgggagaatggcaggggcgacctgcgcctggtccctgtccctgtgcctatgcctgagccctgtgccgggtccctgtgctctcctctcatgtagctggcaatgagccccaggtcctgcatcccaggcaacccggaagctggtttgtgcggtgtctacagtaaggctattcaggtatcaagctgtctcaggattcgcatggttaaaaatacatgaacttgtgggttaaacactaaggtagcccatcccgtgattcccggtgcacagtaaggtgaggtgggactcagcctcttctcctccctagtcttcatttctacgttgggaacagggagcacgtggtattgggaagaagatggagccagtgaatggtaggttcaaagccctgatttctccactcaccatttccatagatctgaggaaatcaacctcttggagccatggttttgcatctataaaatgaggttaaaaatatctgctttccaaaattcttataaggatcaggtcaagtttgtccaacctgcaacccacgatggctttgaatgcagcccaacacaaattcttcaactttcttaaaacatgagattatgcatggaccttcatttttttctcttttgctcatcacctattgttgatgttagtgtattttatgtgtggcccaagacaattctccttccagtgtggcccaggaaacccaaaagattggacacccctggattagatatttctaaaaaattatctttatagtagagcttccgcacagcaaaagaaactatcaacagagtaaatagacaacctatagaataggagaaaatatttgcaaactatgcatctgaaaaaggactaatatccagaatccataaaggacttaaatcaataaggaaataaaaacaaaaacaaataacctcattaagaaatgggcagaggacatgaacagacatttttcaaaagaagacaaagccaccaacaagcatatgaaaaaatgctcagcgtcagtgatcatcagagaagcacaaaccaaaaccacagcgatagccatccataccaatcagaatggttacaactaagaagccaaaacataacagatgctggtgaagttgagggaaaaaatggaatgcctatacactgttagtgggaaagtgtattagttcaacccctgtttaaagcagtttggagatttctcaaagaactaaaaatagaactactattcgacccagcaatcccattactgagcatatacccaaaggaaaagaaatcattctaccgaaaagacacatttctctatttatcacagcactattcacaatagcaaaggcatggcatcaccagctgcccatcaacaacgactggataaagaaaatgtggtacatatacaccatagaatactacacagccataaaaagaatgaatcatgtcctttgcagcaacatggatggagctggagcccattatcttaagcaaattaatgcagaaagagaaaaccaaataccacatgttctcgcttataagtgggagataaacattgagtactcatggacataaagatgggtacagtagacactggggactccaaaagaggggaggaagagggtggggcaaggactgaaaatctttctattgggtcctatgtccactatttgattgacaggatcaacagaagcccaaaccttagcatcatgcaatctagcccttgtaacaaacgtatccatgtgccccctgaatctgaagttagaaaaaaaactgtcttcatagtaaatgctcaataaatggcaattactattatagttactaataaaatattatcttaaaaatatatatttgataactaatatataaaacaatattttattaacatactatactgtataatcaatgccaatgttatataaataatatattaacatgtttaataaatatatgaataaatatatactaaaacatgttataatatattaagtttcaatacattatgactattagaacaattctttatatattattatattgtactaatatattactattgttcatgtgtcattacttcaaatattgattaacatggtttcataatgatacaagaaactaacttgttttactgtttctagctagtttactctctctgtggagatacactggaagtaagtgaaaataaagtcaccatttttttcctgtttgcctaaagtcagcacagctttgttttatctggaaaataatcatttgctttttcaacaaaagtaaagtcactgaaacattttggaatctaaagttccaaatggaagtcagggatagcagatgaacccaaaccaaagtcaatgttcacctccagttatggtatcttcactggtagagccccctttacacctgcagctattcaaacagtcagtcaatgctggttattattactcacccaaagaacaggataggaaaagggcaacgaaatggcctgcccattacttgtccccaaatattctgcctgattgccttcactctgtggaatttgcccatattatttcatggagatagttctaccctggttctaaccagttgctttggccttcgtgcccagtttatcaaaccccatgagcccttagagagcctatgggtgctccttgttcatttactcagtcaataaatatgtatgaaggccctatatttctgtaccatgctatgtactaggcttaaaaggatgaacaacatacaatgggataaatacacacttagaagaaataaaccctggtgtctgacacatcaacagggtgatgatagttaacatgaatcgatagtctattccaaaatagccagaagagaataattagaatgttccgagctcaaaaaaagagaagtatttaaggtgatggatatcccagtgacactgatttgactatatgaaagtatgaaattatcatttctccgcagaaaataagtacgtcatatatatgccaataaagttaaataaagacataagaacagggccaggcacagtggctcacacttgtaatcccagcagtttgggagggtgaggtgggcagatcacttgaggtcgggagatcaagaccagcctggccaacatggggaaaccctgtctctactaaaagtgcaaaaattagccgggtgtggtggtgcacacttataatcccagctatgcatgaggctgaggttgaagaattgcttgaactcaggtcaggaggcagaagttgcagtgagctgagatcatgccactgcattccagcctgggtgacagagcaagactccgtctctcaaaaaaaaaaaaaaaaaaaaaaaaaggaaaaggaagaaataagaacacgatatagtggagaggctcacagtccattgcaaaaggcaatggataaatacgtgggggcttagagtgtgagggaggcttggaacaacgtaggcagagcatgtgatggacacctagccccatcctggggcttcagagatttcccagaggatgtggcatccatgctgccacatgaaggtggccttagagtcagcagggtagacagacagggcaggatggaaaaggatatgcccacagagaggagagcgcgctgtaagatttggaaggtgtgaagtacgccaggctcagggagctatagggcatccccgtggatagacagagggtagacgcagtgtttctgcaacacgtggtgggaggatcacctgcatcagagtcctccagccttttggcacaaatgcatggttcttggattcagtgagtcgggatttctggaagagaggaccaagactcttcacttttaaacacaatctcaggtgattggaaggctagctgaagcctgaacttctaatgcagaagagagacgaggcagaatgggtgggtgagggctagctcatgaaaaacctagaagtccagaggagacgcttggactttctcatgagggtcccaggcagtggtgtgctggtaaatgactaacaaccggttctggggtggaagtggttaattcacagcttgctcatttctgggttgtaattactataaagatcacatgagatcatctgtgtccaacctcgtaagagctgaagcatggaagaaagaaaagttgttattctctaattgacaggataccttttggatttgctgaatccacagtctcttcttctaaacaattcacctgtcaaaattatttgtcatgaaagcctttattgtcatgagagttgatttactcttcaaaggaatctgtttcgctctgacctctttgagcacacttgacaggggttttgcactgtgacctcccaggaatcttgcaagcatcacccagaagataggtcatctgctattcccacttgtattcatggcaatgacaatttattccaggcattggtcatgagatttgcacttcttcacatattcattcacatatttgtttacacattcatactagtaatagctaacatttattatgacgtgccaagacctgtcagacatgaatgtattaacttctcaaaatgacctataagtcctattactgcatacatgttatacagaaaaaaactgaggctcaaaaaaggtacaccctagtaagtatcagagctagaatctgaatgcaggtagtctgtctggggataagccatggtgcctctcacatttccttttcattaactaaataaactgtcctgtagccctcaacagtcttcccgtaattcacagatgccttgaaggggggttgttctgaaaaagaataaagttttttcctgtttgcacccaactgaggtcagtagtttaataaatgcatcatagtggctctttgtaagagaatctgatgtgtacatcatactcaaacctatttctggttttattggctttatggaaaaattaaacataaaaatatacaatgtctgcatcagctcctcctgggttctcaggtggaagaatcccttttcaggtaagattattccttgcctatttgaggagtgactccgagatgaagtgactccatcttggatgctaatctgccacttcgacttctgattagccccaattccgtgaatgcctcctggttcctactttatttaccatccctagtgtaagaacatgtcaatcttgatgttatcacacaaattataggctgtgacacgcatagcattcttgcctattctgtaggattgcttttagttgtcccgcccagagcacacacacccttttcctatggtggataagccctgggtctgggggtaacataacattatggagatctccctgtctttctgctgccaaagaccatgcttccatccgtaagttccccagataaatcaccctttaccaaaaaaactggattttgtccttgttctttggtttcttgtctcctcctgtatttgggggtcactttgtgtatgtggccctttcttggaacactatctcagaggccccttcagattagaaactgtctcacactttcttaggaaaacattttgatatcagcaaacatttccttgaatttaatctaaacctgtcattcttcagctccaacaaatctcctcttattcaagtctccattaagataaagtataggctgtcataggcttgggcataatcatgtgtgtgatatttagtgtatttgcaagtaattgtcaagccttccacagtcatcccactcaggctaaccattccttaacccttagtgatttctggttcacagagttctttacatgagaaattccagtgcttgatctgaattcatgtacaagcaaggtggaacacagtggatcattccaggcactattctccatggaatcctggcaaagtttcaagcagatgtcgaataattctaagtgactttaagagtttcacatactctatactaattgccctaaggagccatagagctttgactatacatattttattcttccttttgatcctatattgtgtgtatttcagaattttgacatcttacctctgtatctaacgtgtttccaaaaatatagcatgatcaggaaagacaattcttgaactaactctagctctgtgtggctgactattatgcccaggtacaaaagagcaggactcgccggacatgattcctgggctaatttcaaatgctccttctttaaaagatctgcttccatttccccttaattgcccctttcataaaatgaccagatcctctcagaagatttcctttagacagttactttatgccacaaatcacaaatgttcctcgaaaaaagtatctgaagtacagcgcaggatatgtctttgtaggagaaataagacagggtcagacagagaaaaagacaccaacgctgggaagttaggtgattgtaaactgagagcaggtgttaaaggaaaccatattggagtattcagaaaaactcaaattagcacacgaaatagttaatcaactttttaaaagttacaactatcctttctagggttaatttccatccactctctatttaccgcacaaacatttggtaaaaacatagctataatcttatttggatatttaagaaaagaactccaatcaagccatcttccctcccttccactcccctacctctcttccctggcctcttctccccgtcctctcctctcctcttttcttcccctcccttcctctccaccttcttttgatgccacagtttcttcagattacactccttacagtcatgaaaagtaaagacttggcctgatttcatgtggccttaccaaagtgctccctgcaaattttgcagccaccatgaatcacaagacgctgaatacgaggggagtttttttttttgtttatttgtttgttttttgcgagcctcattcactagaagcagggctcagaagattagatggaattatgaagtttggaggattaaaaatctaactaaaaggacacattaaaaaaattcacggacatgattgattataaaatgatttcctttactctcatagaagaaaccactcaatcaccttctctctctctctttttttcttgcttttttcacccctgcctctgcaaacatcatttgctatggttgaaatcctgagacctgtgtcagggcctgccagaaggccagttagaaatatatccatcagcctagagactcctttagattgcattatatataaaaggaagaataagcagtgtgcccaagtgaatccagccaaaagccaaagctgtgcaatggctgtgtatcactgacaatgcactaactgtgattaggggaggccagctgccaccctgtctgtttctaggtatgtcaagtgtggccgcccacccaggagacagagtatgttcaggtgccctctctgcaactgccttaatttcaatgctcatgaactgtgtttctcaccctgttttgccatttccagttaatctcatgcatatttatgtgccaattatgcaaatcccaagataaaaatgcattaagcacccatgatttagactggttaagtccattacatggtgtaatgaaattattgcatgatgtccaatttacctcaatgcttgctttaaactgtccataagttattgaataaccataacatgccaaaatttagctctaggaggcttcctttgtctgacctatcatcataccaggaaatcagaaacttcaagctaaatcctcaccaaagggagaaaatatttcagaacagacttaaggaggcataatgtgatcaaagtttaagtatggcaaccaccttgtcacggatatgtcttctcttcggataaattaaaaatatcgctgggtaatttcaacaacatttggacagggcaacttaggatttaaaaccaagccttgccaatgggattctcctcttgcccagtcaggtcttgttccctcagtcatgatgatattgtaggtcactgaattcaaatgcagtttgaattttcaatatggaaatatccatttccagcattagaaataaaaagactaaaaaagaattcacagaagcaatttaaacacatacacatacacaaatcccttgaaacctaaaaactgaagggtttgaatgagaatctatttgctatgtagagattttatgtttaaactttggtaggacccgaaccccacagtttccatgtttattagacaatatgatgatcaaggaacaagccatgatgtgagtgatactgataaatataatatgtgagcagcctgactcactgacatccatttctcccccgactatagcatgccattttaatcggctcatggtgtgatttacgcagagcctgggtcctgattatttgcataggaaactcccttcgaagtctacgagagttgtactcgcgtgaggttaggagctcggatccacagatctgttaggcgccagagactgcacaatactgcgatagtttgcaatttgaaaacctggtcaaatgaacagattacgatgccattccccaaagcattcaaacctcatcctgtcaatcaagtgagctaggatgccagtgtcatttgccattttctttgctgtggtaggggatcatgaaacagcaccttggattgaagtgtactgcctgtaagcaacaggattccagctacatgcccagtgagaacaagtgggtcaccaaggggatctcaaagatctgccagcccgcagaagggctggagttagagcctttgtaacaaactctcacttgaggctatccttctaatgaatgactctcagacatgggtgaacataacagagatgggaaattctcgcaaaggatggggtgtcttcctgcacaagacctacttctaacattctctgaaaatatcatggtcaggctcattaaccagcaggaaaaaaaaatgttcaatgacaagagtctatttgtgtccaaatcattacacagggcatcaaagagatgaggtaaatcaaagctttgtcctattgactttaactctgctgtgtgtttagagatctatttgccccttgatttgttttgaaatttctggttaagaaaagtaatatttctagcattattgaaaactttggatctatccatttagagttataggtaaatatagcagatatcaaataacaccttcatcgtctgagcttataatggaaaaccccacgttcaaagcgtctcttgaaagtgaaaaagcaaactccagccaagaagaacaagcgcttagagtcttcaggagaccaaaaccagttccccgtgagcatttctaaatgttacaggaccaagttcaagatgtcaggctagagcagtgctctgaaatcttttctgcaggtctgctatttttccgagaacacactggcctccagaatgcattaacctactttctacagagaggattccctggtcctcctgctctgaagaagaggaggaggaagaggaagaggaaagaggctatttcaagtgggagctgggcacactctttgccttaaacgtgttactcctcctgctaaacagcaatacgatctgagaaattggtacttcctgcaaacgaacagctccgagggctgcacggccccaaagcaagagtgactggaaatcctgctaaaatatggctgtctaatcaaccgagaggcgaactcatttactgaggttcccattgtccacgctgacagatggctcgctcccctctctgctctccccttcccctcagatcgcgctgccgtgcaggcaagcctattctttgagagatccagttgcaatcgccagcctagttctgaaatgagacaaaagctccgtgagcctcctcccatgcacagagccttttctgtccctccaagcagaaggaaaagaaatccagatccactccccttaccttcgtcctcatcggagacaggagcccttccatggtggcagaatcctcatgccagtttctgtctcctgcaagttactctctctgtgtgccgtgcttaagcatcccacatgaaaagagccatgtcgggagccgtggtggctcccctctcccgggtggcgcctctgcaccgccacccggtctaacttgaatccccagcgcctgcaaagcgccgttcctggagaagcctgctcctctcctcgccctggtcccctctctctttctccctctcccgcgctctctctcctccctctctctcctccctctctctttccataatctgcctacagctctctgtgtaccctgctcacttgacaaatgatctctgtcttaggtaacgcatttgaaccaagaacagtgatctgtaacaacccacagggcagctcatccagggcaggaggcgaggggggctgagccggagcatccagccgctttgggctctgtagcttgttctctccagagctgagagcactgttgcgtttgttcgttcattcattcattcattcattcattcattcgttcatcattccttcctctcttaagaagtgggactcccacaggaatggatctagttgacaccattactgagctgcttttctggtctgtgtacagaaagctgaaaaagaaatcccactgcgtggagtacttctaaatacccatgttcagcccactgtgaatttcacacctggatagttaactgggttcttctgcagtttggccagatgtttagaggcacataactgtagcctctttttagagaaagtttcaaaaacagatttatggactctgatcctgaatagttgagtattaaaaaaaaaagtgtgtgtgtgtctgtgtgtgtgtgtgtgtgtgtgtgtgtgtgtgtgtgtgtggacgcgcgcgtacgggcacactgtccaggagtccaaataaatcaggattgactgtttcattcagcattgctggtcacttggaaaaaaatacacaatgaaagaaaaatggcaaagacctaggtcagagcataatgcagttgaaaagatgagatttttctgaacttctttatgcttgaggaattttctctgtgagaataattcaacatctctacttcaactggtgactccttaaatgtggctacacacatctatgccatcaccaaggggccaggaccccttttgcatcatatatgtgacacatgtgcaccatacatgaacctatcaatgtgatttaaggaagatgcccctgtcccttgcccttctttccatctgtgattcttgtactcacaagacatccccaagatagggcgagccactctgtcctccagatggaatcacaggctggtcccaggcccctgcctcttccttcattgatgcttttcacccctaattaacatccttcttctcctcccgttcacacatcagcattccaatagaacttcagtatctacaccaactctatcacctcttgatcacctccttcgtagtctccagtttgcttccttttttttttttttttttttacagggtgtctgtctgttgctcaggctgcagtacagtggtgcaatgatgatggctcactgcagccttgaactactgggttcaagagatcctcctgcctcagcctcctgaatatctgtgactgtaggcatgcaccaccatgcccaactaatttttaatttttttatggagacagggtcttgctatgtttcccaggctggtctcaaactcctggcctcaagagatccttccgcctcagcctctcaaagtgttgggattacagatgtgagccgctgctcagggtccaattttctattcttaactctttctctgcgtcaccttagttgcaggctgcaacctcattctcacttaaccagacatgtacatcctttgaccagagtcttagcatcctgacaaatctgtagacccaacatattgagtgcaactcgctgtccttatataaaagattattgccatttctgggggactctggaccttatttcttgggtattgacttaaacaatacttcttattttgtattgtagtgtttagggatccctaatattttcttctattcatgtagtcattcaacaaatagttgtaaggcacctagtatgtgctggaagctgttcttgttctgatgatacagtggagaatagggtagacaaagtccttgttccaaggccctatatttcatagcaggtttgatacaaaactcaaccaactcatcaagcccttccatctatcattgcattattcataccaacctctccccatgtttttgggtttctctgtgggattgcaaaccttctgatgtgacttccatttccagtttagtgccagtctctttgtgacacttctcctaactgtacacccatgatcaactttctcctaggaaataaaaaaccaaaatgtctccacgagaatctcattccttcacctccatcttttttttttttttttttttttttttgagacggagtctccctctgttggccaggctggagtgcaatggcgcaatctcagctcactgctatctccgcctcccaggttcatgtgattcttctgcctcagcctcccgagtagctgggattataggcacgcaccaccactcccagctaatttttgtatttttagtagagatggcgtttcaccatgttggccaggatggtctcaatctcctgacctcacgatccaccccctcggcctcccaaagtgatgggattacaggcatgagccactgcacccagacttacttccatctttaattctattctctgtcctcttccccagacccttcctctatctccccaaaggtttcatttttcagtgtcagggaaggaaatcactcttgtttactcaaaacagagatgccgttcctcatcctccccggttattggccctgaaccattaaaacgacttgttatcccactcactgttgagacatcgcccatgccatgtgctacatttagcttccatccctttggattcttcaataactagaataagctgcatccattatttgcttttttactttcgacaattctttcctgaagcattctgccctgttcatgacatgtaaaggttcatgaacaggtttgcactgtttgtgccctttctaaactcagaaacccctctcatcagaatttccaatcatgtacccttctttttgtttgtttttgtttttgttttttttgagacaaagtatcgctctgttgcccgggctggagtgcagtggcatgatcttggctcactgcaatctctacctcctggattcaagtgattcccgtgcctcagcctccaccatgcccagctaattttttttgtattttcagtagagatggggtttcgctatgttggcggggctggtcttgaacacctggccacaaattatccaccaaccttggcctcccaaagtgctgggattataggtgtcagccactgtgcctggccccaatcatgtccccttctcaagagttttatccttgatattaaaaaaaatatatctctggtacaattgattacctgccccgctgcctcctggccctctgtactctctctggctctcaatctccctaaaggtttgtttaaagtagatagaacagaggggggactatgccaaggttaaacaaaattcgactgattgcatgtttaaggccggttgttttctgaaaaactccaaccatagattttggaaccagaatagctttcctgagtcaaaggaaaggactttcggaaggaatttggaatattctgtataagtgcaccacttagggagggtagaacttttctggttgtttacacaccagccatttagcccctggagcctggggttgttcaccatatttttataatggtctgagaggtccttgacgaaacctctggaatcaataggacttggaacctatcaattagctcctgagatgatgctgctgttgatggtaaagatgagaatggcaatagctgttgaatgcttacctggtggcaggcactgggctaagtgatttcatgcagtagttcacacaattcccttaccccctgccctacgagggaagtactattcttactgctatactgcagaagcttcagctaagtaattcacccacacagcattcagttcaatgaagccactgctggtgtactatttccaccttgtgttacttcattaaaaataatccccaccaacataagacatacaaagacttaaaagtacattttaaatttctgttctttattagtcaggggttgcaaagtaagcatttgaaagtattttattttagactattaggctattacattgagtacctcgttcacttatgtattcaggaaaccaatattcattgaacatccacttcaagccaggttctgtgttagacacttaaaagcacaaagtcttgtgtttatcaaagataaacatttacaaaatggagcacattagtccatttatcacttatgatttccaagtcctttaaatactgatgactgcaccttttatgtcttgtgtgaagtggttgaattgttgcagggtgaagggggcaggaagagagagagggtggtggggattagaaaatattttaacctgggcaataaatgtccgtgaagaataattgtcagatcattaggcaccctaacacccttgacattgatcaatgttaccaaagtatccagaagcaagaacgatttgcatttttgcctcacagatttctttggattagggcactctctgcttgcaatttaccatctggggttaacccaaacttagaaaaaaaaaagtcaataaatatcaaatatgtagacactggtgaaatattaattaagtttacaccacaagagaaagggagttttctctgaaatctgacttaaggaatttctactttgtggtaggtggacttctcacctatagaggaaaactccccacaccaaggaacctctcttagcaaatgcccttgccctttgagccacccttctttcatattttgatgtcaaaaaagagagggaaataataactttataataaacttctctagactaggagcacttgtaaacgtcacaaaggctgttgggtaggccatggttggaggctcaggttttccatctcttgggcttaaacactgaccctttcttccccacatctttgccatttttgaggttaatttatttaggccccttagagtctctggggatcatagctagccaaacaattaggttttattatctgggattgcactgcctgcttcataaagagttgatgatttattaaggtgagaagattgtgacctaagcaccgtgaaggctttaccctctgtgacctgctcaccactctttactatttagaaacatcttcatcaaattgtaggctttgggatgataatggatagaaaaggtcttcttcctggatcagttccagatatcttgggtaacactgaaggagttatgtaactaacatgacaaatctccttccccctttttctctctgcctcaaccctcctcagccacacatatttgctttcatttataatataaatatccgaacctagcacagagaaaattttcacctgctatgtactaaagtgctcaataaaaattgtgatttaatattaagtgcttaaatttattcatgtctaggtaagagaaaacattctacaagttcttgcgatacaaaaattatatagcgattaacattctttcaaattgtttttacatgtgtttgcctttttaaaaacctcagaatgggccgggcgcggtggctcacgcctgtaatcccagcgttttgggaggccgaggcaggcagatcacttgagttcaggaattcaagatcagcctgatcaatatgacaaaaccccatctcaactaaaaatatacaaattagctgggtatggtggtgcacatctatagtcccagctactcaggaggctgatgcaggagaatcgcttgaatccaggaggcggaggttgcggtgagctgagattgtgccactgcactccagcctgggctacagagagcaagaatccatcaaaaaaacaaagcaaaacaaaaacaaaaccaaaaaacaaacaaacaaaaaacaaacctcacaatgatcccatgagatgtggcaggtattcattttcattttataagattggagaggtgaatagaagagtaatatttattgagcatcagctttgttccagggcttgagctagatactcttcagtgtcatctcacttaattttaacaggtgtattattattcccatttaacatatgatgacctgagattgagagcattaagtatggtagtagatagcatcatttggtcctgattattcatacattttgttatccatgcaatttgctgtgtgactttgccaccctctctttttccccaagtatggatagaaggctagcaaaggcggtacaagcagaattttgaaatgcgcatgggaaagatacacccacgctagtctgctgattccaacgggaggataacagaagacccaacctccattacagacttacgagcaagccagagaatcacaaatgagtgagactagccaagatcagctgagcccagcctacatcagcaaaactctacagtcttctgaaaaaccaatgcctattactgtgtggcaccaggcattgcatttgttatgcagccaatggatacgattcctaatccaagatgagagttcctaaactgtggagcagagctgactagaactccaaacgcaggttttctcactccaaaaatttcaagttcttccaatgctgtcacatttctgtggctcacccatgcgcagtgatgggttgtatgattactattttccagaccccagatcaatgtctaagctccaagacacacattccggcacttctatgttattgaatgtcaagtataggatctactgtattttatttacaattccttaaaattgtggcacactgaggaaaacacggtatgaggttctatgccttgatcagtcatctcgtctttatgatcttttagactctgccccattttctaaagaacagcaattgcctaaagttatcagcaatcggtacagaagttaattggaatctagcccttggagacttttcccttcagcagttcttgcctttccgaaaaagtgtctcacagtgggaaaaataaaactgcttttcttcattatcataaacacttcagctggaaatggttctctacctgccccgatgttttatgaaaacatctaaagagcagagtgacattattttcccgtgtttgaaaagaggtatttccacttttttcttttttttgtttttttccttaaggtttgtggtttaagtacttttgtcaagagggagaagaaaaccgacagctgctgcagccccagatcgctgccccgtgtttgctcagaagacctctgggagcccagataaggagaaagctgagagacaggcatctgggcggaagcaatgcctccttcttcccgtcgtcacagaggggaagcagttggatgttcctgcaaagttagcatgcagggtagcatttttacctcccgcttttgttgggttatttccaagctccaaactaaagaattgtgcgacagaaattatgtagggaaacattttaatttttgacaaataaaaattgcacatatttctggtataaaacactatgttctgatatatgtacgcattgtgaaatgattaccatgaattttttttatttgagatagggtctcactctgttgtccaggctggagtgcaggggcacaatcacagctcactgcaacctcggcttcctaagctcaagcaatcctcctgcctcagcctccccagcagctgggactacagatgtgcaccaacatgcccagctaatttgtgtacttttagttgagatggggttttgccatattgaccaggctggtcttgaattcctgaacttgagtgatctgcccgtctcggcctcccaaagtgcatgctgggattacagacgtgagccacggtacccggactacatcttttcttgatatttctgtcaaaatgttcaggattgtcacgacttggacaaaccactttcaaaagctttgtttatttgtggctttttctttataagaggcaaccccaacactactaccaaactgccgtataattgtttatcaaacctagactggggaggggacaaaaatgatagtgatcaatggagatgggagttgacacagtttctgcttctaagacttctttgaactctcaagctgtgtttttaaaaagagagagagatagggtgcagtagcacatgcctggaatcccagtgctttcggaggctcaggcaatgaaattgcttggggccagtagttcaagaccagcttgggtaacataagaagacactgtctctacaaaaaataaaaaataataataatagccaggcaaggtggcacatgcctatagtttcagctacttggagggctaaggcaggaggagagtttgagcccaggagtttgaggctgcagtgatctctgatcttgccactgcactccagcctggacaacagagcaagagaagtctgacaagacaaaaattttttttttctctaattggcctatccttcatggtaggggtgtgaaagagacccccatcatctaccctaaaagtaactcatgaactccttggtacagggatgttcctaggttccttcaaggtggacacatatgctgagaacctcctttaaggcaggttcgaccgggggctctgccctgaggttaccagtgtgaagagtacaggtgaaggctgttgaaaaatttaagaactccaaggattagaggtaacaatcacagaaaccttctgaattctactgagtgagaactagcaggagggttgaacaattcaagtggaagcaaacgttgggagaagtactcatttcacctgggattgttgattaggctgcttcaagggaaatcctattcttgaaggtggctttgaccatctggaggaggttaggatgttggtgcgtggggctgtcgtaagcaggatggggtggagatgtgtaggaggtgagggaggacttcagacagagagactgacccatgctgaaaaagcatagagctaggcagtaacatatttgaagagaaaaacaagaacactgaagtttacagagtgctgataagtgatctccagattatatggtcttagactcgatttttcttaatttaaaattgaatttacacctcactttatttgaaaagttatgtgtcatgcacgaatgaaataatgtgcagacagagttcactttatatcattagtggtgtcttggaaagttacacattaatttatttagaaatctgcaggaaattcctttatgttataaaagctcattcttctaagttattctaattttacaagttggaatgggccatgcctgcagagtgtttgatggtccctttaacagtactgggattgtctaataatggaattatgtttacaatgtgacctttcaaacaataaatgtgcctcaatgtgcattatcttcatagctctaaggagttgtttcttttttttttttcaaatcactcctgtgtcttaaatttccttggccagcttcaacctgaggcacaaaggaaagtaattgcttgattcaatttctcactgtgtcaaaataatgaaattgatgggcatcttttactcccaaacctggaaatgcactctattttgcaaattgaatcttaaccatggtatctaaatatgttcattaaaagcaaaactactgtcttttaaaaatgttcataaacagagacactcatgcctgaggtcataaagccaagttggcattttgatcaggtgtgaagaatatttctgtctcaattttagtaagacatgatttttctgactcagtacctcagcataacctaagaaaccaaactttgtgaacagtattgactttaaacatcatagtaatcataagaacaaagagaaattatgagatatggaaaatagctccagaaacaaaggcttaatttgaaaactttgctatggtttccaagcatgtttttacctggtcatggtttggagaaaggagttggaccttctaaaagtagatcaccaagcgcttacatcttaacacatttccttttttgtttttcttttcttttcttttttttttttttttttttttttgagagagtctcactctctgttgcccaggctggagcgcggtggtgccatctcggctcactgcaaactctgcctcctgggttcaagcgattctcctgcctcagcctccagagttgctgggattacaggtgcataccaccacaaccggttaattttttttttttttttagtagagatggggtttcaccatgttggccaggctggtctcgaactcctgacccaaagtgctgggatggattacaggcgtgagccactgcaactgaacccattttctatacccagcttgttgagtaatctcagttatttatctagcttctcttagccaactttctattctattatgttaaaaaaaatggagaaattactacttctccaatgttaaaaaaggtattttttgttgttgttccaatttaagggaatttgtttgctcaacaaaggctgaagtgctttatacaaggcaccgtgcccgtctcctgaggagcctctgaacgttcccagaagcacacgtccaggccgggcagagcatggcttctgtttctacctctcagtgaaatcaatccccctaagctttctttcaaagtagcccaaatgtgtggctcatgggctataagtcagatatgaaagaagagaagtttggagaataaaggcgcattttcttatttatttattttttattttttaaggaaatgatagatatccttaccacatcttcgtgcatggcctgcccggatacaactgcgtgggtactgcgatggagcacaaacaaacgcgaccgctaaagtcgtgtagggtgtttccctttcatgtctgaatttgtttagacagttacacaatcagagagcgcggaatgagagaaaacaaaacccaggagaaaggaatgctttgaatctaggtccctgggccttgatactttttctttgttaaatcaacccaaggcccctccatatgctgatcatcttttgccaatgtctgtgtctgaacaggttttcccaggcatatagctcagaaagaacctttcatcctccttttcctgttatgtgtataatgtggtgtagcccaaagccactgtgggttctaatttgcatgtctatttcaagaagcccggaaactatttgcataagactcttgcttcctgagagatcccagcagaaggatgtagagatagagtctttcattttttcatttagttctagatatccatagtgagagatctgtgtgtctaaaccctaaaatctgtagaatgtgcatgaaaaaatctaccaccctaagcgtaaggagagctagtacagatgaggatgtcgtggcagaaattagtacaaaaaacattacaacattttgtaatttttctaacttcaagtattttttggaggtttgttgtagaactatggaaacttgaaacataaagcaagactatttaaaggttcaatctcgtcttgtaagaaagagaaacaggtagagagacagaaaggggatatatacttcatggtcagagagctgcaggggcggttgttagctgtgcagatgagcagaagagaggatagcagcagctcaacagtggcaccttcagtagttctagagagaagggatggcaacagcagtagaccaggctagtaccagccaaagcaacagatacgtacaatccagactagtcctgggcggaatagggtagacagggcagggcccagtggagacagccatggccaggtttcccatagagttagagtgagataaagtggtaacagcaacagggcagagagagactgggcaggaactgcaaagatggcagctggagcagaatgatgtgcatcaggtgagaggaaaagcacaaggccagaggatcaactgtgcagggtccatggtgatggagcacagcagtgggcagaagtgcgggctgggacctacccccgtaaaggagacactggaaaccatcgtccaaagagacaaagacaccaatgactaacagaatttattgagcttacaaaatcgcagataaaaagaaaaagaaaaaaaaaaaaagactggccaaaatgctaaaactccctcctcttatgggataacaaaacaggctacaattggttggaatcaatatgaccaaccagagcctgtacagaaccagcctgtgatgtcacagtctgaactaccaccacacgtttcgtactaacgccccctgaatttgcacatgcgacccatgaggaggcatgaagagataactgctcatgccaagacctttctaggtttcccctttccttccaccgatcacccactaatcccagaatccaccccgtaaacctcttctaataaaactactcccttgaagccagcagagggagacagatctgagctggactcctgtctccctgggaacaataaaagctttgcttttctcacaaacctggtgtcatagtcttggcacactgggcagtgaccctttggctccatgacaaacatgatggtctagggaccctgcttctctcctgttcagtctcaggtgacccaaggactagaccatgcatcctcttccttcttacctatcttcatatcctcatgagagaagggagggttatcagcctctgaggatgcagatgttgcgctcagccccaggatccccaggagactggcaaagaagatcatagctttgactgttcagggtggccttggacacaagttgtacccttaaggaatacccttctctgaccagtatggtggttcatgcctataatcacagcactttgggaggccagggagggaagactgcttgagcccaggagttttgagaccagcctgggcaacatactgagacctcgtctctgcaaaaaaaaaaaaacataattagtcaggtgtggcggtgcacattcctagctactaatcaggttaaggcaagaagattgcctgagcccaggagtttggggaagcagtgagttgtgatcatgcctttgtactctcgtttgggtgacagagcaaggctctgtctcaaaggaaagaaggaaagaaggaaggaaggaaagaaggaagggagggagggagggagggagggcgacactcttccttataacaagaaacagcttgcattctataaaagcaatgatgtgatttcttaaaggcattatgagcctaactccatgatatcagatcataggatattacagtcaaattgtgtatcaactagtccatcatttcacagataagtaaattgagtcccagagagttcggttactttcctaagattacagaagtcctcaaccttgctaatctgatgttctttctttttcaacatactgttggctatatatgtcctttgtaaataaaggaacagagccattatcgtggaatgactgacttagagaacgctccatggacatttgcttcgacctatatcccatgcctttctccatttacccccaaattgacatagaaaaagatcagccagatacagtggctgggagggcaacatagtgagaccccgtccctacgaaaaatcaaaaaataagctgagcaccagtggcatgcgcctgtggtcccagcaacttgggaggctggggtgggaggatcgcctgagcctgggaggttaaggcagcaatgagcagaatgctgtcacagagaaggaactcaataaatacttggtaaaatatttattttgggggttagaagtagacttgggaaatttggttttctttgattccatatttcactagggggaaataaagatgtaaaacagagacataaaacatgccattagctttatgggccttgggacagtggggttcccagttttcccgggagatgacgatggaatgcattcaggcagctcccacaatacaattttcccatctctagtgtcctattgggaaggtatctccacctccttgtagcctctccatgctgaatacacttaaaactctaacctcctttcccccaaaggagctccttccttagactctccaggtgctgtccttgatgctaatctttcttctggtcagccttttgtttttcatgtaaaaatgacttatttcattacttactggaccttttccacaaaatgcctggaatcaaataaaaaatgactggattctcaagtcaacctttctggacgcctgcctctccccctgtgccaaggacccatgacctgcttgctgcctgggctctttgtgtggtttggttgcttttctcagacttgaatgcttcccactgaaatcctacaattgggcacatagcactccctattgaaaatgtataatagcttctcattatacaagctcttcactttggcttttagaatcatgtgccgtctcctttcctatttgcctcccgcctgccaaactcattatccaatcattccctcttcaatcagtcccacctttctacctttaggtccttttccagaatccaaactttaatcaaagagataaagcaggccaagacccaatgtccattacttaataagccctcaatagacattagctttcttcaaagtcctcatcaactcctttccttggctgcgcacagtagctcagactttgagaggctgaggtggaaggctcacttaagcccaggagtttgagacaaacctgggcaacatagtgagaccccgtccctacgaaaaatcaaaaaattagctgagcaccagtggcatgcgcctgtggtcccagtaacttgggaggctggggtgggaggatcgcctgagcctgggaggttaaggcagcaatgagcggtgattgcagcactgacctccagtctgggcaacggagcgaggttttgtctcaaaaacaaaaccaaacaaaatcccgcccaaaacaactcctttctgggaagctttccctgagcaacccagctcacctctgtttgtcttcactgcctgtttgacatttagcttaagttaccttgtgctgttatcttttaaccctgatctgtattttaaccctcaagcacaaggtctcatggctgtgtatttccacctctgtgtatggtgtcctatagacagtgagagcttaacatctcgcgtcagtgatgatgctgcagcattgctacgatgtcacccttagctccaaacatgcctacatcattggcaaacctttgaaatcccaatagcaaaatgccagaaatgcaagaatttgaggtggaaaaaggggtaagaggaggaagagaatgggcccggcgcggttgctcacgcctgtaatcccagcactttgggaggcagaggtgggtggatcacctgaggtcaggagttcaagaccagcctgaccaatatgatgaaacctggtctctactaaaaatacaaaaaatagtcaggtgtggtggcgggcacctgtaatcccagctactcgggaggctgagacaggagaattgctagaacctgggaggcggaggttgcagtgagctgagattgcaccattgcactccagcctgggcaacaagagtgaaactccatttcaaaaaagaaaaaagaggaggaagataatgaatatttacagactgccttctctgtaccaagtaacattctttgttcttgtataaatatcctctcctataaagaaaaaaataaacaaaaagagggaattgattcagtcagggtaacagatgttagtgtcatcacttaggactagagcccataaacttctgactgccactgaaaaacagccaatgtcaaggtgagtttagacagatcttaactcagcctgatgctcattaatgagaacaatggcaaaagtgttgggaatttgagtcggcctcagtaggaaaatccttataaatttaatgagagctcaggagagatttctatctatcttaattatgcttgcaaacttcatagggcgctctctgactctaggctaaaacatgaagcaccttgatacctctaatacataagcctaaggcagtaaatcaggttctccccacacgtacaccactttccaaaatatatttgacaaaacttgtctaaatgtctcatagacactaccctttgactaagaaaacggttttggttatcactcccattttacagacagaaaaactgtggaacagattctgatgcaacagtatgccctcgccctagcagacgagtttgttgctcatcctgaagtgaaaacagtagtttcttcacagcaaatgaccacccctctcatgttggtagttctaccattttcaagacaactgtattaccagaaaaaagggctcactgctggatgtgctggaagccgatactatgacaccgggttttctgtttgtttgttttttgttcattttttagagtcagggtcttgctctgttgcccaggctggagtgcagtggtgccatcatagctcactgcagcctcagtctccaaggctctagcgatcctgcctcccgagtagctgagaccacctctgcctcccaagtatttgagaccacaggcacatgctatcacacctggctaataaattttttgtagagctggagttttcttgtgttgcccagtctggcctcaaattcctggcctccagcaatccttccaccttggtcccccaaagtgctgggattaccggcgtgagccccggcatctgtcaacactggatttttgagaaaagaaaagctttatattgcaagtctactcacaaggagacaggagtcaagttcaaatctgtctatctgtgctggctccaaggcagtattttttaatggaaaagtttcagggggtggatttggggataagcaggtgactgatggaaggaagcaggaagtctggaaagtccttgggcatgcgcagttatctattcgtgatgcctcctggggctttgtgtgcaaatttggaggaagttagtgtgaaacatgggtgggaattcaggctgtgaggtcagcaagctggttccgtgcagaccccagtcagccatattggttccaaccaactttagccagttcttttatctcacaggtggagagagttttagtgtcgcagtgagaggtttcttgtcttatatgttaacctgcacactcaagaatttttgttagttactggttgtactcttgggggcatagtctcagtttcagcttttcagcaagtttttgcttttcttatgtgtgttatcctctaagcccaagaagttagccattggcttctttaactctttggggcatggtttcagttgggaatcccaaacagaaagggtcttctgctttgagagaattttatctaaatggacacacaactcataaaacaacagtcgttgagagaaagcagaggctaatggggtcaaaggtgaacagccagtagaagtgccagctcctaagagaaaggatatcaagggacagccatagtttacaagacccaggaccaatcccaataaaagtcctgtctcatgacccctggtctctctgtcactaattgagaaatacaatcgaccgctcccctctgtttatgcagtgcatccagcatcatgtgactacacaagagaacaaaaagtagtatcggctgttgctatggagacttaagaaccatgtgaattgctatggcatcataaaagcgatattccaatcatcagtctttaactatagggccgttgaaatctatctcatatttttagaatgtgtgacatttaacacattgatgaatatttccagcctcagaatatattccctgctttcatatttagataggagttttcagctcaactggctgttttttttttttctctctctctctctctctcctggcaaatgcttcatctcctcatgagtgattacaactctttctatactttcctagatgtttcttcattcttgcttcctgttttttctttattctataattaaaattattttctcactcactgtctccacttccaccagaccactttttcacatccccggttgacatttcaaccaggctttaacctccactggtcttaactgaccacactttaagccagagttgctaataatcaacaattctgagccccagccaaaggtgcacagctacctccttggtggtttttatccctgaaagtcaccatccccttatcatccaagggaattccaattcactgacttttctaggctttatatgaaatcattcttttggatggagaataacatatctaattctccacttttttctttgtaagaattgctaactgggttttgtgtagctgtatacacagaccattttgaatatcagtgtgtatccacacacacctgttttgcttatcttatttggaagatgttgaaagagattgattaacttgtttagagtaacagctcttataacctaattagcttagaagcaaaaatgggaaagtgtaaatatcaggaaatatacattcacataacaaaactctgctaaaagaaacctgttacagtggtgcactgttgtgagataaattcctccacattccttttattcttgcagcatcagcctctccaaatcttcatgtgtattaagaaccttctttttttaacctctttccttaagagagcttcaggatctcttggacttatgtattttcatctcctccttaaacctctccaaagaagagccttcttgttccctccacagtattatacaataagctcaagtacatcagtgaacatggtattaccaaggtgtgattttattctgtgagtttccaggaatgaacatctcccctctaggttactgaattctaaaacgtaatgaattccttcaaagagtttttaagcatttttgcatcaactttttcttccaggggtcacaaaggatgatttatttattcactgttgcatttctaatcacaccaatagggtgcagttgtcactgctgtgtacatagcaatatgaactaaatatatttgcacagacagtaatgccacaaaaagaaataaagagtaacagcgtgtatttgctgactccaacatcaaggactgcactgttatccttgtcaatatctaggtcaagttaaatactgttttcagaaattctaccctgggccatccatggctaattttattttttgtttgaatgggatttctggtaatcatgatcttgggaagaacacagtcttactcctgatgatttctaaatacattagactgtctgtaaaccaatgaacagtactttaccttgctttctccctgataggttgcctcttaattaatcaatccatcaactgagactaatgcaccaagtgatgtgcctcacatcaggaactgtgcaatggaagcattagtgagcctttgctgatatttttacttaacactttcgggtccagagaccttgtcttattaatcacaaaccaaacttccagaaaacggaaatgtcacatttcattgctttttaattcttggtgttttaccacatacatacatacacccacccacccacccacacacacacacacacagagtgtgcaatggaaacttgtagagtgaatgtaaaaacagagggatgaattcagaacaagaccccatatggtttttgaagaacatacaatttagttgggcaaagaggagaccagaaatattcataagcaatgaaagatggcctggaaaccaagcaaaaagttgcagtagggaccagcagtgctggtctacaaattaaaaaaaaaaaaactacaaataatatataatattatataacaaatacatatgcctagagatactgctttgatgttctatgtcaactccaggctcctctcgctaagacactggcacacttcttagtttgatgaggttgatggaaatgcgttgctcctttcctagacttcttggtccctaaaaggttctgtggtgaacactgatccatcccaacccatgtcccctgcttctctgaatttttcctgattcaaagttgatacatacaaactatggaaattccctttcttttttaattccatgaagatcagactttaagacacagaatttccatgcattaaatttacataactagctatacatgttggcaaaagcacaaacctgcaaatgaagaccccagggggtttcctctgtgattttaattctcatttttatacttatcttcattttgcaaattccctacaatcagcttctataaccacaaaagtaaaagcaaataacaaagccctctagcgatgtgagaacattcacttattccttccttgactcatccatctctgcgttccttcattcactcgtcagccctactacttctcacagcactatgctggcattgtggggaaagggtattaaaaaacacggaggaggccgggtgcagtggttcaggcctgtaatcccagcactttgagaggccgaggcgggcggatcacgaagtcaggagatcgagaccatcctggctaacacggtgaaaccccgtctctactaaaaaatacaaaaaattagccgggcgtggtggcaggcacctatagtcccagctactcgggaggctgaggcaggagaatggcgggaacccgggaggcggagcttgcagtgagccgagatcgcaccactgcactctcgcctgggcgacacagcgagactctgtctcaacaacaacaacaacaacaaaaaaccaaggagcattcctacttcctgcttcaggaaatgttcatttctgagatgtcaagaggataaactttctggaatctcttattttatggttctctctcttttatctccttaaagcacgtaaaatcttcttttggttctaagaaatattattctatttatagtattattaatctatattattatcatattatatcacattcatttatgtaaaatcattattaatctgttaataacattatattattctcttccaaatgccctttgaaaaatagcttagctgatttttcagatactgttagcttgaaatcatgaactatatccaggtcttaagagaagtgcccctatttcatttcagattggtcaaagtattaaatcatcatctctgtttccttacatttttctttcattccttaaaagtgaaatagcaattcttattctcagggtaggctcacacagaacaataagaattggtagtagtagtagatgctatttctttctcccaaacatcaaaaataatccaccagattcccttggcattcccttttatgtaggctagatgtcctaattcttatttttgcttgagtggaaacaggctcagcatgtttaaggatattacctgttataatccagtaagttagaaatggggcaagaaccagaaaccgaagctccagaatctgttttaggaattcggtggaatttaaaaagaataaaaccatacctaggagggaatcacatctgcctgagatagtatatctttctgacaaaagtaaattgtctcccctgtgttttctttcattaaaaaaaaaaaaaatcagttgccatcagaaaatagcagagggaactcgggctgcagttagagactgaaaactacctgtacaaattatttccctaaggttcccatacttattccattctctcctcggataacaaataaacttgctcagttttgaacatcaagtctgactcttcgtgcagtgagctctccaggcgtcccccgttgcagggggaatcaagctggggctaatcagtttcttacatgattcccagcaggaaggtggtaatattcatgacttcagagaccaaaatgaaaccagctccttttctgagggcagagcccaggataaaattaatagtagcaactccttggatccagtgtactgtggcatcctgcgtgcaaacagctcaggaaaggttatagagaaggtgcctgttgtatgtcctgtcacagttcttcacttacattgaacacatacaaactacgaatctaagcctggtagttccttacgacttcacgacactctgaaaagttttgttcagtatgtttacagagcagctattatgtctctgcatgagattttgagaaagatcagtggaggcaggacatgaacaaaggcttttccagataaggcaagtcaattaaaatggacagagactgcaaaaacaaattctgattcccatgctaaaacccttccagcttgaccataaacacacaggtgtgcacataaacatatatactcacatgcacacacatacacacacacacacacacacacacatccttgcaccagcagtcatggaaatatggcaggaatcccattactagaaggctgagagctgaggctgggtaagaccagctattctgctcaactcaaccttgagctactcaaacttgacccaccctccaaggactgatcccagagtctctgccaggctgaccttcacccatggacctagtagcccaagctgcaagagttccagacaggctgtaaaacattaaaatgttcctgttatccaacagctttagggcacctgaagggcataagttattcaaatcaaaggctaatgttcaatttaaatgaaaacctgaaggctttgattttacacaagaaaaacaaatactttttatatttttataatttctaagcaaaaataatgcccaaaccaaaacaatactttctacataattcctagatatggataaacactgacatctatgtggttgtctaaaaatctattacaacagagtctaaagtgtactttacattgtttggtgttggattagaaatgccattcttaatgtaaattgctagcccatagaaatcattcaataaatgttaactattattgggattaccagtgttaactgtgattgcttgaatccaaatataaagcgctagacaattcattcccatctttatgtccagtcgtagttctctaaatggtttgggctaaacttcttaccctggggaggaatgacagagaagggaggtcaaggccaggcaggggaaggcaggcaaccctgtctagggtccatgcaatgtcaatagtctgaggccagtctccatgaattggaaaccaacgaattgggtgaatcctagaattgctatcactgttctcaaaacccctgccagcctgaagacccagaaacatcccgatggatatttaagccagctcagaaagctgccaccagggggcgcgacaataaggctgggacaagcagctcaacccagaaactccctggtctggtacctcagttgttcaattcattaacctcacaataagggaaccccacattttatacaattttatacaggcaaatcgggaccccatttattgtgttatgacgaggggaaccacgtgataacttttaagggcaaaaggagacaatatgaataataatattggcgtataacacataaaacaaaattgttcaggacaagcaggatatacgatcactctagtttttttattttttatattttactttttgagatggagtctagctcgtggtgcaatctcagctcactgcagcctcctcccgtgttcaagcaattctcctgcctcagcctcccgagtagctgggattacaggcgtccgccatcaggcccagctaatttttgtatttttagcagagatggggtttcatcacattgaccaggctggacttgaactcctgactccaagtgatccgcccacctctgcctcccaaagtgctgggattacaggcgtgagccaccgtgcctggccaggatcactctagttatgacaaatccactgtactattaaattattatttcattcaattgtcttgcatgttctacatgcaagcatacatgtaaactttggcactcaaattgccaacttcgcactaatgcctagacgtttgtccataattattaaatcctagaaagtgagcacatcatctatgcaacccttgaaaaacaaatcccacagtaatttccacgagacagaatattctacttattcatcactgaccatcactgaccatgtgtcataccagcactaactgcttgcctggagtttccgctctggctctttggtgagctgggagtccgcaggacagacctggccaatgtggtgctttccagtgctcatcctccatccagcaaagcacatcctagtaggaaacatgcctgcagtttcctggcctgcccagaccttcaaactactctcccagagcgtattagctgagatggtggcacgaatcaaaggaatcaataccagtggggagtagctgctcgggctcatagatcatttacttgggattgtcagatataactaaggaacagatctcctcaaggactgcgttccttgtgtcagcacagagtcttggagcgagagtgatggggatgttcccgcccacatgacctcattgggacatcgggctggagagacctgggatgttgaggcaactgccatgcaattgctactaggcagcggcacatggttcttggccaggcggaatagaaacaaggtttactgaaggggcctaggcaatttcatggaggaggaagcaaaggcagaggaagtgtccagggggccaggaggctgcatcccagggaaagtgagggctttgaggagcaagccaatttcacaggagacttgactgattccctggatccttgagttttgcagtttgtttcctctcatttcctccttgctctcttttctgactttgccctcattgtcctcttatcacagatatgttttgttgaacaaatcagtatttcagtattactttgggatctcattgacatcacatgtactgattaccttgaatttgtctcttcctccatccacggtgcgttatcttatagctttcctacaaaactccagctctccatctagagagaactggccgagttaaattccaactccgcattttatgagctgcgagaccgctctaagtctcagttttctcatctataaaatatgaagataacaatagcatctgccttacagagctattgtgaggtttaaatgagacactacattcaaagtactcagtagagggcttgtcattcatctttaaatgcttagtacatgataattattattatttatggttacatttaagctccttgtttctatcttacctttccgtgttttctcttaaaattaattatcctttcttatccagtccatttcttcctttcttatccaaaaagcaaagtaatttaattttactggttttatagtgttactggttggttttaaaatttttatgttgtttccatttttaaaagttttaatctcatttgctttctggctatcattttaatgcttatttgtaacttattctttatcattttgcattaattctactgcttgatttttaagtgtcttattttatttatttatttatttatttatttatttatttatttatttattatgttttgagacagagtcttactctgtcacccaggctggagtgcagtggcgtgatctcaactcactgcaatctccacctcccgggctcaatctcaactcactgcaatctccacctcccgggctcaatctcaactcactgcaatctccacctcccgggctcaagcaattctcctgtctcagcctcccaagtagctgggattataggcacccaccaccacgtctggctaatttttgtatttttagtagagacagggttttgccatgttggccaggctggtctcaaactcccgacctcaggtgatccacctgccttggcctcccaaacagctggaagtacaggtgtgtgccaccgtgcctgttattttagacatttaccttttattccttttaatttctaaatttaaatttatctcatcatatttagttttaatcttaatctttcattcttttttatattgatgtgaataaaagacattaattttgacataatatgtactttattatttcctctacctttaagaaagacatgaataattttaaaaattttactaaaattttaaaaattatgtttttgttggcaaataatcatatattatatatttatggggcacatgtgatattttggtatatgtttacattgtggaatgattacatcaagcttaacacatccatcaccttgcttatttattaatttgttttgtttttttttttttggagacagggtcttgctgttgcccaggctggagtgcagtgcagtggtgcaatcacagctcactacagccatgagctcctgggctcaagtgatcctcctgcctcagcttcccgcagtgttgggattacacgcatgagccactgtgccaggccttatatttttgtgttgaaaatatttaaaatctactctgacacaacttttactgatggggatggactcagggttggaagattagcacctgatagtttaatataatttcttatttttttgagacagactctcactctgtcacacccaggctggagtgcagtggtgcaatctcagctcactgcaacctccgcctcctaggttcaagtgattctcccacctctgtctccagagtagctgggaccacaggcacccccaccttgcaaggctaatttttgtatttttagtagagatggggtttcaccatgttggccaggctgatctcgaactcctgacctcaggtgatatcattttgtaaaggaaagagagctacagacagggatgtggagaagagacactaagggagagaagttcaatggggatttattttgcagggaaaggaatcataaaacgctgagcactgtgcagggtgagcagcctcctcagcctcctcagccttctctctggaaccttccatacagtctgcgtggttcactgtcccagtggcaagctatggctcttccttttcaaatcagcccttccaggcgcttttttccggtgcttgggctgagcttacagggaagcgtggctccagtgtctcttctaggttctgccggtagggggcgtgggagggagactgcaaggctggagggctcatttattcctgtttacctcctgttcagtccccatgaagccattctggctggtcctacctgtcaggagcgtttcattccagcaatgccagctgcaggaacagctgaatccagctagcaatttttccagtgctggcagagccagcttcatcctacttccttggacaccagccctagctgccagagccctttcctcagagctcagtgttcaggcccacagacccctcctctcaggtcagagataccagcaccggacagcagccctgaccccagaggtctgagttgcagctcacggggatcttcctccaagcttctccgttttgataattccagctctcctcttgctcgccagtccttggagtagctgcttcctgcaacagcggcctctttgattccctgctgcccttctctttgcctttcaagttacccagttagcaatgatttatatcaaattctcccggttagaataactggcgtcggttccatctcctgactggatcctgactgacatacttaggaatgcctgagaagtggattctcttctgggggcattgcaaagagaactactaagtattgctgcaggaataacttggggggaaataatacagactcgcttttcacaaaaacacagctgtgtctgagttgtactaatattgccttccctctcccattcgcttttctgccttataatttatttttcataatgtccagcaaataaaagtgtggtctgagaggagagaaccccctctctaaactgagaaagctgttactcttggcttcagctgttgccaaacccaaccttcaaaatgcctctctgagaagccagggagacctgtggttgatgcttctctggagctgtggtcctatctggacacgtagcaaatgactttattgtgggggctgcttcctggcagatcacacaaaccattccataaaggaagaccttcgtgtctttaaaattcacgtggaggctgggtgcggtggctcatgcctgtaatcccagcactttgggaggctgaggcggctggatcataaggtcaggagtttgagaccagcctggccaacatggtgaaacgccgtctctactgaaaaacaaacaaacaaacaaattagctgggcatggtggtgtgtgcctgtaatcccagctactcgggaggctgaggcaagagaattgcttgaacccgggagggggaggttgcagtgagctgagatcgtgccattgtactccaacctgggccacagagcaagaatccgtctcaagaaaaaaaaaaaaattcacgtggagagccattggattctggtaaactaagtcagtggtgtgctgcaagacagtggcaggcaggagtgcagagccaggcagaagccttcctgtctgtgccccagcctgactttgtgatgacacagaaggtggtggtatcccctcagatgggaaaagacacagaaaagcctctttggagggtctgaataggaatagtggtcctcatctcaaacacctggttagtttttagttatttatttatttacttatttatttatttttgagatggagtctcgctctgttgcccaggctggggtgcagtggcgctatctcggctcactgcaacctgcgcctcctgggttcaagcgattctcctgcctcaacctcccaagtacggggattacaggtgagcagcaccacccccggctaatttttgtatttttagtagagacggggtttcaccatattggccaggctggtctcgaactcctgacctcaagtgatctgcctgcctcaacctcccaaagtgctgggattacaggcatgagccaccgcgactggctacacctggttagttttgactttagggtcactatacatcacataactggatgttctctctttgcagtggctgctgaacattttatttttttgaaacaagatctctctctgtcacccaggctggagttcagcggtgcaatcatggctcaatgtaaccttgacctcccaggctcaagtgatcctcccacttcagcctccacaatagctgggactacaaggcaggcaccaccaagcctggctaattttgtatttttcgtagagacagggtttttccatgttgcctagggtggtctccaactcctgggttcaaatggtccacctaccttggcctcccaaagtgctgagattacaggtgtgagccaccgtgcctggccacaagctgaatattttagactcaagtttatgtctgacacctccagggccgtgtagaaatccagtggtatactacacattcactggcctgcctcctctcctgtccttttgcctgtttcttcacttttttaatttagatttttattgcagcatatatagattttttaaataaataatcagtctttgaatgtttgacatgatctagaggaaactgactacaacgtcgtttccccattttccatctcaacatttggtagagatgggctctcctagagtgagccaaatttacatcgctgttttgcagtggttaatgtagaatgtttttgcaatatcacactcatgacagggcacatccaatgaacatttgactgaagataacactagattccagaaagtatctagacactagaaagcaggcggtgataatggtagttaattaacaataacaatgtcaagtgtctggcttttgcccttctctaataaacctaaagaacagacattaactcggctaaatttgcccttactttcttacagccttcattatttaatttttgaatcagtaagcgcttcccacgggggtcaccttgtttgtcatcttgtcatctggctgtgtcccatcatcattagaaatacttgcaatttcccctttctcccatgtctgcatctattgggaggggaattatgctaatgggaatgctctatcctgacttgctatccgattagaacttcccttgacttttaaaacgctcctcctcgaaaagcattcatttgaattgtgcctaaagttattccagctgtcctgaggtattatctcagccaatcgttcttcctctggagcaagatctatttgtctatcgtagtttgacccacagttcccaacagattgtcagtaacaagagcccaggaacatctctgaagggctttcattgaaatcacagaagttctttagttcttcacttcattagtaggcattagaaaagctagtcaactttcttatttaatcaggtgcctgttgctttgaaaaattaccgaaaggaagaaaggagagactcacttagaggtatcactataggctgggtgtggtggctcatgcctgtaatcctgacactttgggaggccgaggtgggaggattgcttgagcccaagagttcaagaccagcctgggtcttgaacatggcaaaaccctgtctttataaaaaaatacaaaaattagccagacatgatggtgcatgcctataatcccagctacttgggaagctgaggtaggagaatcactgagcccagggaggttgaggctgcaccgaactgtgatcagccattgtactccagcccgaatgacagtgagacgcagtcaaaaaaaaaaaattactatatcatccataactaattattaattaggataactaggttttacctaagagtgaaaactcatagcaaactaaattatcacacgtcacggtgaattgccatagtcacggttcattccttttctcgcaactacaaaatgaatagatccagacccacttcagcaaggaatatgaaaggtaaacagcacatggggcccttagctgccttttgcaggaccctctctttttcttcctaaagtagcaattcacttatttctctaggtgggcacatcacggaaactgtcatacttaatcggagcctggagagagagattcaagcatctccctcacatctgcatagcaggaaggagcagagagaaatcgagaagattaagcagagagctttcatacccgagataacccagctgtgtgcaaaatcaagcctattgaacgcgaaagcactgcaccaccaaaataactgctttaaccaggaaggagaagaaccgatgccccaacagagcccggagagccacacagacacaagttgcatttcaaagtcgctgctgttgtctccaccccacgtgtctctgccttaacccttccttaccaaagttctgcctgatcatcttttttttcttttctttctttttttttttttttgctatacttctttgagacagtgtaaaccaaaatcttacctaaaagcaagatttgggcttttgacaacgttagccataggaaaaaaaattctatttttttgtaatctcaggcgactaagttaaaagttaattccaataaaacaacatttaacacttaactacttagggtactagccacatttcaactactccatagccacatgtagctgggtggctactgaattggccaacacagatgcagaacatgtccatcatcatagaaagttctctcggccatgggaggattacagaactcagcttcaagtatgcacatttaagtgtattcctaggagttttctgatgctgataggatgcctaaccagcttccttactgatcttctgatattactgtgaaagtggactaagaaaccaggattccctggggtgactcaggttatgtagaaattatgggccgggtgcggtggcttatgcctgtaatctcagcactttgggaggccgaggtgggtggatcacttgaggccaggagttcaagaccagcctgatcaacttggtgacaccctgtctctacaaaaaatacaaaaattagctgggtgtggtggcaggcacctgtagtcccagctactcaggaggctgaggtgggagaatcacttgaagctgcgaggtggagactgcagagaggtgagaatgcaccactgcactccagcctgggcgacagagcgagactctgtctcaaaaaaaaaaaaaaaaaaaaaaagggaattatgtttactcttgcaggcctccaggcctctgcttgatttgggatgtaaaaggagacttacctgcctactctttaaagtagcctctcaaggtccccttctcgtcgtggtatgagcctcatttcttgagactcttatttctttccaggatttatggcatattctggagggagcggattcagacagaaaagctggctctctgctagttttcccatgggccagcccccttgtcagtgaccagtctgcctcactgtgtgatggacagtgtgtcctgccactggtaatggaaacccagcaattgattggtcgttaggttattttcaaagctcaatattcagaataatctaagagacgccacataaccacaaggacacacaaggctctcataaccctctcaacacaaggcgcacttttcttctttccatcccagcaacaaactgacaacccagtcagcacttaagttgggggaaaaactaattaaaagaagaatctaccacctataggttaaaacaaaaaaacgcaattgcagctgtcttctccatgccagaggcctgtggtttgaatttcaatatcttcatctactttctgtcctgtggttccttttattctttatttcttgtcactatctcttatttgtagacacaaatgttccatattaaaacctaatctttaaaaagagaaagactgggctcagtggctcacgcctgtaatcccaacactttgggaggccgaggcaggaggatcacttgaggtcaggagttcatgaccagcctgggcaacacggcgaaaccccatttttactaaaaaataaatacaaaaaaaaattagccgggcgtggtggcatgctcctgtaatcccagctactcggaaggctgaggctcgagaatcacttgaacttgggagtcagaggttgcagtgagctgagatcgcgccactacactccagcagcctggatgacagagtgagacgctatctcaaaaaaaaaaaagagagacagagaaacaaaatatttttttaattgcataaaatcctaaaggtgagatccacaggctcatgccccactgattggaatgcaaaatgctacaatatctctggaagtaatttcatccagaccaatcagtgaccttaaaataatttgtaatcttggacctaatacctctactattagggagctggcctacgaagacttctgcccaaggatggtcatcacagtattatttataattctcccaagctgaagagaagacctgaaatgttccaaagagggaaatggttagataagcaacatatttataaacaacattccagagtgttctggaatgtcatacaaactttccaggtcatgttttagaagaacaattaatactacaaaagatgctcatattattatgttaagtgtctatatcagtggtccccaatctttttggcaccagggactggtttcatgaaagacaatttttccacggatgggggtggggtgatggtttcgggatgattcaagcgcattacatttattgtgcacttaatttctgttattattacattgtaatatataattaaataattctacaactcactatcaggcagaatcagtgggagaatcatggactggaaccagtccatggcccaggggctggggaccccctggtctatagtacaatataaccctgtgtataaaatgtgactttaacacaggccccagtctttttgtctgtaaaatgtattaattacattgtccttccccttttaaggttttctgcaagagttaaagaaaatacacctcatcaattgcttagcagaatgctcaacactagcaggacagctataaatgtcagctaatcatcctaggtaaccacacacacacacacacacacacacacacacacggagggaaggagaaggaagattaggaagcaacacacaatgtattagtaggcagtggggttactagtgttttttatatacttttttatttccctctttatactgtttacattttcagtgttatacaataagcatacattacttctgtaatcagaagaagtcagtataaacctcaccttaatataatgaaacaaaattgttggctgggcgcagtaactcacacctgtaatcctagcactttgggaggctgaggccaggggatcgcttgaacttaggagttcaagaccagggcaacacagtgagacttcatctctacagaaaatgcaaaacttagtcaggcatggtggtgtgcgcctgttctcccggctacttgagaggctgaggtgaaggatggcctgagcccagtagatggaggttgtagtgagctatgatcacactactggcctccagcctgagcaacagagccagacccagcctcaaaagaaacaaacgaaaccaagcagaaaacaaaaaccaaagttattgcttaaatcctacatgctgccttgaagctattgtaggccagagttctggatgtaactgctgagggataaagtgtgttgttcagggtgccaatggccctgggctcccccaggtctctggggagggctgtcctctctgtcacagaaaatgtcattagcacactcacccactcccgccttactcatatgctctcatgttatctaccgcgtggatgctgcagggggtgacatcctagttagtcccaagagccagactgcccaaagctcactctagcgagccctgccttggggaaggaggaggggactctgcgaacctcctacctgggctgaaggaaggccactcactcccccacccctcccaacctcagctgtctgtgctcctggtaggccactcaccccctgcctacaggcttggaatgtcaaggccatgatgacctctggcctcccctgaacccagagctttccctttacaaggaaggggagactgagacctggagcagggctaagaaaggcacagtttgggactctggcctcttctcatgcacctgtatctgtcccatgcctggttcccattcccggatccttggaagatccatattgatgaaacagtaaagggtgatgggcactgaaaggccgctaagttgctccctgaactttttcccctcccaaactctcctgtggtcttcagtatttaacaggaacctcttgacactctggaggggtgagcttctcataggaggcccgtggtagggaggctgtgggagaggtcaggcactgtataccttcccaccatctgtgaatggttccatttccaaggccacagtaaatgcagggttgaaggattcctcccggaatccttccttttctcttcctcactttccttgccttgtggcctcatcactccaatatctctgctgccgtcttcacatggcatcctcctctgtgtgtctctcctgacacttttcttctcctgacacttgataattttgtcaagttatttgacaaaataattggatttctgggtgcctctatccacgctggcattttaacactcctgtggcagattgcataggctccctccaaagatgtctacctggttcttgtgaaagtgctgatatttggaaaaagaaatctgtacatgtagttaaatccagcacctcaagatgtgatcatcttggattagggtgggccataaatccaatgacaagagtcctcataaggaaagtggtgggcatggtggctcacgcctgtaatcccagcactttgaggtcaggagatcaagaccatcctggctaacatggtgaaaccccgtctctactaaaaatacaaaaaattagccgggcatggtggtgggcacctatagtcccaattactcgggaggctgaggcaggagaatggtgtgaacccaggaggcggagcttgcagtgagctgagattgtgccattgcactccagcctgggcgacagagcgagactgtctcaaaaaaaaaaaaaaaaaaatagctggacatggtggtgcatgcctgcagtcccagctaatcccaggagactgaggtgagaggaccacttgaacccaggaggtcgtggctgcagtgagctgtgatcatgccactgccctccaacctgggtgacagagtgagaccctgtcccaaaagaaaaggctcaggagagacacacagaggaggaagccatgtgaagatggaagcagagattggagtgatgaggccacaaggcaaggagagtgacaaagagagaaggaaggattccaggaggagccaaccctgcaggcatctcaatttcatacttctggacttcagaaaagtgagagaagaaatttctgttgtttgaagccaccaagcttgtgatactttgtgccagcctgctatagcctgaatgattatatctccccaaaattattccattgaaatcctaactcccaaagtgatggtattaggagataaggcctttgggaagtgattagtcctcttgtaaaatgggcccaagggaggtcttttgcccatttcaccatgtgaggatggagtgacaaggtaccatctatgaaccagaaagtgagacccaggcaccaaatctgctggcgccttggtcttggacttcccagccccagaactgggagacattcctgttgtttataagctacttagtttatggtgttttgttacagcagcccaaacagactaacatgcaacaaactaatataacccctgaattccagaggtcctggaatgaggtccctgaacacataccctgcaataccctgccttcttatatttgctcaaactcaaccacacagcatggaccttcagtatcatttactgagcacctaatatgtgccagccaggagtaggtgctaaagaccacagatggacaagtcagggtcctggcccctaaggagtcagtcgtaagcatctccaatagccgcactgtatcatgtgggccttgactgtggatttccgtctttgtttgttgtttgtttctttgtttgtttttgagatggagtcttgctctgtcacccaggctggagtgcagtgacacagtcttggctcactgcaacctctgtctccagggttcatgtgattcttctgcctcagcctaccaagtagctgggactacaggtgcatgccaccatgtcctgctaactttttgtatttttagtagagatggtgtttcaccgtcttgaccaggctggtctcgaaatcctgaccttctgatctgcctgccttggcttcccaaagtgctgggattacaggtgtgagccaccgtgctcagccagatattcaatttttaggaagttttatcttatgggggaaagaaaatgaaatttttagtttagaagaactaggttcctatccccccatctcacttccctggtataacagtactagtcaaataaattaatgtataatgtttgagaatataaacaacattattagctaatttttttgagagcttacactgtattagctctattctaagcatgtcaatcacttaatcctctcaaaaaccctatgtggcaggtactgtcataatccccaatgaacaggtaggagaaaaccaaagcttggaaaagtgaggctgcttgctcagtgttcctgattcagtgagaggcagattctgggtttgaagtcacgtgggtctggtttgagggcctaagctttgaattactgtgttccaaaatagctccttaaggcacgcatcactattgcatggaccagaagacagaggttcaggtatttctacagaactgctataggaatcaaaccgtatcatgcgtgctatctgtcaagagccagttcctatttctcttaaatcccatcctcctttctcctgccatgataagatctttagggtcaaagattgtattctacttatcttgggtcctcctccagcttagcctgctatccccatcagagcaaatgataattgtgtgtctaccacaggccaggctggatcgtgatgtatttcaacgttccaaagtcctcgaagcgtttgaggctggcaactaacagttaagtaagaatcacaagaatgattcaaattagtgtgaaaactgtcatgcattatagcacattataaacccatttcctaatggaagttgcagaggggctgccatgagagagatttaagtttgaagggcttaaaagcctgattatctctcagtgatgcctcagcactggggaagtggctgcctggtgtttctctctgtgatggagacctgtgtggtgtaatgaagcagcacagagctctgagatgatgcctggggtacagacagacatcccctgtgatccttccaacagtaagtctttgttggggctgcagaaaaagtgtcccagggtagctccaaattgcatctcttctcccagggagaggaggtgagctgtgcccttctacccagcaccacacccctcaccttccctatgggatccccactaacaaggggccaccaccgatatccagtggcactgaggactgcaggagcagcatgggaggagatgctttgggagaatatgaaggacaagaggttgcacatcactagcctttgcctgcttagaccttttgtttctagggaaaggtggaacagctcccattatcctttcagcttcatctaaatgacctccaccccacccccaccttgtcagaggacaaaggcgtggatcagatgtttgctgtgagctcctagcatccagggatctcatttcccccttaatggaaaagcagatctactcccccgataccgaataaaactccttagtctctgtgatgtccgctgccagctcagctctcccactctagatgctggataccatgaaaaaaacgatatacacacagtagatccttaatgtgcatgaagatgtcttgaaaccagagtaggagaccaggaggatgactgatacttgttgtgggcaataagtgagttgtttttagggaagggatttcaaaatttggaaactgtaagtaccttaatgcctttggaatgaactgcttagcacctatggtggctgagcaggagatgctgggatggtttacttatgaatgcatttttcatgatggtccaggtatatgtttgctgtatcttttttctctgaccttaattctgctgccatgaagaagaaagtggagtagatttccctcaagggtgtgaagccctcggagaagtcacttacggcaaaccacatgctgggttcagaaatgtaggataggtcagatgcagtggctcacgcctgtaatcccagcactttgggaggctgaggcaggaggatctcttgaggccaggagtttgaaaccagctgtggcaacgtagtgagatcccatctttacaaaaaatttgaaaattaaccaggtgtcaccacacctggtatgtgcttggagtcccagctccttaggaggctgaggcaggaggatcacttgagcctgggaattgcaggctgcagtgagctatgattgtgccaccacactccagcctgagtgacagagaaagaccctgtctctaaataaataaataaataaacaaataaataaatacagggtacatcagaaccttcatggttgaaatgatgaatatttattccacatgtactatggaccaggtactctggtaattgctctaaaagcatgatcttgtttaattttctcaacagccatgtgaggtaggtgctgctattatctttgagctcagagagggtaagtagcttgtctgaggccacacagacagtcatcagtaaagccggtattcaagctctggtccaggttttaacaccaccaaagattctcaaagtgaccagtcctgatgggactagatcatccctcaggttgccctgggctaggatggtctgcacaaacaaaaccatcccacagaataggagagccagagggaggtaaagcatggcagcaagccagcccatcatgttctctgtctgtataaatcccaccctcaattggagagtctccccactaggggtggtgatatggtttggctgtgtccccacccaaatctcatcttgaattgtagctcccataatccccaagtgttgcgggagggacctgatgggaagtaattgaatcatgggggtggtttaccccataaagttctcatggtagtgaataagtctcctgagatctgatggttttataaggggaaacccctttcacttgggtttcgttctctcttatctgcccccatgtaagacatgcctttcaacttctgccatgctgttctcgtgatagtaaataagtctcacgagatctgatggttttgtaaagggcagttcccctgcacaagctctcttggctgccgccatgtaagatgtgcgtttgctcttccttcgccttctgccatgactgtgaggcctccccagccatgtggaactgtgagtccgttaaacctctttttcttttttaatgacctagtctcaggcttttcttcatagcagtctggaaatggactcatacaggtggtcctcagagtccttggaaatgacacctcctagagaagtacagagcccagcctgcagaactctacctggaggccctgaacacagatcttcaaaccccaacccacatcccatgtctgggcagtcatgctgcatgaagtcccaggctgggagttggctgacattggatctagctttgactgtgtcacatacaagctgaacgaccttagacaagtaactcaacctctctgaacctcagttttctctctggaaaataaaagagtgagtttaaagttctggctagctctaatgtcctataacctgtctcatttgaacccaaaatatttataccttagtacttaatatacattatcttgtacagcatttttatttccatagatctctatttctaccatatttttctaaaaattatgtttttcttaggtaaaacctctagatcctcaattaatgcttaatgagttttgaatgtttatagtcctattttctatagataatcttgtgtttgatatatttcccatgtgcctagaagtctaccatcatggcatctcatgggtagaacaaaaattgtagcattctgtgaaatatagaaaggaaggaagccaactgtgatttttaaaaacctgctttgtattgtgcctacatataaacaaagaactatctacataatagcctccatactaacgtacactttaacatcataatctataggaatgaattgcaccaataaatctaacaggcttgggccaaaaagaaacattgttccagtttttttgcaacttattattgaggctgaattagagcaagcatgatgaattggatcacttaatgagattaaagataaaacatatacagttttaaaacaccaacagttggactattgacatggcatgagagtagccagttaagttgggaaaaggtagataccatcaactagagaagccattgtctacaaaaagcaattgtcttaacgaaaaagccgtggaaaataaatatattccagtggctccaaagttattttaaattccatgtgtacagttcagcgaaaaacaagccaggccctaaaataattaaagccatcaatatgaaccacttgagtttgaaaggatccaatatttctcactcataaaaaatgaaataacgtgtgcaatttggttctttgccatctgctacttgaattgcaaggtattgttaaaaagttaattgaacacccaaatataattattaggactatagaatgcctaatctttgccaaatcattcaagaatggcttccttttttactgtaattttaaacttcataaactaaaataacgaaagtaattttatactttgcaggctctccttcttagagcaaaagaacattaaggaagtggggggaaaagcaaatttaataaaattgtgtgtaatgacacaattccccaccgaatacggtggcaaggtgttcagctgtttctcccactcattctgaaagcttttcttagaggttctatttgaggatcttgggggaagcctagagagaatagtgccggcatatgagcgaaggtctacattaactaatcagtcagttaactcaccaagtttaacccaagaacgaggaaagcctaccgtgaaattaactatttcacactttttaagaactttgtcatgggagtctcagttgctactgtccttacttcgtagctgcccctgcatgtcgaaggggaaataatctttactctcctgctcaggttctttgattttcttcctggaaggaataaaaaaaaaaccacgttgttttcctcttgaaaatcctgtgagctgagattgcaatctccatgggggaaagaagttccactacacgttctgtagcggcacctaaggccatgttgtgctgcttttggacgggaactctatgtctgggtgtttgaaaccccaccagctttgtacaaactgtgattattccaaaattccgtcccggggtctgagatttagtgaataaatgtgactcaccccatcctcactattcctaattaaactgacttccaacctactcaaactcagttccattttctctcctctgtttctaagcaccccgacattttaggactccttggtttctttgcatcttcaaggtaaattaacaggaatcacgtttgcacttccaataggtacaggaactgtatttgctcaaaagtggaagagaaggctgggcgcaatgactcatgcctgtaatctcaattctttgggagtctgaggagggtgcatcacttgagctcaggagttcaagaccagcctgaccaacatggtgaaaccccatctctaaaaataaagaaaattttaaaaatgttctaaaaagtagaagagatttgattttgtctgattttgtctgaaatatccttggtcactggaagaggctatgttttcaaaagaggatgcaaattgccagtcttgtcgcagccacccgttcgccagcaagtccttctccttgattttcagattcccaagacaggaaccaaatcgttaaactctttgtctccagaacctctctttgtttttctccttttccctgcttcccatgctccctctagttttctgatgtatatttcataagtgtctatcatatgcctgaaacatggctgtgtaggcaaggagggtctccaccaggataatgatccttcatttctactctcttcttttgcattctgtatctagacgcttcccaattccataataattcagtttgtttaacttagtccgaaatgcagttgaggattttcctaaatattatacacactgatcccaaggacaagggaacatgctgggaagtcctcctgacagccggtcaccgaacaggggggcatggcctccatgggactgactcaagatcaccttcacttctctgtcactatacttgattcagttatccttttagtttaaacattttactatacagaatgtttccaaataaatatgcaccttgacccagagagaattttaaaaggtgtcaaataaaattgtcccaaacatcaatccctagggagcccatgatttctactttggaccactgaaatggtttggccatgtccccacccaaatctcatcttgaattgtagctcccataattcccacatgttgtgggagggacccagtgggagatcactgaatcatgggggcggtttcccccataatgttttcatggtggtgaataagtcacaggagatgtgatgggagatgtgatggtttgataaggggaaacccctttcgtctgggttccactctctcttgtctgctgccatgaaagatgtacctttcaccttctgccatgattgtcaggcctccccagcgatgtggaactgtgagtccactaaacctctttttctttataaattgcccagtcctggttatgtctctatcagcagcatgaaaacagaagaattcaaccacccaccagggtcatgaggtggtggcctagtcaaagggcatcagggctgaaatccagctggctctctgcaacctaggcgctggctcccagacaggtctctgtccacttatagagaaggccaccttttgaaaattctcacgcaggtgctgtgtaggctggcagggtctccaccaagatagtgatcatttatttttactctctctctctttttttttttgctttgagacagagtctcactctgtcatccaggatggagtgcagtggcactatctcagctcactgccaccttcacctcctgggttcaagtgatcctcctgcctcagcctcctaagtagctgggattacaggcgttcaccaccacacctggctagtttttgtatttttagtagagatgggtttcatcatgttggccaggctggtctcaaactcctgacttcaactgatccacccgcctgggcctcccaaagtgctgggattataggcatgagccatggtgcccagcttatttctactctgctttttttgcaatctatatccagacacttcccaattctatcatgattctgtttgtttaaattggtatgaaatgcaattgaagattttcctgaagattatacacaatgatccccttcttacccatatgcccattcacaccagcagagaaggtaactgaggaatttgactaacttcttctttcatccagtgggcatagttgtttaaatgttcattctctgccacagattagaactcaaaacagctgaggtatcatcctttggattaacccactagctttcagtcatagttacataaaaatcatcataatcccttacatttgtataagattttatggtttatgaagttctttgtatttacaatctcatgtcatctcatgtgattcgcttacattgcgggaagtcacagggctggattaaggtgtgtcttagtggctgggcacggtgtctcacgcctgtaatcccggtactttgggaggcccaggtgcggggattgcctgaggtcaggagttcaagaccaggtccctcccacatgtgggaattatgggagctacaagatgagatttgggtggggacacagagctaaaccatatcattctgtctctggcccctcccaaatgagcctggccaacatggtgaaactctatctctactaaaaatacaaaaattagccgggtgtggtggtgggcacctgtaatcccagctatttgggaggctgaggcaggaggatcacttgaacccaggagccagaggttgcagtgagccgagattgcaccactgcactccagcctgggcaacaagagtgagacttcatctcaaaaaaaaaaaaaaaaaaaaaaaaaaaaaaaaaaaaaaaagatgtgttttagctatacacttggtaatcatagtaagaaggggataagaggaggggctaggaacataggaagtaagaggaaggcaagggagagggatacctgtgagaaagccagatacacaaggctcaattagtttgacaaagagagatggaaacacaacaacaaagacatctcaaaagccagtgtttccagtttgttttgcactgtccaagcactagggtaggttccctttgtgaccacaggcatcttgagtctcaggatccctgtcttaaggggcaaccattcttctgtgttggaggacacccattctgtcccctctgcccgatgcttttaataaggacctaggtatcctggaacctatgtcaggactgacaagtgaaattaggtaatccacaacctcccacaaatattctctgagcacctactttgtgccagcgcattctgatgccatcagaaatttgcaaagtaatataactcttcctattcacaaatgagggacccgtgcttggagatggtcaggcagctctctgaggtcatggtacaaggtggaagctgacctcaaattccatcatgtctgatgctgcaaacctttgctttttctactgagtcacagtgctcggtgtgatcctgactgttcccaagaactgttttgtttttcaagacatgagagtacacagagacagctaagccccatgtaacaccttcagagaagggactggggaacttcagaagtgcccagggcaagctgggaggctgcctgtgtgcatcctcagtccagactcatttagggaacatagtctgccggcggggaggagaaatgatgtttttggtcaagacttgaattttttcagatgtttaatcacaagcgatgctagtcctgcctgaaaccctgaactacttgctattgagagtgatgaaagtacatttccccctaattcaagataagagagaagggtggagatttctagaatgtatgtttccctatctattgcgaatggtgtctagagcctatctgtgaagtgacgaagcagttttcatgccagggtgtctactgtccatgacgaccatgtggtcctgacaatcccgggtctgggttgtcctctgctgtcatcccagaacttacgttctagtgattagcatccatttgcccttgcccttctaaatgacgaaactgttcagcactgatgaactgcaacatatcatcgtactcaaaggggctcccacacaccaagtcagtggtcagtgtgagtcacctccaccaagtcaagcctcaaagtgccttgtttatatggccccacttcgggaaacagctctggctttatttggtggcaatatgactaatttgtcatgctcattcaaagataaaattggccgtcaacataaactcctttaagcactttgtggtaaaagcaggtgagtttgacttttagggaggtgatgttccccattagtcaatcccctccatgccccaaagggggtgccaggatgaccccatctctatcccccgccttgaggccaataattgaattttttgtatgtgggttctcctacatgaaattcttcacattgccatactgtctgaaatcccaccgattagaggaaattcacttatcttgaaagctttctgattctgcagtaaatgactcttaaattcgctgacctcagtgcagcagtgggagtgtcagagaccagagtcattcaatagaggaccagcagaggaggggtgcctccatggaggcttggcagccctggcatacaagaggcaaccagaggagttggctgagttgcgtgtgtgtgtgtgtgtgtgtgtgtgtgtttgtgtgtgtgtgtgtgtgtgtgtgtgtttactgggggctcccagagctcagaggcaggtggtatcagggaccaggaactctactgtattgattggactgaagagcagaaccctaccatattggctggattgaggagcaggaacctgactatttaggctggactgaggggcaggaaccctaccataatagtctggattgaggagcaggaaccctgctgtattggctggattgaggagcagagagattgaggaaagacttcctgaataaacatggagaacatgcagcgaatggtggcaagacttgggaagaggagaatcaaggtgcaaactcaggttcctccttgatggggcaaagcagaagcaagatgatctgatgctgcagggggctgccctactgccctgaggccccttaacttttcttacctggatcagcacagttgtgagagcttagctggaggctggctgtccataggtcagggataactgctccatctgtggagggtagagaggctttggggaagggagccaaggggagagcattggtggagatgtggcctaatttcatagcctggagaatcaagaaaattcagctcaggagttataccaaatacaggctcttttatcctagtgtgttagggccaaccctgaatggcgtgatctggagaggggaattgcaacattttgtctttttcaaaaccaaattggtttgctttagccctaacatcattacttttaaccttagggagaagtctgactatatctgtacttcttaatctcttgctctgttgcccaggctggagtacagtggtgtgatcatggctaactccagcctccaactcctgggctcaagtgatcctcccgcctctgcctcccaagtagctggaactacaggtacacagtaccacgccgggtaattttttttttttagagatggggtctcactatgttgcccaggctgatctcaagctcctggacttaagcagtcctcctgcctcaccctcccaaagtgctggggttacagatgtgagtcacaatgcgccgccagtgattttgtttctgaacctgtctgtgttattggagggtctgcagttgaagattgggtagtgaggccccagtttgtttttctagataacaggcttaaaaatgattgctgcttctcaggaaggtaggtaattacttcttgtaggttttgcggtctctgtctttttaaagggagaaaatgattgttcatttgcccactaccacgtacatgccatatgtgtccaatgtctcaattttagttcatcagcgaagtatgaaattattttaaaatggcatatctttcgatattcaaatgagactcaatctggcatggaaaaatacaggatgttaattattctttgtgcatataaatcagctgtgaaatcacttgaaactcctgtatgtttgggttctttgtcgacagggccgaataattatcaacaaacctcagtgagccttgcttagcaaaaggtctcattattcaacgtgagtgtagctttgaacgtggaagtagaggtgctctctagcgtgcgaaatgcgtagccaagcttggcccctgctgagcgtacctggagaaggtaagtgatgtctatccagttgcccaatcatcagaatcatctttggagagcagaagatgtgagaaacttgacttgattagagtgagagagagagagaaatagagaaaccaggccatctgtaacagcagatattctaaatcaagagtaggaacagatacttagaaattagaagctacttcttacaaatgatattcaaatgtgattcccatcatatatgaccccgtcccactcaaattgtgtttctctccatccctctccctccccactgcagaatcaggccatggtattgagtagaagaggactggagtgaaatctccttggaaaaaaaaacattgtttattgttgatttcaagtggcactgtggctttggtgattgcaacaggctctgtaggccaggtgcggtgcctcatgcctgtaatcccagcactttaggaggttcacctgaaggcaggcagatcacctgagctcaggagttccagaccagcctagccaacatggtgaaaccctatctttactaaaaatacaaaaattagcctggcatagtggctcatgcctataatcccagctactctggagactgaggcatgaaaattgcttgaacctgggagtcagagttgcagtgcgctgagattgcaccactgcactccagcctgggcaacagagtgagttgagattctgtctcaaaaacaacaacaacaataacaacaacaacaaaacaccagtgacagccactggcctagtgattctcacctcccctgagatgcagacttctagggtccacatctccggatggagcaggcacaactgctaggcaaagtcatcatggtgcctctccccagaaccaccttttctccattgggaccaggaatgcctgttccctcactgtgtgagcaaggagaaaattcttcctttcttcccccatatctggagtggaggtcaaatccaggcttatctcttggaagagctgctctctagaaggcaacagactacactgccgttggctcccctgcattttctttggagttcttggctcaaaaagagccaaataggggctgggtatggtgactcatacctgtaatcccagcacttttggaggtcaaggcaggaggatcacttgagccaagagtttgagaccagcctggacaacatagggaaaccctgtctctacaaaatatcaaaaaattagccaggcatggaggcacacaactgcagtcccagctgctcgggaggctgaggtgagaggatcatttctggctgggaggttgaggctgcagtgagctatgattgcactactgcaatccagcctgggtgacagagcaagaccatgtctcaaaatgaaaaaaaaaaaaaaaaaagagagagagagagagagaaagagagaataaagccaaatgcaacatatggctaaaagaagatattctagcaaccccacatctccctgtcgttggactcccctctgcaacccatgggcacctgtgggatagatactccatttctctaccctcattaactctttcctgctaagcaacaaactgaaaagattttcggggacccttctctaatatggatcatctgcatcgggagtttgccctgcattccctcaaatcacttcctttgaaaagggacatacattgtccattgctctgctcaggcgaggagtcctgtggctctcacaaacaggacggggctgctttgccccatctgatggaaagaactagctcctctttcaaatccgtgcctcttctctgccaaaagaaaaaaaaagtgtgcagaaagccagctccataaaaatagcccggtttctgaggaatgtctcaaagaatcaaggtcctcatttctaaaagtgttgcagacacctgcagctctgcctctgtgctccaagatgtctctgctttctctgccatccttgttcttctgcagcactttgtagctttcctagaacacttgccacagtgacctgcatatgtgtccacctccccatcaaaggagggccctgtgagagcatagctgtggtttagttgactttgtctttcttccctcatttccactcctactcatactgggcagaaagactttggtcccagccaattaaaaggccagttaatctatttaccagggaagcattttggacagtcaaaattgtttgcactttgattaaattttgattttttttttctgtgaagagtttcaaagtattagcatctggcaagtcagcctacgtggataaaatttcaactgttcagggccccacctagattccagtcccaaagcagcaaaagataagagaaggaagcttaaaagagtctctcatttatctccttggagcgtatgaattttgatgacagactatgttaagaggagagaattgactaatttcatttcactggcctgaagctatggggagacaggcctcaagttttgtcaactttttttgtaagtctaacttgcaactgatgtagagcaggtccagaggaagccgttattgacctacttaataaggtagaaagaaaatatccaagagggctcaaagaaatacaatggcaaatcttcaataaatgtgctctgccccctctcatcatgatgtacaacatctgaactctaaaaatccctaaaaatgcaagtgtcccccatagtaacagagtcacctgactgcaaataagcttgacattcttattagaattagcaggaacagtgaaagaataaatatacaccaggtggcggtaagttaataatattttacaaattaacataaaacattgctgaaaaacatttagcctaaaatcgtcactactaaaatcatcattttgaacatattaaatttataaaatgtaaatgagaagtatggtgaaacctcatccccaaccctcaatcccaaccccgtagccaagaatgtggaaatgaaggaagaaaagctttcaaatcaacacctaatggattaaagcagagagacaccaaactgcttcaaagaaggcaagaggtcctagggtagcaagaaaagtcttcaatctgatcgaagagattaatattcccaagggaaaccgtgccttcatttgcatgaagtgggtcatctatggaaacacagtgaaaataacaaaaggaaattcttttagatgagatttggcccggcttccatgcactgtccagggcagagggcagccagctgacagctgatgggacagagggatgtacagtctgcttggcaatcccctcccgattgtgaggaacacatcaggctattgcagcctgatctcattacaaattcacaccattaacccccttgttctgattgcatgtgcaccaaacaaccttctgatgatttgcttccctctgtagctcttctgtaagtgatagaagaagctggttagacagacatgtgtatctgttctacctgccagttcgatttctcctgatacatgaataaactggcgtttgggttctagatattgttgctcagaagttttgtatgagtcagaatctcccagtgtgttctagggccatctcaaaggggtcatttcttggccaaagctgacctctgggtggccagatattctactgataaggagctggtcttgctagttcctacaagtaaatattctaaagcaatgtgtaacagagcctttttcatctatttgagatttgaagtaagtgtccaacatcaaagttacagtaacgttctctctcaggtcacctccctgcatgttttttttaaattttaaaaaattttactttaagttcttgatacatatgcaggtttattatgtaggtgcacatgtgccatggtggtttgctgcacctgtcaactcatcatctaggttttaagccccgcatgttttccctgggtgtgagttatgtgcagaggactcctcagtaactccatgcccagctctgtctcccaagcctggaccattcaacagctcactgtacctctctccttggagatcacgcagacacccaaagttgacatgttaaaaattgtgttatcatcgtatacatcagtgtgtttcagctattttgtgcctgttccagagaccaggttgcttaaactatagaaatgtacagtctcacagttctggaagcaagaaatgcaaaagcaaggttttggtagggttggttccttccgggcgccatactggaaggatcccttataggcctctcttctgggctggtagatggccatcttctccctgtgtctttacatcttcccatggtccatgtctgtgtccaaacttgcccgtgttctaagggcatggcgggttaggactccaacatataaatgtgaggagaacacagttcaacccaaagcaccatccttcattcgtcacctcatcaaatccatggaactgcctgcaaggctccacctcacgagggtctctcggtcactatcactgccctctgttggcgttcatcattccttcttgcctgtctcctggtccgctttactgccctcctgctccccgctgccttccaagaccccaatcgactcttcacacctagactgggaggtctttctttaaaacacctgacattgcccttaaagtacttcaacggagcccaatgaccctcctataaagtcaaaattccttgtcacagttcctcaggcctgccacgatctagtgcccacacacccagcctcatggctgaccactccccacgagggctgcacatgcccgcaagatggatctacttccaattccctgaaggtgccaagctttcctcttgcacccaggcacttgggcatgctcttccctcagcctggagcactctggttcaggttcatctctttagtcgtcttctttcttctttccccttcctcctcctccttctcttcttcttctttttttttttttttttttttttttttaggcagagtctcactctgtcacccaggctggagtgcagtggcacaatctcggctcactgcaatccccacctcctgggttcaagcgattctcctgcctcagcatcctgagtagctgagattacagacatgtaccactaaccccggctaatttttgtatttttagtagagatgaggtttcgccatgttggctgggctggtcttgaacccctgacctcaagtgatccacccacctcggcctcccaaagtgctgggattacagatgtgagccagggtgcccagccctctctttagtgttctagcctccccattcctatgctctcagcttgagcgtcacttacaccaagcctgcatgaggtgtcctctttttgttttctcataatctcctttcttttactcataaaatactgaaatacccaatttctgcatccacattcttcactagactggaagctctaggatgcatgagatgctattggtcacacagtcgcatctctagaccccagaacaggttcctggctcatagtaggtgttgaccagcattgctaagaatttgttgaaaatgataactttgtgactattttgctttctaacaaagttttctggccagaattttttttttcttttaacggagtcttgctctgtcaccaggctggagtgcagtggtgcgatcttggctcactgcaacttccgcctccctggttcaagcaattctcctgccccagcctcccaaggagctgcgactacaggtgcgtgccactatgctcagctaattttgatatttttagtagagacagggtttcaccatgttggccaggatggtctcgatctcttgacctcatgacccacctgtttcagcctcctaaagtgctgggattacaggtgtgagccaccgcacccagcatagaagttttaatcaaatcattttagattcaaatgttgatagttggaagacttctgtcattattcttgttgcaaaactcacacccaggaattcaaatccaatttatatcctcacagagcatatacaatgacgatatattcacaaaaatacagtgaccatatgtccccacttgattgggaccatccagcttaagtttattgtttgagcttaattattaataatgttcccattgactctcctaagggctctggcttgggtgattaattacctactcataagccaatttacaaatgtttaattttgtaggtgaaaatagtgttttgctaaccctgttttatttgaagaaagcaaaaagttattgtccaaaatgcagaatgaagtttatttgagaaaatcttgtttagttagaaacaagagggtgatatagccagggtttgtaagaggcagacttttaacctgcagcaaaagtgaaacaacgaatttgagtcaacttgcaaccaacccaacaggagattcacgcatctggagtaattgagttaaagcagattaggttctggattaatacacatcactaatttctatttgtttgctttttttttttagtaattgaaaaatacatgcaattaatttctgacatgaagaaaaattacaattaatccctcactgttcaaaagcagaattctaggagttaggtcagttgtctagaacttctggatcagatgatccaaggttgctttgttatttagtttaaagcactgagtattcccacaatagctgtttaagcacggtgtgacagtagcattaaaatatgccccacggtctaacacgagccctgctggaatgacctgttcatgtggacttttcttatctttgctccccttcagcagtgctaatgttggagaaatgttttttcttgttttttttttgtttgttttttgtttttttttaagatgctaaaaccaggccttttgaatggtgggaggggaagagaccctgaactcatttccaggataagacaactttctcatttgactagttcaatttttttaaaaacctacttaagaaaatatattctaatagaggtaataaaataaagcattgaccacataagcattgacctaggatttaaacacattatttaaaaccaagttggttgcatgggtggatatgtgggttgcacatatcctatcatttaaacttgtgctactcaaaatattacatttctttaagtagccccacttttgaaactaaaagcagctatggaaatacgtcaaccagagaaacttatgtactcttacaaaataaattatgtactcttatgatttgagcaattgtagctcactgcagcctcgacctcccatgctcaggagatcctcccactgcagcctcccgagtagctgggactacaggtgtgcaccacaatgcttggctaatttttaaaaaaagatgtagagacagagtctcagtaagttgcccaggctggtcttgaactcgcgggcacaagccgtcctcccacctcagcctctcaaaatgttgggattacaggtgcgagctactgaacccgacaacccacacacacatttttattttaaaaagcaagccatttaacatcaacacatcctatataaaatataaaactaaaattctgactccctagagctatcacattgtaacaaagctgaacactcatacaatctagctatcctgtcctctctacatggggtcattctgccccaaatcaaaacatgaattgtcctatgaactataaaagttgagttcatgccctttgagaattggtggaaaatccaatttgcttctctccatctctgtctatagaggaaggctgatctaattgtgagagaggttttcagagctcaactgcacagggagcttcttataaatagttactacccatctttctaatgacagccatgtatacacatttctgaataaaacacaagcaacggtgcacacctctcctttacagtccatagaagttcaccacagttgctcatttcccaaatcagaaatgtggggccctctcccccctagcatcttgggacaaaaacaccaaatttaggtaccattttgccagttgttgttgtcactgaagaatggttaagaacgtggaatctggttcctgtagacctgggtttgaggttcaactccattaagtacaaatgcgtgtcctgtgcaaatttctttagctattctagggttcactttgcctgtttttgaaataggaataaaaatagtctctaaatcacaaaatgattgtgaggattatgaagaccatgcgcataaagatcttggcccctggtagatgctcagcccatattagttatcattattgtcatttgttttggctgtggctgtacgattgctactcacaggagctatcattggtactcttaattcctgacgagaatttttaaaattttttattgtgatttttttctttccaacttttactgtaggttcaggagatacttttgcaggtttcttacacggggaatttgcatgttgtttgggtttggagtacagactattttgtcacccaggtaatgaacacagtatccgataggtagcttttccgttgtcaccctccttccaccttccaccttcaagcaggcgctggtgtctgttgttcccttccttgtgaccatgcttgttcaatgtttgacttccctttataagtgagaacatgtggtatttgatttttctgtttctgttttagttcacttaggataatggcctccagctgcatccatgttgctgcaaagaacgtgattttgttcttttttatggctacatagtattccatggtgtatatgtaccatgtttctttatccagatgggcactaaggttgatttcatgtctttgctattgtgaagggtgcttcaatgaacatatgagtgcctgtgtctttagggtagaatgatttatattcctttggatgtatatccagtaataggattgctgggtcaaatggtagttctgttttaagttctttgagaaatcgccaaactcctttccattgttgctgaactaatttacattcccaccaacagtgcatgagtgttccctttttgctgcagcctcaccatcatctgttgttttttgactttttcataatagctattctgactggtatgagatgatatctcattgtggttttttttttttttgagacggagtcttgctctgtcacccaggctggagtgcagtggcatgacctcggctcactgaaagctccacctcccgggttcacacccttctcctgtctcagcttcctgagtagctgggactacaggcactcaccaccacgcccggctaatttttgttgtgtgtttttagtagagacgaggtttcaccgtgttagccaggatggtctcgatctcctgaccttttgatccgcccatcttggcctcccaaagtgctgggattacaggcgtgagccactgtgcccggcctctcattgtggttttgacttgcatttctctattagtgatgttgagcattttttcttatgtgtgttggccacgagcatgtcttcttttaagaagtgtttgtttatgttttttgctcatttttaagggggtgggttgtgtcttgcttgttgatttctttacatttcttatagatgctcgatattagacctttgtcagatgcatagtttgcaaatattttctccccattctttaggttgtctgtttactctgttgatagtttctttttctgtgcagaagctcttcagtttaatcaggtcccacttgtcaattttgttttcatggtaattgcttttagagtctttgtcatgaaatctttgccagggctgatgtcctgaatggtacttcctgggttttcttctatgatttttttagctttaggttttacttttaagtctttaatctatcttgagttgatttttgtatatggagaaaggaaggggtccagtttcaatcttctgcatatggctagccagttatcccagcacccattattgaatagggaatccttttcccattttttgttatcgttggctttgtcaaagattggatggttgtacatttgcagctttttttcttggttctgtatcctgttccattggtctgtttgtttgtttttgtcccagtaccctgctgttttggtaactgtagcccttcagtatagtttgaagttgggtaatgtgatgcctctagctttgtgccttttgcttataattgcttttgctatttgggctcctttttggttccatatgaattttagaatagttttttctaattctgtgaagaatgtcatttatagtttgataaaaatagctgctgaatctagaaattgctttgggtagtatggacaggtattgattcttcctatccatgagtatggaatgtttttccatttgtttgtgtcatctctgatttcttcagcagtgttgtgtaattctcattgtagagatctttcagcctccctggttagctgtattgctagattttttattcttttattgcaattgtgaatgggattgtgttcttgacttggctctgagcttggatgttattggtgtatagaaatgctactaatttgtgtacccagattttgaatcctgaaactttgctgaagttggttatcagatctaaaagcctttgggcagagactttagggttttctaggtagagaatcaaatcacctgcaaagagagatagtttggcttcctctcttcctatttggtcttttatttcgtagtcttgcctgattactctggctaggtcttccaataattttagttctacagatagagttgtagagtaggaaaaaaaaatacagactttttgagacaggtatttcaacccagtgtgacacatagtagttgcatgtctctctggcattttcttaatcctctgagactcagtttccttatctgtaagatgggaataatgtcaacaggattattgtgaatgcatatgaaagtacctgacacagtgtaagcagtcattaaatggttactcttaatatgatataattagttattctacctccattggagagcaaaaatacatatcctcagaagcatctgattccacgaaattatcctcacacaaaactcagtcatctggctaggagcagtggctcacacctgttatcccaacactttgggaggccgaggagggcagatcacctgaggtcaggagttcaagaccagcctggccaacatggtgaaaccccatctgtactaaaaatatacaaaaaaattagccaggcatggtggtgcacacctataatcccagctactcaggagtctgaggcaggagaatcacttgaactcaggaggtggagtttgcagtgagccgagattgtgccactgcattccagcctcagggacagagtgagactccatctcaaaacaaacaaacacctcaatcatcctgagtgcttttgtggccctagttagtataggatgtaagacctttggaaatgcacaagaatcagaacagactggaaaataataaaaacaggcacgctgaaaaagactcactgcttttgcttccttacaaaagaatgcgctcagcacagttgggaggctgggagaaggagcggcagctgcaatgaggctgcacagccatgcacttgattggctttcgcaatttcaagagctaaagtcagaatcagaatctgcttcagattttaattcagcatgtaaaaggctagagagatgtttctgaaagtgagtctgcaataataaatcaatgggacacagggaaaatattctaaataggcaacattttgccattgctgaaaatttaaatatctcttcctttctactgtgccaagataaagggctaagaaagaaatcccaagctaatggcagagaagactaatgtattgcctcccaagactaagcacagaacacacgatctcaccctgctcagccacagacaggcagataaatgaaaatgcatctttttttgtctgaactcttgacatagcatctgtgaagataagcatctctaatattgattccctattcagtaggacttcagggaagaagaagaaaaaaaaaaacccatcagtggctgaaccaaccactgcaaccctatgtttctgggttgggttgtttgagtccctggtgaaatgtctgtaagttctgaggccacccatcacactgaccaaaacatcagagaccaactctgtttttatcgttgtgcattcagtaaagttcttatcagcaactttctcttctccattggtcccctggatctcagagggatcccggggttgatgtgaaattaggcacgagggaattcttcttaggtagcagccagcccacgttactctgggctgccagatacaagtcggtggctctatttggggacgccatagcagggctggaattcggcattctgaagacacatttaatgccaaagccagtcttctgtgactatggtctatggatttgttatgtgggtcccaatgagaagggccctggctttgttctacaaacagaacctgataaccacagcgtaagctcgatgctaaaaaccaattctcccgtattaggatggctgacactttcagccagaactgctggagaagtgtctctatggtgggcattcagatcttcccctttcatcatcagaggcacagcctcatggtcccacctctactaacagcccctgtggctctacgttagatcagttgctactgagtctcatgcaggatccacgaattacagggaatttttagcatcacactaaaatggctccaagctctgactttcaagtatttatctttagcaactgtacttttgtagtgctcgttccttttttcttatttgttgctatataggtacgtgcagaggtggaaggggtagttcccttcaagtctcgtaattagttcacctgtagttgtttgggctggcacagtggggtattttctgggtctgtgttatgtcaaaggcagggctttataggtaacctaagctgtcttttttttttgacacggagtcttgctctgtcgcccaggctggagtgcagtggcgcgatctcggctcactgcaagctccgcctcccgggttcacgccattctccggcctcagcctcccgagcagctgagtccctggtgcccgccaccatgcccagctaattttttctatttttagtagagacggggtttcaccatgttagccagtatggtctcgatctcctgacctcgcgatccacccacctcggtctcccaaagtgctgggattacaggcgtgagccaccgcgcccggccgccaccaccattttttcatacacactcccctctgcactgctaggaagcgctctgttttatggttgttcctggtttacactataatacatcttccagagcaatgttaacacctatccatttgttacttcaatggggtgtttgttactgaacacttgttatgcctgttaacacgggtataacagaatccaccactgccacgggttcagtgggtgggcttcccaccagtgactctccagcggcttaagacagctgcgccgttgcagccgtcacaaaaatcagcataggattccagagtgcagcagaatatcttctgtccttgagaatatttgctggtgttgccatctggccaggaaagaacataattaggcttgacctgccatgattttctaagtgctgtatagaattaagcacagaccacaattcccgtgccaaaccatattcacccatgattcttccaagaatcaggcagcaaatccaaactttgatatttaaagatgcagcaacctaggccaaaagagagagtgtctaagtttcactaaatcctggagcaagaatttggcaggtcctggaagaaggtgaaacagagagggcttcctctagcttcatgcacgatcatctgccagggcatctctttgagcctttctttcctattcttgacgattttctaaaagggatgctcttcgcgcacttgccttcaacttgatggcaaaagacatcagagtaaaacccttttccttagtcccatttcattctcagccttgcccctgtttataggtctttaggaggacttgggtcctgggcagaccatcccatcagtagaatgcacgcatgaagcgtggatgaagagctcttggttgtaatccaagaaggaaatgcaggctgatccaaggaaagaggtgtgattggaaggatttgaagaactcattgaactgggagtgagactagagaactacaggcagaagatgagcaggagccgaggtctaggtggcaggagagacagctgaggtcccacagtcacagccaggacactgctgctggccccataccactggatgcttgctgctgctgctggagcctgggtcagctctgcggatcaccacctgccctgccagggtgcgctgcctctgtggatgctgaggaccagacaagggcttccaatcagctgggtctaggtcaatgagtcggtgccccactgcctgagggcaagagagggaacatttggccctgctcgggtgtcatactgccttatctactggatgggtgagtgcccaaatcagcaagcggttcagaggatggtcagccaacagattaacaaacaaataatccaacaacgcgcaaacatccagaacagatgctatttaagaatgaggacagctaacgtttcaaggaggatccaccctgctcctgagtgaccctggttctgtgtgtttgggtctgggtctgctcatctataaagtatagctaatgaaacctatattttaagagtttatgtgagaattagagatactgtagataaattaccctgagaaggaactccaacaggtcagcaaaaaaaaaaaaaaaaaaaaaaaaaaatcggtttttaaaacatttttataattttttgatagagatggggtcttgctatgctgcccttgctggtcttgaactcctggccttaagcagaggtgaattcttggccatatgtagggtgcccacagctgcacagaagtcagataggatgaggagatagaacctggagtgacgagcactgtcacggtaagccaagactctagaatatgggatatggggttaggagatgtgtgctaggtgctgtttcttatactttttcagcggatgcatttaatcagggagaagtcacacatatggggcatcaatttctctttttttgttgttgttttgagatggtgtcacactctgtcgcccaggctggagtgcaatggcaggatctcagctcactgtaacctctgcctcccaggttcaagtgattctcctgcctcagtctcctgagtagctgggattacaggcccacaccacaatgtccagctaatttttgtatttttagtagaaatggggtttcaccatgttggccaggctggtctcgaactcctgacctcaactgatccacccaccttggactccaaaagtgctcggattacagacgtgagccactgcacctggctgcatcaatttctctgctgttgagagagagacagacagagacagagagaattccagctctgtttatgctacacagctgttgctaggaccaaataagataatatgaggagctaccaactggtaggcaaatgctcttcattatgttgaccacttaaggtcccttctgagaatccattatttattctgggtctacggaacactgactatgatgagggtgctaaggctgctggcgagggtcctcctcggccagcttctcctagcagcagggcacgcacagccctgttttctcatctgctttcagcagcatttgcctcctactccacttgggtcactcaagggtcccaaaatagacctgtgcattcatgggacccctcccacctgcctctctgctcagtgtctctgttgggacaggcagcaagtgcttaaatcccagccactgctccccgctggagtccacctgagaactttcccagcaatttgacagaacaacaaggcaccagttacacttctctatcatctattgccaagctacaatgggccaggcactgtactaagcaccttatatgtggggtatcatctcattctcataataattctgcaaggtggatagaattatgtttccaagtttctaggagaagtagagacttatttagattaaatagcttgtctaaaatgttccggcactacatgagtccaggtaatgagtccaggcctgagtcttaaccactgtgtggcgttcggccaagaaattcgatagtcaccaacttcatttcttccttaggaaaataattccataccgtggcccatcatttctccaaaggatcttttaacatatctttttccgttcccccttcctttttgagcaagaagcattttttattttattatttatttatttatattttactttaagttctgggatacatgtgcagaacgtgcaggtttgttacataggtatacatgtgccttcatggtttgctgcacccatcaacctgtcgtctaggttttaagccccaagtgcattaggtactcatcctaatgctctccctccccttatgctccttccccctacaggccccggtgtgtgatgttcccctccctgtgtccatgtgttctcactgttcaactctcatttatgagtaataatatgtggtgtttggttttctgttcctgtgttagtttgctgagaatgacggcttccaacttcatccatgtccctgcaaaggacatgaactcattcttttttatggctgcatagtattccatggtgtatatgtgccacattttctttatctagtctatcattgatgggtattttggttggttccaagtctctgctactgtaaataggaggtgcttttttactgattcctttcgactcttatttcctcatgacctgtaaaaatatgtgtcaatattgagaacacagaaagttaggcttgacatttcaccctgaagctgctgtcattttaattatctggcacattcatagaaaaacatcccagagatgcctgactttacttttcatctgtggagatactgttggattgtttaagcattaaaatctcagaaacagaaatgctacttaggttgtataaccctacgtggcttaatagactcatggatctccttaatttgctctaattaaaagtgccttttaaattgataaaaacaaaaagttttgttgagaattgttcttttaaaactggcaaaagctggccggacgcggtggctcactcctgtaatcccagcactttgggaggccgaggcgggcggatcaggaggtcaggagatcaagaccatcctggctaacatggtgaaaccccgtctctactaaaaatagaaaaaattagctgggcgtggtggtgggcacctgtagtcccagctactagggaggctgaggcaggagactaggttgaacccgggaggcggagcttgcagtgagccgagattgcgccactgcactccagcctgggcgacatagcgagactccgtctcaagaaaaaacaaacaaacaaacaaacaaaaaaaaactggcaaaagccaggtggggtaggcaggtttctactgatctaaaatgtaactactgaaactacctgaattccagcctgactgttgagattgcacagactggccaagtggaacagagaataggagaaagagagaaaagaaaagatgctttctgagtgagtgtttgctcagctgaaagcatggtgtgatttttggaaatattcattcacgctaggattacttttagccaatccattcaaagaatagtggtgtttttgctggaattgatgtaacacctttggaaaagtaagtaacagggtcctttgcacctcagaaagtgcattacatcatgagatacttggtgaactgtaaatcaaatcatgtattgatttacaggatgctccgaatgcatgctcacctgggccgcctattgataatagagtctactatgttgatggttgctagagtcaccatcccaatactgatggagtaatgacatcttcattattctcgcccatgctctcttcccttcccctccgaaacttctcctaatgaggcaggatggttacgtagtaaatctaaccctgtcacacaaccgaaacgccctgttggaagtttcagacagaaatcacacaggctgctgcatgacggccatttatgatttctcagactttcctccagtgctttcttttcccggtgtgtgcgtgacatttctatcatgtggcattctcagcacatgtgtcaggcttcaccctaaacaagcctgctggtgtatgatgataaatagtgccacgatctgcagcgattcccacccctccacatcctggcaaaggtctcctagcaactgttgttatgggcaacactagcatgtttagttcaattcagtggctacgggccatttctggtctcctgatggaggttcaagtctatgccctggagattcggatcccctcacaaatccacatgcccattataacttcccttgtacctgcataacgtttaaccattattattaaatttgtccgttcagcaagattgaaactgccattcggaagctattgcaccttccacacaggcagtgaaaaaggactaacatctgaatttcgctacaaggtaacattcggcttcattctctttcctgtttaatattcacaaccttaactttaaaatggtttccaaactatggtgtgtggtataaaaacaaaaagtaagaacagaaggaaaaaagtccattattaagcccctgctgggatccctttctctttaatgcacttcaaaaaaaaaaaaaaaaattccgggcaattttgtattcagatgcatcagcagaaccaggctgcaaatgtctgcattggtggattacatcaccccctactgattgatccttttaatggctcagcattttgcaaatgaagaagcagttacctctgttctgttggctattaattccatctacatagggttctgctggtttaatgagcattgaatatcttccatcaaaatgcagtgctttcaagggatgtaataaaatagcctatgttaaaactggcctataaaagtagcttataataaaatagcccagctaatgtaaaatttaattccttcactatatttatgaaataggcaatcagtcctcattcagagaaaatggaatgtacaccaagcaaaatcagctttgacctgatctctttaaactcaatagtaactcagttggaaccatctgaacttgttttttgaaaaagcttctagaaccttttttgtgattgtcagcattttcaggacaactttgtattcaggtgagcctgattattcaacactaagatttccatttggcatgaaagaggtgtttaaattatgagtttatttttaattcttggttaaaaagtagtcttctattcttggaaagcagaagtacaatggcttgaaggacaactgtgcactcaggcattgatctttagcgtttatactttattagccaataccgaattccacagtgattctaatccccttctacaaagcattggagagggatttgttttaccctccctaaaaaaaaaaaaaaaaaaaaaaaaaaaaaaaaaaaaaagagccaactgagaattaaacagaggtgttgccaggaacagacattacaaacataaaatgaacagaacagaagggctgtctaggagtttgttgtccatctgccctacaggatgggaagagtggctgaggaccccaaggccacacatgctgggatttctggggtgatttaggaagagtgagaccatcctgaggatctcttctgttttcctaagctgtatcaccaccaagctgctttgcctgtaacactgagctcaggagtaggaggaaactgctgttttctaagacagtgctgatgctctagtggatatcagcctggaggaggacctgttgcctagctccatactcactactcgaggtacttgtacctattgtctcaagctaagtacaccaggcttgagacctcagacatgtaggaaaaaataaccacttcaaaagagaaaagggttagccaattctgagaaaacagagtccacagattggatatttattaccatcagggatcgtatggagcatggggatgagaagaacgtccaaagatgagggctttctttattccccaagtgttcttttccaatatgttgttagatctatctagtacacctaaaagtcagacgctaactcaaatcagaagcattcctcaagctaattttattctcacaaatctctaagggactgcattattatattagattttgcagatatttcttacacgtcgttgctaaggatgttggagacatttggtgatagatagcccgcaggtataagtagtatattaatggtaataaaaaatgacaaaagtccaataaagacatacaaaggataacttttgtgttcacattgttctttgtaaggatttaaacctatgcctctagtgcatgacctctgaacaaaattacaaagtaaaacaaggataaggaggcaataaatgccaaattaagtcacgatagatggaacacaagagggaccctgtccttcgtacaaataatctgaaacgaaacaactaatactccaagacttttcatggggaggtcagacagggagtcagaagtcaaagagattgctggtgagagtgaaaatggtgcattcactgtggaaaggagtatgaaagctccttaaaaaattaaagatacaattacagtatgatcccacaattccacttgtagatatagatcaagaggaattaaaaacaatgtctccaacagatattttgagacaccatgctcatggaagcattatttataaagggttaaaaggtggaagtaaactttgtacccattatagatgaatggataaataaaatatggcatctgtctgtctatctatctgtccatccctccatccattcatccatccatccatacacacacacatgctggaatattattcagccttaaaaaggaaggaaattctgacctatgctacaacacaaataaaccttgagaacattatgctgaatgaaataagccagtgatatagtttggctctgtgtcctcatccaaattgtaatccccataatcctcacgtgtcgagggagagacctggtgggaggtgattggatcatgggggcggtttctcctgtgttgttcttgtgatagtgagttctcatgaggtctgatgattttgtaagtgtttgacagttcctccttcaaatgctctttctcgcctgccaccatgtaagatgtgcctgcttccccttctgccatagtttcctgaggcctccccagtcatgcggaactgtgagtcaatcaaacctctttttttaaataaattacccagtctcaggcagttctttaaagcagtatgaaaataaactaatacaaccagtcataaaaaggcaaatattatgtgagtccatgtatatgaggtgcctagaatacggtggtcaagttcatagagacagaatgtaaaatggtggttgctagggactaggggagggggatggggagtacttatttaacggatacagagtttcaatttcagaagacagaaaaaaaagaaaaacttctggagatggtggttgcacaactatgaatgtacattcacactgctattaaactgaacacttaaaaatggttcaaatgacactttgttatgtatatattaccacaattaaaaaaaaaaaaaggagtagtcagccccaggactgcaatctaattacattcaaataggcattaagaagaaatgggccctcagttgtatatctaaaataaaagtgatcatcagtatcttcttctcaacctgtggtcaaaggccttcttctttatcaatgaatgtacacaactccaccttgaaagctcagagaataacaattgactttgggatattaatggctaattttccccaaaggtgagggagcaagaagacatatgaccaaatcaattagcccccttaattagtatgaattaagtcttgcttgaaagaaagcaaatggaacagaacacaatcactttaagaaaaggcaggaggagttgtaataattgctaccattccctaaacacctcagatgctaccctgtgctaggggatcatcctcactgctgttcaccagccttgccagacttccacccccttccaggcgccagaatgccttccctctggcccccttgtggttaggtggaacccagtgactagcgtctaactaatgagctgtaagcagaagcaacaagtgtcagttccaaactgaagcatctcattgctggtgcaagatcccagcaatctatgcggattacattgcctgagatgggggctcttgtatccacatgaggagtcatggtaggcatttgacatttaaatatgacatttatattataatttgatgtgatatttaaaggtagttataaaccactaagatgggggataatttgttaccatgttttagcctagcctacttttactacaaaacgaaatgaaaaaccaacctaaacactgaactgggcacattacctatataatctaaagtcctacaatgaacctgcaaggaaatattacatatccattttccagatgaagcaactgaatctaaaacatcacacccaggaaggcagcacttagaatcaaatacaaattcgtctgactccaaaacctgtgctctttccgcagtaatactgagttctctttaatgttcaggcttactttgaccattaagatgcaccatgagtcatttcctgccacctctaaatggctataatgctctttctcctcaagcaataaaagatgatttctctgcctcactttactagcctctaattaggcacgatctttctggaagtacagtctcctttggtcagcaaagaccttctgagctcttacatcccttgaatatggaatcttgcacaaaagcctcaggctcttagttttcaagctgtgaaatgggagtactaatgactcatcacaagcttgctcatggacattgcacaaccacacttacgcttgggtccccaggagcaagtgaagccatggacctttcttaggctgcttgggctgggatcagtggcagtggaggacatgggtcacaggtcagcatgggaggagagcataggcaccggccttaggtctccgggttcgttggtgaggtatcagctctgaggtatgggcaggttatttgtcctttctatagtttcctcttgtgcaaaatgcggatgaccaagggattgctttgtgaaggaagttagttcaaacaaataaaacactgagggagtaaggtagagaggaatgtctagagtatttgcagcattcaaagagaggaaaatgctttccagaagctgctcaagtcctgttgtgggctgaattgtatctcccttaccccccaaactcatctgttgaagttctaatccccgctacctcagaacgtgaatgtatttggagacagggtcattaaagaggtaattaagttaaaggaggtaattagggtggccctaattcaatatggctgatgtctctgtaagacgaggaaatttggacagacattgcaagaccatgtgaagacccagggagaagacagcatctactagccaaggagagaggtctcagaaggaatggaccctgctaacaccttaatctcggactgctggtctccagaactgtaataagtttttgttgtttaaccctcccagtctgtggtgctttattacggcagcccaagcaaactcatacaagctccttccagtgcggggagccagaccaactctgaaaaccctcgttggatgctgaggctgggccacttagccggctgtgcctgaaagaggacacagcagcacagcagccacacagaacctccctccgtcatctgcctttgccatcatcattccaaaaactgaggcaaaggagactcaagggctgtctgccctgctactgcgaggggctcctcagatgctcccattcccaaagactgatgtggtcccagattcagcaggaacctgctagagaaactccatgtcaatgcttggtttcttgttgaatcaacccagatttctcaggtccaattaaagaattaggtcttcaatttaggagggttacagagagatgggggcaaaatcaatttatcaagaagaacctttatatcacaactaagcacaaaacctaatgtcactagcctcaggaaagtactttatgagcacctacacagatccaagaagtggtagtacagaaataagaaaacacacatacacacacacacacacacacacacaagtgcacgcatacacactttcatgcactcatacacaatcacacatatatacaggcacacacaaacacacatacatatgcacacacatacacatgcatgcactcatatgcaatcacatgtggacgtatatgcacacacatgcatgtatttacacaatcacatatgtacacacatgcatgctcatacatatacacacatatgtgcgcacacacacgcacatacagccttaatgccactgatacaatagtgaactataagtaattaagttactttgactaaacaccaggtctgccaggaaaaagtgtttaacgccatccccaaaggacgttgtggcgccaaaagcaagaaagggaggttaggtcccgcctcggtggaaatacaaaagagagaaaacgcggagatagtgagagactaaacacaggagaagaaagattgtgcttcaggtggaaggggagggagtgtgagacaggaagggaaggggtgcccagggacccaggcaaggaaggggtaatcacccggtagtgtagctgcgttgtgtgaacatgggcacggttagagggagtgggcttccctgaggggtatatcaagctctagaatattttttcttcacaggaggtttttaaagatgacctagatagttcacttccctttctgtacaggtgggactcgcaagctcttctagcgcgtgcaccaatctgggttggagcatcacataaaccacctctcagctcaaacttgccgatccccgctggccacacagggagactagtgacccaaagaccagtgggagactgtgatggccatgcccagagtcaccccgcttccatcctggtggaagtcagtttgccatctacacaactagagatagacattcagttacagcccagatggtcctcactgttaaagcactgtgcctgaggaactagattcaaacctctggccctggaatatagacatttacacggtgcccagaacaatggcaaattgaaaatgcagctcatagcacctgtcaaaagaaataagatcacattaaaattcttgccatttcctttttctgctaaactaggtaggttaacatacagataggcctctctctctctctcactctcactttctctctctctttctcgctctttctgtctctctcttcactccacagtcagttttctggagtgtggcccaaagatccatatgtcaaaacctggcagaggaagctgataccaaaaccacatttattcttttcctttaaaaatggcttgggaaattagcccctacatttagggaagtccgagtgaagaagagggaagagaggggaaggccttacggggcacaggacccgctctgattgttggaagtctcagccttggcccaaagcccagcctctgtcctctgcttaaattgagtgtgagggaacaggattatcttggttgtaatttttaaaatgcttccaagcattgtataaaagtcagagagctctgttggaccttcacacgaaacagcattttcgtaagttaaaaaaaaaattggaaacaaacgactctacatggccaaacctcatcctaagccaaatgacaaaataagtagtttgccttctgttccctctgttctcaaaccttcctgctgtccctacccctggcacctcagcgggtgcttctctgttgcttccctcagctgcccaattccccacgtaacatgagctagcattaattgagcacctgctgtatggtaggcagaggcataagtgccttgtaaacatcacatttttattctctcacaactttatgagttagaaaactaatctgcccaaatataaggagacccatcttctccaatgagaagttctcccatcaacactttaaaaaaatccgattgactatatgaactcaaagatataaataaaacaaatatgacttaaaaaatttaattccgttgcacatgcatatttaaaaccacatactatctaaataatacattaatgtagaaatagtgcctttttccagtcttacatattacagaattttattcatcaatgtgttcgttatctctagagccaattttagagtcattcaattcattttttacaggacatatcaccttcatttccctctgaattgtttgagatgtggcacactgtcactggaaattttttcccaagctgtaaatgaatacacattaatatcacattaggacagatgttttatttattcatgctattggtgtatatcaaggagttctacaatataactatttaccttattgctttttaaaggaatcttcacagggtttgtttacaatggcctccaatgcttgcattcatgaggtcatattccaaggaataattgctaaatgggttcaattcatttgcctcctttctgttcactgattctgtcagaaaacctcagtaagcactccaaacaagcactgatggaagtcctttcaggccagtgttttttccttaaacaattccatgtttgtcaagttaaactaagtgagacagcatcccaaggtttgaaacaattggtaaggattcttttatttggaaatgccttcttttctaaggtagaattttggtaaaatcacttgcacctacgttttgacatacgtgatgactttaagtcccttttacagatgacaaaactgaggttcagatattaaaataaccggccggatgcagtggctcatgcctgtaatcccagcactttgggaggctgaggcggctggatcacctgaggtcaggagttcgagaccagcctggccagcatcgtgaaatgtcatctctactaaaaaataggaaaattagccaggtgtggtggtgggcacctataatctcagctactcaggaggctgaggcaggagaatcatttgaacccgggaggcagagtttgcagtgagctgagatcctgccactgcactccagcctgagcgacagagcaagaatctgtcttaaaaaaaaaaaaagaaagaaacaaatagatattgaaataactttcctaaaatcaaagaactagtgtttgtgtgaaatgaagctggggccagaggccaggactgtcttactctagggcccacatgctgaagccccagtctgcactgcccatgccaccccagtgtccatctcctcatgtccaattctgcagccgcttccctttccagaacttcagtcagtgctgctctcagcatccataacaatgtctatttcttctaccgacccagaaatttcacttacaggaatgtcactgaaagaaatcctcatagatatgcaaaacaatttagcacaaggatattcatgatagcattattcttaagggaaaaaacttggaaacaaagtaaacgttcccgataagggatgcatcaactaaggtgtaggtacaggatggaagacaaagcagtcattcacgaaatcctaagtggaaaaaacgagaggttgcgtaaaataattctagttttactttttaataaaagtatatatgtgtcaaaaaataggaaagaaacacaacaacatattaatgtagttactcttcaggtgatggaactaaataagattattttcttgtttttactttatttatttatttatttatttgagacagagttttgttctcgttgcccaggctggtgtgatctcggctcactgcaacctccacctcccgggttcaagtgaattctcctgcctcagcctcccaagtagctgcgattacaggtgcgtgctaccacgcctggctaagtgttgtatttttagtagagatggggtttcactatgttggccaggttggtcttgaactcctgacctcaggtgctctgcctgcctcggcctcccaaagtgctgggattacaggtgtaagccactgtgcctggcctgtttttacttttctattcctcctcctcataaaaactgtgcccatttcaaaggaataacttcaacaatgagaatttgggagcaaagaaagaggaagcatagaatagcaggagaaatacctggtgaaaatggcgtcttgttttataagctgttgcctcctctactttttacaaaggtgttgccctataaaaggattttccaattaaggggaaaagattaaggctgtaatcctgggatgttatcaagtctataatctgtttggtctctctattacaactgcccaggtataaaagcctgtcttgtagaaccaacaaagtgtgtaaacctctcagccatatgtcagaccctctgtggggccaaaaatcaagcaagctcttctagagaattagctagttctcttttaacccagtccttggcttcagggctgtgctggtgggaaacaacagatttagcaaaaacgacacatttcctacccccagggagtccagcatgggttgctgatgaagacatgggcacagtgagcagagagggaatgggcagtctcagggggaggcccaggagtcacagccaggcacttgctggtctctgggagtgatgtccagcacctacagggctaatagtaccagaatgaaaaacataatacgaggccaatttgtattcattgccaggaagaagcaaagctgcctcttagaaagttagcattccatgccccagttgcatagtttctagctgtattcaaaacctggcctctttcaagagatcacagtgcccaaagggaacagccaaaaatatgctcccagccagtacctaaactgtgtagtaggcagcctcaagacagcccccaatgaccccacctcttggtagttactcccagtttaacccctctctttcaaagtgggataaacttatggatttgtttctaactattcaatagactattaattagaaacaaatcaatacagcagaagtcaaggagtgtcacttctgggatttgattataaaaagattttagtttctgtctggggtgtgctctctttccttctttcttgctttactaacccaggggaggccagctgctatgtcatgaggcacctctatgggaggtccacatagtgctgaacgtaggcctaccaacaatgacaagaatgatcttggaagcaaatatcccccagttgagccttcagatgaaactgcagccccagtcaaatgcgtcactacaaccttcaggaatgatcttgaagcagaagtgttttgctaagctgcacccaatttcccatccacagaaactgagatactaaatgactgttatctcaagccactaagttttgggacaatatgtgaggcataaacagataactaatacagactccaaataaacactttgaaagaggagttccaggtgatattaaggagttttaaaataagaagtctctttgagtggctcagggtttacgtgggccctggagccagattcctgggagttcataccccagctccaacactgatcaggatgaacccagaggcaaattacttaacctccctgtcccttcattttttgatgggaaaatgggaataatattgctaggtttatgggaggaagatcaaacgagcatgtgtgcacacatgtgcacacacacacacacacaatttaaaacagagcctggcagagagtaaatgctgtatatatgcttattatgatgattattaaagcatgagaatagaaaagaagacattagtatcatactatgtatttttaagctttaaaattttattgcatatattttatttgaacaaactatatttatagaaaagtttcaagaatagaaaaacgaatgtccaatgcccttatcctagattcctcaaatgttaacattttattatgtttgtttcagccttctctttctcctttcctctcctagtttattttcaggttgatttaaagtaaaatgtatccataaatactccagtgtgtctttccaaagagtgagaaatttccttacctaactacaggaaattatcaaaatgaacatatgaacgttgaagcgatattatcatctaatctacatatcttgagatttttgccaattggacaaaaggacattattaagaatgttctttacaggaaaagaaaatccaaaaatcatgggctacatttagatttcatgtctctttagtaacagttcttgactctttttggggtactttatgatattgatatttctgaagagcataggccaagcattttggagaatatgcctcaatttggggttgtccagtgtttcctcagaattagattcaggttatggcccttgggcaggagtacactctggaaatgatggtgagttctcaggtcactcatatcaggtggcccatgctgttgattcatgccatttctggcaatgttaactttgatcattggttaaggtggtatatgccacatatctctaccataatattagtttttatcctttctaacaagaagtgccttaaggggatatactttgagaccatgtaaatattattttattcctcaaactttgatccactatgttagaaccaattattactatgatggttagcaaatggtatttttctaattccatcattcattctatatttatctgttagtattctactaactataaggaaaagctttcccttcttctccattcattcattcatttattctttcttcattcatttatatcagtgtagactcatggactcccaccttattagataagttataaccttttattatacataatttacattaaacccaaatataaatctgaatagctttaagtcaaatagattcttttgacatttattgaccaagaaaagatatatttatgtctaaaagacacaggtatattttcttttattagagcagagattttgcttatgttaaaaactgttgtttgtttttgtccatgctctggtcaaggttagcaccgctgaagaccgagaaactgtgtttgtatcattattaatcatccctgcagaatctgacagtgagaaactccaagataaatagtgaattcctctcctatgaatttaagaaacctggttttatccccatattttgccagcagcttagcaaagaattcccacgtgactaacttttcatataggtttttttgtgcaagtgtaattgctatagcaagtggactgatttcacagggtggaatatgggaaaccaacttttttttgaaaaccactttctttatatgaattctatctaattctttatcactgtcctggacagatcgttatagctttagtaattctttctggtatcagaagaacttcattacaaagcacccaaaaatcctgcttaatagaaataaatgcttcaattgctcattcacttaaaactctccccttacccagctctggataaagattcttcactggagtgtggcagtgacaggcagagggaatagagaacatggtccatttgctcttccttcaccttgttcttcttttccttctccctcctcttattgttttgctcttggtttctctaggaccaaggacggggtgaagtgttgagtggggaagctcgctgagacagcaagaatcttgcttggcaggtaatgttgtaatttggtttatgaatcctctgtgggtcagttgtgcaaatgccagctttctctctctctcacaggtcccaggagagacctttcgacacctccagcttgcagttcccctctgcagacgatacactttctcactaacctctcatgactctccctacgctagtttcctctgttggcttctgtgatgctcactggctcaagggaaaatgctatgtctttgcccttaaactctggaggtacaggccacccctccccacctcagccctccattgaactccaatcagcatttcacccctagacattcttccaagtaaaaatccatggaacatgatggcaccttcctcctacttcaactccaggaaccaaggtcaatttcttccagaaactcatcactatacacccttaggtgggcctataggatttctccggttctgtatgcatctattgaggatgatatgtcaggttctctttctggaaagtaaccatactctctacgagtaattctttttaaatgtcgtttgctttgtctgaggtggaagaaggacatccttcagaagggagaacacaggacaccctgacaactctctccaaggaaatcttggctcttcctcaccagcacaatctctcctcttatgtattgggcttgaagtgggagccagctaatgctggaagatccagtttggatcacatgttttcctgtggatacgcctagcacctttctttacaatgtggggttcttgccaacttcttaacctcaaatatttttaaaagcctagtatttgcaaaagaaatgccttgcaagttgtattacttctcatctatcataaaaataacagatgagaagtaatacaattttcaaagcatttcttttgcaaatattaggcttttaatgtgcacatgtaccctaaaacttaaagtataataataataaaatcgaaaaaaaataatagcctaggttttaaggggaagagtagataaggtagtaatgcaggaagagcttgtacaaatgttcaagaaaaattcctctttccataaagtcttctgagacttgagggagaattccagtcaatcaatcccagtccctaaagtcttaacttaatttgcctccagactgctcaacttcctattaagaatggcatctggcttgtaacccatcaagcaaactctaccagctttccactgaaatgcctgtggagtaggagaaaaggttaagaatgtgcaaccgtctcaaaatcagcagtggctatctgttggttgctaaaatctggaagaatttccattacctgcaaaaatgatagaaaatgccagcaaatgaactaaaccatctgctaaaaggtgaaagaaaaatcattcctccctctcctattgtcttctttctctgcttataaatctggaccaagctgaaagccagacaacttcctctgttgcctcgttgctgccttctaacatagccacagtgctacccatatcagctgtcttccacatgtggacagagtaattctcaggaaaacatacgaggcatgaactaggatagaaactggtaacaggacattatattaaaatatggtatcaaaagggaagacctgtagatggggacacaagaagagccctggttgcaccgcatacttggaattgtacattttaatgcaccacgatgttcagagtttcagagaccaatgcagcaagggcaggagacaatcagatgagcacaattgcccttgccagatgctgagaattaagctatggcggaagacataaacctgccctcgaactgcagctgtgaaaaagagattagtccagccaccagaaaacaagtcattgaaaagactagaagaaaaaaattgagtttaaattttggttgccaggctgggcggtggctcatgtctgtaatcccagcacactgcgaggccgaggcaggtggatcacttgaggtcaagagttcaagaccagcctgaccaacatggtgaaatccagtctttgctaaaagtacaaaaattagccgggtgtggtggcctgcacctttaatctcagctactcaggaggctgaggcacaagaatcacttgaaccgagaatgcagaggttgcagtgaatcaaaatcacgccactgcactccaccctgggtgacaaagcaagcctccatctcaaaaaaaaaaaaaaaaaatttgttgccaaaaggaaataaaacaattttttaaactacagaattaataagcaattttagtaactgactagaaaaaggacaaatgtaccaaaaacatttatgttcctatctaccagcaaaaactgatttttaaaatataataggaaaatatttataatagacggcaataattgaaaaatatctaagaatgcattgctaagaagaaatatgtaatagaaacccagatgatgaaaactataaagctttaatgaaagatataaaagacttacaaaaaagaagttctatacaaatttctctatggcatgactgtaattcaaaaagtgacagttctcccccaaatcatgcattggtaaaatgctattccactagaaattacaatggactggactctaataatttcaaaataattattttaaaacccatcttgaagaataagcagagaaaaaatgaaaagtgatggaaaatttttctaaatttttcatggcaattataatgttataaagaatataagagtgtagtgttgctacaaatctcaaaagagtaatagaataaaatggtcattgaattggccctaacatacatgcttataaaaccttattatattgtaaaggaaataacacaaaaaagtgcatgagagaaattattccacaaacggaatttttgttaaagtatatgtgggctgggtgcagtggatcatgcctataatcccaacactttgtgtggccaaggtataaggattgcttgaggccagaagtttgagaccagcctgggccacacagcgagactctgtctcttcaaaaaattttttaaaataaaaataaaaaataaatgtatatgtaataacatatacatacttacatgaagtttaaacatgcatgcatgtatagagcaatttaagaaaataaaataaatactaggcagtaggagaagaaagggatattgtttatttggggaaaaaaatttatagtgtaaccagataccatactccaaaatttactctagatttttgaaagttaattaactggctgggtgtagtggctcacacctgtaatcccggcactttgggaggccaaggatgggatggatcacttgagataaggagttcgagaccagcctggccaacctggtgaaaccccacctctactaaaaatacaaaaattagctgggcgtggtggccagtgcccataatcccagctaaccaggaggctgaggcacaacaatcacttgaacccaagaggtggaggttgcagtgagccgagatcgtgccaccacactccagcctgggtgacagagcaagaccctgtctcaaataaaaagaaagttaacaaactggaacaaagcagaggttaatatataaactgatctcagtatgaacaaggaccttaaaaaaataaaagcaatgaaccaaatcacagagtataagctatgtatatggtcagtggatttttagcaaaggtgtgcaagtaatttttgtattgagttgaatggtatcccctcgaaaatgcatgtgtacctggtgccttacaatgtgatcttatttaaaaactggatatttgcaggtgtaattagttaagatgaggtcatattggatttagtgtgggccctaatccaatgactggtgtccttacaagaaaacagagacacggaaacatacacagaggaaaggctgtcatgtgaagatggaagcagaaattggagtgatgtgcctgcaagccaaagcactgcttaggagtgccacccgccaccagaagctagaagagaaaagaaagcatccaaacctagagtcttcagagagcttggccttgccaacttgatttcagacttccagcttccagaactgtaagaaaacaactgtctgctgtgtaaagccacccagtttgtggtcatctgctaaaacagcctttgaaaactaatacaaggtgcaatggagaaaggaaatcttttttatatatgctgctaatattggatagccagacacaaaggtaaaacttgactattatcttacactatatataaaaattaactcaaaacgtgtcatattctggaacacttttagaatacaatgaagataaaaatcttagtgaccttgggtttggaaaagatttctaaaataggacacaagagcacagacactaaaaaaagaaatacattttacttcaaaaaatatagaacttatactcttcaaaaaagaagagtattatattacataatattatttattatattacataataaaaggcaagtcacagactgggagaaaatatttataaaatgtatatttgataaaggggttttaactaaaaaaaaaaagaactctcaaaattatataataagacaaacaacccaaacaaaaaaatgaacagatgattttaacagacatttcatcaaagcagatacaaggatggcaaataagcacatgaaaaaatcctcagcaccacgcattattaggaaaaagcaaattaaattcacaatgaaatactaccacacatctatccgaattgttaaagttgaacaaactgatcatacctagcgttggtgattatgtggagaaactggaacgctcatgcaccacaggtgaaaatgtaaaatggtacagtaacattggaaaacagttgggtagatgacccaatcattttatacctaggtatttacttaaaaatgaaagctcatgttcacacaaagacttgagcagaaacgttcatagttgttttatttgtgatagccaaaaatcagaaaacaactcaaatttccaccaatggttgaacagataaacaaaaccatgcaaggaaatactacttagccataaaaataaatattgacacatgtgacaatatggatgaatttcaaaataattatgctgaatgaaagaagtcagcaaaaaagagtacatgttgcatgaatctattcataaaaatattaagtagtggaaactactgtataaaatcagaaatcagatcagcagttactggggatggtgaggggtgtgagggagggattacaaagggggcaaaaggaaatttcttggaacaagggatatgttcacttttattattatagtgatggtctaatacatatgccaaaactcttcaaaaactgtatactttaaaaatgttcagtttactatacattaattatgccttgacaaacctgtaaacagtaacagaatcataaaaaggtaaatggcaaacaataagaagtacttgtaataagaatgacatgtaaatggtaatttacctaatgtaaaaagtggcctcacaaattcataagaatacaaaaccatctcaaaaaagttaaaagtgtaaacacaccattcactattgaagaatatacaaatctttaataattatattactgaaataaatattatttaaaccaatgattttcctgtcagttctcatttataaaaatggcattttttcaattttaataataaatgctgatgatgcagtgagatcagtattcatactcctgcaaatgtaatatgattcaaaaagctactcagggaagccatctgccaatatcattaaaatcttcatacctctaggtattgaaatctggggctattttaacttttttctttataatttcttctatttactttttaaacatcaaccacaaattttttagtcagagaaaatattctttaaaaagaaaatgtttgacttcacttcattttgcaaatttacatgcacaaagagttggttgcaccttccaggtctccttctctattgactgctatttttccatgcagggtaagggacacggctcattgtcatcatggaatcctctttgccatggctgttaggatggacaccatgacaaccacattgcccacagctacatggctccagctgtttctctcacttatgcctctacctcttcctaacaccatggagactgttgtcagggatgttaagtctttgaggaatgcaatactcacgtcttcagaaaaaaagaatctctaaggatctctgtgtcatagatatagtctagaaatggcaaaaaaaaaaaaaaaaatcccatctccttttttattttttggcagctaacccagacttaaagggaaggctatcacttgacattgtgcaggagggagaacatcgtggaaagaagaagacatgatgtgtgccagagccctcggcaggtgcagtttggctccagaccccagcatgccatgatccagcttacaaccgctgcattctctcccttttgtactgcacggactctcatgtgctttaagaggaattggagtttggcatgaggatctatttatccttgagtaaactagcagagttttagttcccacaagcaaaactatccagcagagaaagactgtccagtctgcaaatattgacaccacatggtggctgtgtcaacaggtcaagccacagaacagctgcaatgatgcagagaaggcatgaaatgtcctctcgggctcagggttcacacacagacccaatcaaaggcatataagtcatcctacatgctcattaaatcacaagtaaagagtgtttcctttcatggcatggcacctcaaggacagggttgaataatttttaagattataactgaagcctgagcaatcacaattcaaagcacattctgatcttcaccacttcaaattgggccactcctggctatctcccatcagtagacgaaaatattcacaaccacacagccagaacctttgcctttgttcttaatagaaacacccagagatgatgaaacaggaattttgttaaggcaaactatttccttaactataaaagtgtattaaaaataaaacatgaatatgggtaaaaacctggatgcttccccaaggaccaaagcaaacagagtggcataaaattcagaatgttggattctgagtagacacctggggtcaggcttggccactaactccattgggcacattgtccacctccatgggtcttagttttttctctggtaaaatgagtgtgtggaggtgatctctaaaatctttgtacctaagcatctagggggaattcacatacaaaatgggatctggtcaataaacatatgggactgagaggagttagagtctggctttgagccataaagcagtctatggtgtctttgatccaggtagtacccaatccttccttccctggggcagttcgcctcatggttcagccttggagagagtggctgcgtggaaccatgatttaggaggatgtcaaaacatcatgattaaacatttgcaaatatgatcaccattatatttgcttatgtgcttgattataaatttcctatacatgatgggttaaatagctatttggagagtgaattaattaatgagtgaatgaatgaagtgtgcagaattccgtgggccatgttttaatgtaactaatctgactgctgttgtctacttgggtattcagttttcctgaactgaaaactgacctgctcaccaatggctctaacgcttcttcttctctgaggactcaaattaaagctgccacttctgtcatgaaacagctctcagagaagcaacttcccaacagctgctattctccaataaatggtcttccagggaatatgccattgcaatgccaacctatctgatttcaacctggtctctacaaccctgagggagggaggcagtgggcatcagcctagagaagacctgggctctcattccagctctgcctgtggttagttatgcagcttttggtccattgtttaatttctctggaccttagtgtctttgtctataacctgagagggagagacaggagggatcgttttttcctcctaacactaacgtagaaactgtaaaggtctcttaatacttactctaggttctttggtgccaatctgtgtctaaaacgtaataacttaggtgctccaacccagcctctgttatttcaatgtgactccatttctcaccacaccaaacacacacacacacacacacacacacacacacacacacacacacacctcattttccctagttcccctctctctgcttctctgtctccctctccacctctctttacctgtcttcagcatacttcctctccctctgtgcaattccaaaatttgaagagcaatctttgattgataaatgtaaagagttcggggaaaacccatcttcgagcggcaaaaccaccactgcagagagatttcacatttcagtccctgcctttctccaaatttctatatgaaaactgagctaagagatcactttccattacctacttagcccggttatctcttctcttggcccctgatgctaactaggtaaccctgggtgagttacccaccatctctgaatcctggttctgtaccatggggatggcgatgccaacttcatgaggttattgtgcatgttaaaattccagggcttggcaaagggtaaattcttgctaattattatatagaaatattagtaatgatattcatgacctctcttgtgtgtcgaggcttatctagaaggcactggaatgcaagtatatatggttctgtcagctcagtctggctggcataagtccagaactgggtcttctccttcctggggctaaactgcgctcacctcattctcctgactcagtcccttgccagagctcatgagttaaagacacacaaaaggctcctgggtggtgaggagcagaaagaatttgaaatgagcttcttttcttcttgcagagcttccgagacaaattataaagctccagtaatggggaaaaacacagaaagaactccttagacctgagagtggtcatcttgggggcctcagaccaccatgctggttcatgaggatgtaggtgcactcagcatcagcacaatgtaagtctatcttaaagcacattttcttttacaagtaaattaaacaagtcagcatactgaatagttctcctactcgccaggaaaaccagagggcaagccatgaaagaagcaaacaacaaatgcagcccgtgctgttctcattctgtctgtcagtgcaggcgagagggggaaatacaccaggtcagtgttcccctggccaggatcctttcccatccttgctcagaaattttctttcaggacaaatggcctacggagaggacccgtgtgcgatattccaatgacagttttaatggaaatacagccataaggtttggactgacttgattctagaaagcaggaaacaaatgcccacttttaggagctggcatgacagcccggtggcccagcttggttccctccccgccagccccgtctgggtgaagctcctgcttcgtagagctcaggcctctgcacagaaacagggcatatggctttgacttcagccagcgcaggagggggaaggggacgggccccataaatcacttgcaaggctgccggccagacatgctgctaagaatcaccccaaatttccgtcgtcttcctttgtttagggaactgtttttttaatttcaagaagtgcatccattccacgtgctctgagacctcaaaatatcaacattgctcattgtcaattgccttcacccctcactagaaagttacccttgcccacgatcagctctgagtctcctgaatctcttctcccatcacaaactgactgtcctgtgccccagaaagatgctgctgggactgtaatagaggtgaagccatcaaggatggaaactttggatcccagaggtgggccctctaagctccttcgtgttgcagggttagggcacaagcagggtactgacaatgttcaaggaggcccctggagtcgccagaagataactatcaggttctcggttttcactgcgactggcgcccacccttgataaaccaaaggcaaacccaattgaggcattccagcagccaggtcagttgtcagcaaaggcatcacagaggaaggcatttggggtagattggaactggggaataagcagtcaatgggaatcgaaaggaagtagccagtggaagcagccccaagctcttctccagtgagcgagcattgcaccaaccacaaagagctgctgcattaattacatgtctccttgctaagattcgctcccagagtgtctacgaaaactaatgactgcaatcacagcatctctcaagaacttttcacctgccaagcgctttacaagattacctcattaatccactctgccctcctatgaagctggtaattatcattatgcccagttcagagatggggcaactgggcagacatgaagcaaccgcctgaaatccctgggcacatcacagcccacaaagcagagcacaggtctttgagccgtcttatttctgttttatcttttatcccaggttccccattgatacaagcagcccagaagagggtagaaaatagatgaggtggatcttaattccatgcaaccgctgattaatttccttttaaagccatcattctaaaaacaacaacaacaacaaaagtgactgttttataaatgaggtattgctggactctagccaatgacccatttattgccaaaacaatgcattaattcaatcaacagatacttatcaaatacctcccatatttcaaacactataccatgtactgtatacagtgctaacttagtgtaaaaaataatatggatgcacgttcgattttgttgtaatattatttaacccaaatatagggaattcctacagactatttaattaaaatatctattgttttaaaattccctttgaccctaacttttgcttcctctagatttcattgatacaagaaagaactaattttttaacactgtaatccattaacattatcccaagtcttggaaaagaaacacttttttttttttagacgaagtcttgctctgttgcccaggctggagtgcagtggcaagatcgcggctcactgcaatctccgcctcctgggttccagcgactctcctgcttcagcctcctgagtagctgggactacaggtgctcaccaccatgcctggctaatttttgtattttttagtagagacgggggtttcaccatattggccaggctggtctcgaactcctgacctcgtgatccgcaagcctcggcctcccaaagtgctgggattacaggcgtgagccactgagcctggcctaagaaacattacttttgcccattaatggctctgaactttttctgcagtgacttccattaactgatagaataagtaggtgtttctcctcttagtacccaacgtagagcaggcagccttcctcgtgccaaggtgataggacaacctagagtgtcaaagatttaggatgttaattttcattattatcatggtcctttttttaaaacctttccttcaatgccctcagtttaaggttctgtgagatgaaaatgagttgatgtttcatccttggctatgtctctaggatcatagtaacaagatttttgttttggtttgttttgtaacctgaaagtttccataaagatccaaggctgacacctttgtatttatgtgatattaaatatatgctattacttcttggcttaaaattttaaaaagtaaatcatatgaattttgaaacaaggacccatgtacacaatttgtagaggttagaaactataagaatatagctttcaaaaactcagtgcattctgagggtagaaaagcaaaactgacgatttctctagtgatttctgattatcccaactgggattaaaaccaagtggcccatgtatcaacatgagaaggatagaggaatggttctaggtcataggatgcagctatggaattctaggaaatagagatagttcagatctgcatattaaaatcccaaatcagttccttccagaagggtcgggaatgtgactgcccctgtatgtactgttggttgccagagcagctgggaagggagagggaaccatttatcataaatccctcctggggtgcctcatcacaccctctttgtgttgggcaaatgcttcacctctataagcgcaaaggcatggtaaagaccttatcacatagagtcatgaagaatgaatgatcaaggtgtcaattgggccaaaatctgcagtttaaaggaggaagactcaagacttggaagcaacaaacataaatactgctgggccactggaaccagtgaactgaacgggtgtgggtttcgagcagctttcccaacctcggcactgctgactttctggactggtgaattctttgtcctgggggtgggagggggtggggctttcccgtgcattgtaggatgttaagcagcatacctcatctctaccgactaaaagccaatagtgcccccgaattgtgacaaccaaaaatctctccagtcaatgacaaatgtcctggggctgggaagagggaacaaaatagcccccaattaagaaccactgtttatcccccaagtactttttcccaaagttagataaagtttggggagatgctttaagattataaataatattttctgttacagtgccattgaactactagatgaagtaaatctcatttctgcttcatttgatgcttaggatccctagtagatgttgtgctctgtgtgtgtgtgtgtgtgtgtgtgtatgtgtgtggctatgtagggttgtttcacacaaacactcagaaaaacataaagcagaaaaatctgtttgaaaaatgtttccccaaaagattcatgatataaagagaacacattcataaaataaagttttaaaaatgggaggagaaaaaatcatgtttttatactgcagagtatgcactaattgaactgcctttattttctttcttatcataaagagactccaagaaatgtaattgcaaatgtagtttaaagttaattatactattataaattatatccttttactactttctggggaacactaggaattttagggtgactagatgtatataaaaatacatagagtagtcaatatatgacttataacattgagctagcatacatacaatgggttcccacaatgtttcatggaaataaacaagaacaagactctttcttctttggaatttctaagaagcatttaagttttagtgtcactagtgctgtgtaatgacaaaacacattttattcgagagactccgcctggggcaggcagataggtgtgattaacagagttagaacaaatgtacacaaagaagatataatgggcctgaattctacaaatagagtctatggctgaagagaaaaagtgaggttaagaaaggtatgaggtcaagctcttgggatttttaaagctatttttataaatttcatgtctctttcagacacatgacgctctgtgtgtggctgagttcttgggaacacacatctgtctagaggtttacaataaggaagagaagaaataaggaaaaaatagaagcagctcaaagggatgtcttcatatatcttctcatttaattcttataatatccctggtaagtaggtattgctccattttaaagatcaggaaattagaggcctggaagtaacctgtcatgtcaaggagaaagcaaagatgccagatgccacagcctaagctcaggtctgtccaatttcaaggcccttattttactcatacaccatttggcagtagcctttctggttggaatatctatttttatatatagaatggactatactcttcattttctttcaacgtctacaattcaagcaattaggaattcatttagaatacatgaatttaaaactacaaataagtcttggttcaaaatgtacaagtcaggtttgcgttgggataaataaatataaagagatgagcacatttctctgaattttaaatttgggtcctttatttactaactaggtgtcctggagaatatcacttagctttgggaaaactcgattgccatattatgacacaagacctaatctagatacctaatcactctgtaggattgttttataggaaataatgcattctagaatctaaatcactgaactacaaatgttagaatacagcctaacattaaaacatcagtatcttaaatctagctttggtgtagtcattcattagtgggtaactaatctgggttttaaaatttataaaataatacgccacctatttcatgattgtgttgcaggcatcaaatgggatagtatatgccagagtgctctggaacatgatcaaaagagtgtcattattgccattattattacttaaataatgagaactaaaaaaatgagaaataattactgtgttctttatctatcatctgtctatatatttgttttgttttgttttgcttcaaatctaaaatataatggtcaacttatggcacagctgtgaactacaaaacaaataaaacctttcaatataaatgttacgtagcaaaaggcagtctctctcaacatgataggccacttgtgccatccacaacaatgcccacgacagatcattgaacatgatttctttttataaatgtcattagtctgatcaatgcacaccttagacgctctttatccatattgcttcagcctgagatctacttatttctgcaaatagtcctaaacagtgcaaatgtaatatattgtaagactccctcgatttatttattttttcattcatcttcataagaaaactacagcagtgaaatagctgcagttcttcacatgctacctacctgccaaggactccaacaaactagtgaagattaactaatattttgagaaagccattttaagcctgaaatatttgatgcgtgatgaaatctacaacatgtccctatggaaacacgaagcttggggactctttatctgcaattcatgtgtatgcatgagacaatcagaagcaatgttcttcctgggctaagccaatagccaatagagataagtcagcatttctgctatgtgaaaactcccagggagctaggctaatttttccagagtttctacgtattttgtgcttctaaacactccaaatcaaatggaagttgggttaggaaaatctccccatatttaaagcaacaattgggtaatgattacccactaagcgtatgccgttaggatgaaagccagtgacaaaactttctgaggtttggggaaaataattaggggcagaaatgggaaacctcagatatatttctacttctagttgattacaaacagagccatgaagtcccatgataatagctctgggatgccactggattggcaaggctgtgggatggggtggtggctattcctggagtagtaaaggcaactatgtaggcagcatcagtaatgcatctattcacaggatcagcacaaaatatgctcaaaacagcaactgtagcataggttagttgtatttgaaactggctgctttatgagtagcctgaaaatcatccatggttgtattcattgtctactgctgctgtaaaaaattcgtacgagtttagcagcttaaacaacccgaccgtattatgttatggttctgcagttcagggtctcaaggggctaaaatcagggtgtccactgggctgtgttccttctggaggccctaaaaagaacccatttccttgcctttcccagcttctagaggcccctgcattccttggctcgtggccccttcctctgccttcagagccagtggcgttaacatctctctgaccctactccattatcgcatctctttctctgaccccaacagagaaaagttatctgcgtctaagggatgccatgcaattaagggatgcattgccatgattagaccgggtccacctgcataattaggatactctccacatctcaaagcccttaagcttaatcccttttgtgaggtccctatgatggctgattttgggtgtcaatgtgactgaattaagtgataataattaacggatggtaattaagggaattaattatttattttgaatcactgcattaattattctcaatgcttcagcaggaccgaaccagcccctctcctgcagaaagagaaacccaggtgatttggcatttgattagaatgtttgagctgccccaggggtggggaagatctgtcctcagtggggcccagatgggacgaaaaggctgaagaaggatggattcttgctctctctcctggagctgcggcacccatcttctcctgtccttggatgtcaggactccaggtttcctggctttgggacttcaggaagaaaaccagtggccccccaggcttttgggcctttggcctcagactgactgagagagataccatcatcttctctggttctgaagcctctggacttagactgagttatgttatgggtttttgctgattctccagcctgcagacagcccatcatgggacttctcactgcacagttgaatgagccaattcccctgataaattccttctcgtctctctccctaaatagttatcatgtcagttctgtctctctggaaaaccctgactcaacagtctcttttgcaatataaggtaacatcttcacaggttctggggattaggacaagggcatctttgggaggctattatcctatctaccaccatggtctatgatctggagatttccaaattcctcacctatccatcttcttagtgggaaattcctcccaccctctgcagagagccatctggagttaggctgaccatagctgcagaagtcagtcggcctgctgcatattaaccctaagaatccattattgctattaatcatttatacagccaactctcaaagctgctcatgataggtgccattatgacaactgttagagcacaggaaattctcacttaaccctgtgaataggctcttggaaactgcgactttaagtgaaacaacataaaacagaacgattttcctgtgggctaattgatatacataagagtgacgttcccacggtacgtttcgggtcacaaaaacatcaccaaacttctaagtaaagaccaaatcactcctaatactaaacacttagatagatgtgaactatatgtattatgccattcttaaattgctgcaaagatacacttgagactgggtaatttataaaaaaagagatttaattggctcatggttctgcaggctgtacaggaagtgtaacagcggcatctgcttctggggaggcctcaggaagctaccaatcatggtagaaggcaaaggagagcaagtgtaacacatggcgggcacagggacaagattggtgggtgccacacacttttaaatgaccaggtctcagatgaactcagagtgatggctcacttatcaccaaggagatggcccccatgatccaaacacctcccaccagtctccacctccaacactggggatcacatttcaacgtgagattcaggcagggacaaatatccacagtacatcactatacatacatttttttaaaagttagtaaaaataaaattatttaccccattattccaggtccgggttgcaggtggctggagcccatcccagcagctcagggtgcaaggcagggcccagccctagataggatgctatccctttatagggcactcacatacaaacccacattcacactgggacatgaacctcacatgcatatctttgggatgtgtgggaaaacaggaggacctgaagaaaccccttgcagacgggtgggagagtaggctcactccacacagagagtggcctccaccaggaagtgatttttctttttctcatcaatgttacaaagaaatgctgttgagtggaaagtcattcaaggacccactgtctagctgtgttctattattgccttcttctttgttcatcttcttacaatgctggatctgggataactttgcattaaatatctttcttatttaatgactggcatctataaaaatgtaaagctcactgggaagtcagggaagcatttttctgctgacctgaagcatgatttgcatttttaaaaatgcacgtcataagcacttagctggagtgaaataaacttgcagtgctctcagaaactgaagcgtggccaatgtcacggcatttatgaagtcttatcagtggaactcttgtggctgttacctcataattagcttactcagtacattataattaatttttataataatttaatttagttaataattaattttttggttcttttgcccaaccacactggcaaagaaaatcagaaaaaaaacctatattgatcaggttaggataggccatacagcagcatgaacaaatcctgatatcccaaaacaatctaataaaataaaggtttgttttttttctcatgtaaaggtcaatgcagctcaggtaaacttaccccagcttgcagttatgccattaggaaagcatagttgccaagctggatggaaagacatggaatggccatgctggctctgaacccctcagctagaaagggacacatgtcactttcccccacaaccattggccagaaggaatcacatgaccctaacctgcatccagaggagaccaggtagtccaggggtgcacacggtcatggggtgagggctatatgtctctgccaatctatgaccgtcatccctttcactgacttcattgaccttattgtgaaagatgacgaaatggaggtcaaagtcatctgtagccaaaccgaccaagacactctccatcctaacacgtctattaccaacctgacattttgcttctctagaatttcctaaaggtaggatcactttctctctctaagaccaattctctcaagaatttataagaaaagaggtttaactggctcatggttctgcaggctgtacaggaagcataacaacctagtgcagctacattccattaaagtcatggcaatttcagtgagtgacactttgaagccacatcatttgtctttctctggctgactttccttgaaggtggtcaggaatattgacttgccttaatctcttacttcacaatggggcttgaatttcactttctcagatgtgtttgaggttagtatttgaaccaatttgatttatgaatattttactcaaatagacgtcttggtctttgaaatatcttcctattgccttttaaaagcatcttggctggacacagtggcctgcacctgtagtcccagcactttggtaacctgaggcagacggattgcctgagctcaggagttcaagaccagcctgagcaacatggccaaaccctgtctttaccagaaatacacacacacacacacacacacacacacacatgcacacacacacacatacaaataggcatggtggtgcatacctgtggtcccagctactcaggaagctaaggtgggaggattgcttgagcttgggaggtggaggttgcagtgagccaagattgcaccactgcactccagcctgggtgacaaagtgagaacccgcctcagaaaaaaaatatatatatctttttagggggcaatgaaataaccaattctgccatcttagagagcttgggtgatttgaagttacatggccagatttagaaaagtagggacgcccctttattccgttgatctatgttcaaacattcaactttcatctcctactcataacacttacttcttacaacattgcaaaaattatttttccaaatgaaatattaaaattagtaatattaatgggtcagctcatgtaagctgatgatttttttttaagtgaatgaaattagcagtctactctgctcatcttttcagattggaacagagcctggattaagatagaaatgaattctaacctcttcataaactcttccagattcaaacactagacacagacatggccagagatatgatgagctctaatctccacacacctatggctcgaggttctaggtggtcaatggagtctccagggttcttgtttgcaatggggctccaggtcctccaggaagagtggagaggaggactttgggtcctttgataaaaattgatggatattgagagccaggctgtctcatagaaaagttgagatttatttagtcaatcaacaaacacttttgagcacttactagtgcagggcactgtgctggaatctcttatagaacaatcagttacatgaagaataaaacatcaaccctgacctgtgaagggtggagactggtgagaaagaggatgctgagggagatggtggggggagaaatgaactccaaaaaataattatgacgaatgctcaattccatggagaaaataaaaagcgtgttcgtgcagagaatcccaaagggaggtgctgtgtacagacaaggaatgtgccttgaagcaaggcctggaggaagggctgggtcctgccctgaacgcagtcagagaggtgccaggcaggccgccactggccatcatctcaggcctggggcagccacccatgtaagtcgatccctagagggatggcagaacttgacgacaactctctgccctatctcttagcagattacgatcaccatgaacattcttgaggacaaccccagttctaagctcttcctatgcatgatacagttaaggaaacggagaggtgaggtaacccacctcaggtcacatagtggtggatccagagcccacactcttatccactctgccacttcactagtagagaggtgtggttcgctctgaggaaaggaaaagctcataggagatctcgaaacttggggacaggaggaaggagttccagccagttcctggaaagctgttagagctgccgccccagtgtggctgcagacaaagattctcactgaaccagggctcttgatatttctccaaggctggaaacacaaaggctgaacctccgccagggacgctgaagggagaattggaaaaatgaagggacaaaagaggaggatcctctcccacctcttagaaacatgatcattaatgtattgctcagccaggtgtatttttcaaatgcctcctgtccagcccaattccacgtcttggtagcacccggcaagtccctgacttagccagtcagacagggctgcaccagggatgctcccaggagtcacctgacccttccttttccaggtcctcacccttctgctatttcggtttggcatctgaattctgaataagttcttactcctgtccttgagtcttcacacggaaatttcagttttcaggttgacttctgtctctcccacaaggtgtgatcttagactgttctagcaggtctgccctgtttgcaacagtctctggtgtacacttcctgccctggtcaatccttcaaaacccaaactgtgactctagctgctggtcagcaccagtctattccccctgaattctcctgggtgtcaggctctctgtcccactccagattcatggagaccatacaggaagcctctcttgactctgacctcccaggacttatagtcaagtcatagcaactagaccgactcaaggacagtaacagcgattgccagaatcccagctgctcccaaacagaattagacacttaaaaatccacttaaactttataagaagagtctaaacactggacaatgttacatggtggagatgggcaaaacacatcggggtgagtgtatcgcaaccttatctttccttttaaccaaaatgtccagacacaacttgtgtttccataagcacccacatggttggtggctatctgaatattttaaggctaggcacaaatgttaggcagtgcaaagaaagggagaaaggatgaagaaaaacatccaagggcagataataaagccagtttacactttcagatggcatttcttaagttcagttcgttttaaagtttttttccttttcttatgtataactagacttccatgagatggtcaaggtggttaactgcaagcatctctgaatttaggtaaagcgttaagccttttttctcaagagtccacccctgtcttcaaaaatacaaaatggtgagtggccgggagtggcagctcacatctgtaatcccagaactttgggacgctaaggaaggaggatcgcttgagtccaggagttcaagactaacctgggcaatacagcaagaccccatctctacaaaaaacacaaaaattagcgaggagtagtgatgcatgcctgcagtctcagctactcaggaggctgaggtgggaggatcacttgagtctggaggtggaggcttcagtgagctatgaatgtgccactgctctccagtctggacaacaaggaaagaccttgtctcaaaaaacaaaaacaaacaaaatgacagaatgaatcaggagacctgtctctggtcctggccctgttgatgcttggcattcgtcaaatcacatgacctctgggggatagttttttcccaccggaagacagtattttatattagtcaacttgcaaggtcccttttcgttctaaaattcctgcctcactgtcatgcctgccagatgctgcctgtgacactggccatgaaagggcactgggttgctcatgagagctgtggaggaagagttggaaagaagctacgtgtgaccagcttcatgaactggtacagctttgactcaacttggcaacttcctctgtgtggcctcccaagaagggccacaagagccacttggcacaaacctcaccacacgtcttttgctttactcctgcctctcagggaacctattcagtgggaaatctcccttgagaatctcttaatgaaaaggccccagtcatgtggccttttggctcaggaactccgtgtccccattttaaggtacaatttgccactttggccctctgcctctggcttccgttcctgcccagggaagcccaaagttgggtaaaattgtgtgagaagagatagcccctacatggggccccacagccagaaggaaacagatgagaggatcctcgcatctccagagccagccagggcctcactgtcctgttggtttgtttgcttctctatggtgtgaagcctgaccttcccatcttcctgctctgttctttatgccccacactactcacatttgtggcaatgttgcaggcatggtctaaacttcgggctgggattttattattattgttatttaagtatttatttatttgagtcagggtctcattctctgccaggctggagtgcagtggcacagtcttggctcactgcaacctctgcctcccgggttcaagcaattctcccacctcagcctcccaagtagctgagattacaggtactcacaaccatacctagctaatttttgtatattttgtagagacggggttttgccaacttgcccaggctggtcttgaactcctggatttgagcaatcctcctccatcctcccaaactgctgggattataggcgtgagccacggtgcctggccccaggctgggatctgaatgttgaccacatgagattctcagaagaagccctcacagtaacaggaacaaaggttcaaatctgaatctgagccccagaaaggatgaaagaggctctggtctgagtaattatgtcccctcaaatttacatgtggaaatcctcacctgcaaggtgatggtattaggaaggggggcggttaggaggtgattaggttatgagggtagaactattatgaatgggattagtgtgcttgtaaaggggaccccagagagctgcctcaccccttccatcctgtaagaatgaggagagaaggtgccacctatgagccaaaaaggagattccaaatctgccagtaccttgatcttggacttcccagcctcgagaactgtgagccatagttgcttgttgttaaaccacccagtttatggtattagcacttactttgttatagcagcccgaacaaaccaagacagagaagtgagggttcgagactgaacataagcacctcagtgaaccttgaggcaacgcctccccacagttactttcccctccctcatcttccttacagcctctccactcctcacaccgagttgcctactgaagacactctgctgattcttaagttctttgcctactggggaagggaggcccactcagcagggcccagagagaggggagctccggcattctctgacttctcaaggtcatgtcctcccaatggcctgagctccctttaatgcacactacagttggttgtaaatatgcctgttgaaattcagcatgagggagtgggccatgccttgccatgttttgaatggttgaatggtgctcagttcccccagtgccttcttcccaactgacatctggcctgagctgcccaccaagctcgcaacacaagctctatcacttttcccgacattctggaccgctttggcaggttggggctctacatttctaatctgttgggaggctttctgggtttgaaaccgggggcttccctggagagagctctaccgtgttggttctcaggtcactcagtaactgagtccaaggaacagcctgtccttgaaactgcatttgcaaagatataacagctgagggcataactgatttctaaatttcctttttccaccctacccttgttctcctaacttacaaatagtttccaaaatcaagattatacttcttcaccacactactgtctccaagttcccagaggctcaggctccggctgtggcttgaaatgccatcagtgatttatttcttgttagtattttgaaaacacttatcaaaggtcaccataatttagcatgaaaattcaacaattctcccacatccccagaagtcttcctttcagcgactcctccaagcagctttgaaacatttgttcttacaaccctttgttgaaataaataaatagggccagactgcactttcttaacagcaacaaaagcccaaagaagcggcacgtgttaggtggttctacgggtaagatggggaaaagaatctcgcttgcctgagcccagaatttgaatggggatcatgcgttttccagctgaccacgagaaagaggctgtgcacactttacatctcccaagctctgtgtctggcctaatgaagccatcgatttcttcctgtctgacaaatgttacaaggagaccagcagctaggagaatgagagagcaatctttttattttctgcttttttgcttttaattttgtgtactcaggaagaaatgtatggatttctttcttctagctaatcacagcggcacggttgtaactgcctccctttccctttagtgctttgttttccttggttcatcacctgggtaaggtatggacactgcttttctctaatgcatctaacagtgttggggccgtttcagggaatgttgagcacctgtgttggagtccattgcagtgaacctgatggccttgattcatgggtatttagaaagtgagaggtggattcacctgaaacttattatcaaagtaaactatgcccctgaggaggaagcgggattttttttttttttttttttttttgagacagagtcttgctctgtcacccaggctggagtagagtggcgccatcctggctcactgcaacctccgcctcccaggttcatgcagttcttgtgcctgcctccccagtagctgggattacaggtgcccaccaccatatttggcaaatttattttttattttttgtatttttagtagagatggggtttcaccaggttggccaggctggtctcaaacttctgaccgcaagtgatccacccacctcgacctcccaaagtgctacaattacaggcataagccaccgtgcccagctggaagtaagacttttttcaactttcataaaacttaggcagagtctatatttactactacaattttctctctttatacttcttccaagaaagacagttactcctttaatcagatcaaattaccttaattgtgatttggaatcacagaaccaggagtttgaagtgttctgaacattaagggaaagttggaacctggagagatgttgacaataacaacgtgtcctaactctatgtggagtcaatgtgcatgatctcatttaagtcttaccactctatgagaaagggcccatcattcactgcatctcaaagagacggaagtccaaagcaagttacttattcaaaatgacaagtcttctgggtctctctaactcaagcctatggtcataaccactccacattattgctgtcttcgcaggtcccacgttttacaaatgagtaaactgaggtcagaaaggtgggattgttcaacagttagaatgagcagactcacccaggactcctgacttcaatttcttatccttccactttgccatgttacaggacgtgatgactgatgaagacttggggtaaggagcaactctttacctaccttgagtggaatgtgactcacccaggacagaactgaccatttattttttagggacgatgctggccaaggcaggacagtgcgatgtggtggtggagcaaagcggatgggggcagagtgggagcagcccctcgccctggaacctttgcttggtggaaaagcatcttggtgatccccttcctgcatgttggtcttattccactctgaccctggccatcaacatcagaaaatactttttttttttttaaatttagggtctcactatgttacccagactggcctaaaactcttgagctcaagagatcctcctgcttcagccccctgattagctgggactataggtgcctctggctcacactgtaaaattctttatctcttagacctaccaggggcaaatcaccatgtaagtgattcatgtgtagaaacaacataatttacctccatacaagtcaatttttaaaaattaaatacaatcatcattctcaaacagattccaatgacaaatagctctagttttagctataaaagggactggattttgtccttctgtcttgccagacttggctctcagagaggtatttgaaaacaccttggtctttgtatggagattctaaaagtccctaggtatgtggatttctaaaaagcttgcaggaaactcttgtgcttcctttaagaacctgagtgaaaagtgtgaagttttgggctccctctgataaccaagtccaatcttctctattgatattgttgttgttataggctcaatggtgttctctcaatatctatacattgaagccccagcccctgtactcacaatgtggctgtatttaaaatagggcctttaaaagatgaaattaaaatgggtcatatagatgagccctgatccaatctgactggtttcaatttttttttttttttttttttttttttgcaacggagtttcgatcttgttgcccaggctggagtgcaatggcgtgatcttggctcaccacaacctccacctcctgggttcaagtgattctcctgcctcagccccccaagtagctgagattacaggagcacaccaccacacccagctaattttgtatttttagtagaagcagggtttctccgtgttggtcagcctggtctcgagctcctgaactcaagtgatctgccagccttggcctcccaaagtgctgggattacagacgtgagccaccacacccagcctggttttgctttaagaagaagaaattagggcacagactggtacagcaggaagactacataaagacacagggaagacagccatcaattgggttggtgcaaaagtaattgctgtttatgccgcaaggcaaggatcaaggccttggaagaaaccaaccctgctgataacattgatctcagacttgcagccaccaggactgtgagaacatgaattcctattgtttaagcctgccagtctgtggtactttattatggcagccctagcaaactaacacaactgtggtaaaagatacacatcataaaattgaccattgtaaccatttttaagtgtacagttcagtggcattaagtacctccacactgttgtacaaccattgccaccatccaactccagaaccttttactctctcccagctgaaactccatacccattaaacattacctccccattttaacttagtcataaaccatatgcagtgcaactgtctgccttctgagccaaaaccaccttttcccacttgcttccaatgtaggtggggtaaactcaaacagggatgtgtagtaacaagttggtctatacattagagggaccatgtgtgaaaaatatctgaatttctccatttttacattgctgataaagacatacccagagattgggtgatttataaagaaaaagagatttaatggactcacagttacacgtggcgggggaggcctcacaatcatggtggaaggtaaaaagcacgtcttacatggcagcaggcaagagaaagaatgagaaccaagcaaaaggggtttttcgttataaaaccatcagatctaatgagacttattcactaccatgagaacagtatgggggaaactgcagccataattcaattatctcccactgggtccctcccacaatgtgtgggaattaggggagctaaaattcaagatgaaatttgggtggagacacagccaaagcatatcaatatccattagggaccagcaagtgaccctcctaaaggtactggggcttgatttaggctctgatctagaccaagaagtttcacagtttactaagtcaactctcctgcttgcagacaagataaactagcaattgtgattcatctatccttccagaaggcttaatagtctccaggcaagtgctctaataaaatgagtaatcgccttgcgttagccgtgaggaagcaacaacagctcagcagcttaaataaaggtaggagggatggggaaactaataaattctaatacagccctgtcacaagctcccaaggagattcttttcagttaccctcactgctaacgggagccaaccacactctgaaaaagtgtgggggacccttccaggatttaaagcaaaataaactatgtaaggaaactgagaaatcaatggagcttagactccaggtcatagcagacacaggtttaatgagaacacatctacaaagggacctgcacaagtttgttcaccatttgattgatcatttagctgtggtgaaaatttaaaattagggttcttcaagcaaaaatttatgtaaacaaccttcttccttctgcctactgctctgagggacaccttattacatagactgatatgttctccatagattgttgagtcaggagacaccacttaagccttagctacaaccagaaaaagtggtttcctaggatttgccatattattaaagtgcatcgctccagaaagcattgtgaaagctaaagtccaaataacattgccactggacatttaagagctatgtcttcaagggaggtcagtgtctcttatgagttccaggcatcagcctgaagcttaaactcacaaatttgaagggattatcaaacaacagtgtcaacagaaaacagcacttgctaaatgtcattcacaagcttctccttcaaccgtaattctcagctaaatcgcccaacctcagatttggattccttgtagaagctaactttagtaagatttccagggttaaaatggttttgaattggaatgacttctgccagttttgtggttgttaagtagcagcgttcaacttggcaatagttgaaaagctgatcactgaaaagacagcaaaatgtaaaagaaactacataacagacctaattataagcttattttattattttaccctctatatccctatattcatggtaaagatgaaaaagaccaaggaaaacaatccagacaaaacagactatgaaaaagataaaacccagataaaagagactatgaaaaataaatccaagaaggggaaatctgtggattggctctgtttattggtattcacaattctggagtatttattttctcctgtgttcagacccatttactcatcacctcataattacaaggattcctttgataatgtgtaatgttggccttcacttgtttgtttataatatgtgtcatttcaacaactttgttattttgcaagtttgcctgtaggtcattgaatctgagctctggttttaaaatacccaatcgtgggcaagtttctccacctctctgagaataataataattaaaaatatctatccttcattcagatttataacggagccaggcctgggccaagggtcaaacatagatcatctcaattgatcatttgacaagcctttgaggagtgtgccaatattactgtcaatttgctaatgaggaaatcgatacttgaagaggtaagtaacttgctcacggtcaaacaaatagttggtaagtaaagagttggtgtctccacccaagcagtccaactatcctattttacttctcagttatctcaactatgaaatatgggtaaaaatacttaatgtattgggctgtaaaatttaaatgattacttatgtaatcagttccgcagaggctggtaaatagcaggaactcaagaaatattagattgctaatactgttcaccctcctacagtggccaaaattgtcacaatacccataatcatcaaataaactctaccaacatgtacttaatggaagtatgccaaatcacacttctagatagtgatggtggtaactgaaatttataccaacaaaacccaatttaaactattgttgcaggaggctgggcgcagtggttcatgcctataatgccagcactttgggaggccgaggcggatggatcacgagatcaggacatcaagaccgtcctggctaacacggtgaaaccccgtatctactaaaaatacattttaaaaaattagctgggcgtggtggcacacacctgtagtctcagctactcgggaggctgaggcaggagaatcatctgaacccaggaagcagaggttgcagtgagtcgagatcgcgccactgcattccagcctgggcgacagagggaaactccgtctcaaacaaacaaacaaaaaattgttgcagtctaaaaacattaataaggatctctcagcaataaaatataagtgtagtgactgtaaaacttgtgtggtactatatgcattggtatactacttatgctatatgcttctatggttgtaatatagctccagtcctcattcgtgtcttcccttcctggaaaactcctattcatccttcaaggtcccactcaaatgcttcttcctctgggaagtcttctcttatacccgcaggaggaggaagctgccctttcctctgtcctactacaaaattgcagggaaccacatcctaggatatatttgatacccaggtccaacacagagcctgatacgaagaaagtatacagcctttgcttatttaatgaaggaacactttcaacgtgctgattttgaatttgcaataatctaaatatctaagattgtatggagtagggtttaatgtgtaagtattgcaaagtccttcaacactcattagacttttcatattagagtaagtgacaccgcttcccagcgtgataagagtgagggtcagacaagcaaagcagggctgctccaacccacctttcctagtttctatattcacattcttgggtctgagcccaattattgttttcacaaagccctgtctaggattcctagttgagctggggctacaggtatcagcttgtatttcataggcaagagaaaagatgcaggtgaaaaacacgagcttgaaaagcaaagttcaactggggcaccactggaggcattggggtaggctctctcttcaacctaaatggagttttacaagatttcactagcaaaacagctcctgcccatggaggcatgtggaaagcaaaatcctaatatcccttgttgctcccaacactgcagcttcagagtgacactggtctgttccctggttctaccacatgctgtgagactataagtgattgagtcaactcatctgaccatctgtaaaatgggtataataatacctctcaaagttatgaggtttatatgaaataccaggtgttaagtacttattgtagggctgaagactgaatatggtcaataaatattaactcccttgttgacttccttcccctttcactttttccactgaagtaatttaactcatgatccgacgtcagggatcactgccagctgactggcaatcaatatatcacgttctcaatttgtctcaacgtccagtaaactaatcaaatggtaatgatgatgttttgggctgaacaggtagagttgggaaacactcttctgctacccatttagtcaaaaacgcaagatggcggatccaaaaaaatgcaaaatggtggatccatgaaagaacttctgagttcccaagatatcacagcagtgcaacatgtggatcattagaattcttctcatgtatcatggtgctaatttaagatcagaaattgcccttacttattctgatttccaaagtgttgacattctctcatctaagctcctgttcttcttggactccgtaaatggatttgtgtttggctggctgagaaaaggaattgcaaatgcttggtagaactttcttctctcatcctctcaacactgagaaactcaaaagagaaagaaaggatatggtagcttttgattctattcttgctcaactatttcttagactgtctcttgaatggaagcatgggaaggacgagacgctcccgtgtccctcagcaatattgccaaacctcctggctgagtgaacttctgcaacttgacctcttgcctttccaagtttttgctcaaattgcattttttatattcatgctgctctttcttaagtagtggcttgagaaacaatgtgccaggaaaatcaaaatttttatgatagaaaaagagctacaagaagagaaacaaaaccatctcccacttctcagttaatctcagtatctaataacaccctggaagtcaaacagctgttttttccagcaagatgcaagagtcctggtgtacacctgtctccaatgccagaagtcactttcactattgcagacatgccctttggaggccgtaatctttccccagcatgaggagtatgaaaaccctgcatgtgctctgtgtaaagcaagcctaaacaaatccacccttcaaaaaatccatttggtttgaaggcagggatgacaccaagggaggggatggagggagacagagtccatactgggaagcttcctggatgggacaaacttatcaaacattaggaatctcgttgcccctgctgctgaggccaccaaaagaagtgaaatggcaatggtcacatggcctcctgttaaatgattggaacaacacatttgcattctcacatagactatatttcgcatcactcttggcgttctgcactgttaaggtcaatctctaataaaattgcaaagcaggcaaagtctatcttctgacttcacccaccagtgtcccaatatttcttcttgctgccatcttgctctttgacaggccccccgctccgtgatgcattcatgctctcaggtggtcatcaggcatggacctgctgaggtgtagactggccgttgtgctcttcctcttccgtgtttctatagaaattctatgtgtgtacaattgcataaagaaactgatcccattgctgagattacagctttcttacatgttctgcactagcctgcaagttccctaagggaagaggctctgtttccttcctttttgtatcctctcatgttagcattgagttttacagttagtagttacagaatgcattttttaaaaaatgaattgaatgaagtgattaggatactagttaataacaccttaagtgtattttctctgagccacataaatatttcaaaagataacaaaggaccacaaaatctttaggatccaaagagtaagatgtcaatcagtgggaaaaggagactgcacccaacgacttctcagacccaattgtactgatagtcaccagcaacgcttataaatgagacagtttctattgtaaaaatatttctcttttcactagttaggaaataaggcgcctctccactgccacatcaaaaagaatacttagaaataaacctaacttgctactcaccactcaccctactgaaacagttcactctaccttcttaagactgctctctctgccagttcttgaggccttttttgcaaagacctggcagataaaatgaatgacaagtgccagttttgagataaataggatgttaaaaccataattctttaacttcagaattgacaaaacagctcttatccaaaaatctcaaagtggcttacacgctaaccatatgaattcttcctagactcccaccaagaaacaagatgtttatccttcatttacagaggaaattgaaactctagaataaatgactttctacggtgaagagatggtgatgaaaagacactggccctgagaagaaagacttatgccaacccatcccctctcatcacccttttcatcttttccattcctttcttcaagaaatacaagtatgacttgcagagtttaatcaggttagttaggaacaggtggattcataacaaagttcacagtcgaacttcccaacagtaaagtagtaggatgccccgttgctcccaaatcaaaattggaaatctccaaagccctctcagaatgtactgatatggtttgcctggagctggaggtggtgggggctggaggtaagggaaggagacaaaggtttgctcaaattaaaatccaacttaacatatgaagggaactatgtgcaactgtacactgggaatttagacttaccacggtctaaagaagccatcactatgtgttaataataccccagtagactaaaggatgctgcattatggaatggaagaagagcgattttgcaaggcttcatcttgccagattttaggcaagatatgcaacctttttaaaaaatattaatttatttttaaaattgttattgtgctaagaacacttaacatgagatctactctgacaaatttttaagtgcacaatatttttaattgttaacaatatagctattgctacctataggcacagtgttatacagcatatctctagaatttattcttgcataactataactttatatctggtaaacagcaacgccccatttctccctctcctccagcccctgcaaccaccttctactctctgtttctatgagtttgactattttagattcctcatgtaaatgtaatcatgcagcatttgtccttctatgcatggcttatttcacttaacataatgtcctccaggttcatccatgttgttgcatatgacaggatttcttccttttcttaataatgaataacattccagtatatgtatatactacattttcttcatctttaaatggacatttaggttgtttctacatctgggctattataaataatactgcaatgaacataagagtgcctatgtctcttcaatatcttgatttcaattattttggatatatacccagagatgggattgctggtttatatgataattccatttttaattttttgaggactcattataccgttttgtatagtggctgcacaattttctattcccaccaacggtgtacaagggctccaatttattcgtatctcaccaatatttgttgtcttttgggttttttttaaataaaataacagccatcttgacaaatgtgacgtgatatcatgctgttgtttcatatgcattttcctgatgataagtgatgttgagcacattttcatatgcctgttggctatttatatgtcttctttgaagaaacatctattcaagtcctttgtccagtttttaattgggttatcgtcattatctatttgcaattcagttgtaggagttccttatatattttggattttaatcccttgtcagatacatgttttgcaaatttttttacaattctgtagattgcctttttacaacaaactaagtataaaagtaatttacctcaacacaataaagtccatatatgaaaagcccccagctaacaccatcatcaatgatgaaaacttctaacggtgggaacaaagcaaggatgcctactttcaccacttttattaaatgcaatataggaagtcctagccagagtaattaggtaagcaaaagaaataaaatgtgtccacatcagagaggaagtagttaaattactactgtttccagatgatatgctcttatatacagaaaatcctaaagactccacacacacaaaaaaaactcttaggacaaataaatgcataaagttgcaagacacaagtcaaaatataaaaatcagttttttctatacattaatgatgaactatataaaaaggaaattaagaaaaaaatcctatttataattacatcaaatcaaataaaatactaagaaataagtttaactaaagagatgaaagacttgcacactgaaaactacaaatcaagatacaggtaaatggaaagacatcttgtgtttatggccagaagacttaatgttgtccaaatgtccataaaagccacctataaatttattgcaatccctatcaaaatcctaatggcattttttatagaaataggaaaaagtcctaaaagtcatgtggaactacaaatgaccctgaataaccaaagcagtcttgagaaagaagaacaaaactgaaggcatcagacttcctgatttcaaagtataatacaaaggtataataattaaaacagtatggtgctggcataaaaacagacatacataccaatggaacagaaaagagagctcagaaatgaatgcatatttatatacagtcaactgattttgacaatgatgccaagaatacatactggggaagggacaatcttttcaataaatggtattgtgaaaattgaaaaaccacacacaaaagaataaaactggacccttattttacatcatatgcacatataaatcaagtcaaaattgagaaaaaacttaagcacaagacctagaactataaaacttctagaagaaaacacaaggaacagcatcatgagattgggcttggcaataatttcttggatgtgatgccaaaagaacaagcaacaaaggcaaaattaggcaagtgggatgactacaaactaaaaagctctgcatagcaaaggatactcaaacacttttaagcccactctcttcatctataaaatgggaataatggtacctacctcacatatctttggctccaaaataagtaaaatatatgataaatgacttagcacaatggctggcaaataggaactcaataaaaggtgtctattattactagtgaaattgattttttaccccagtgtaattactggacatttcaggaatgtgggagttatccacagcaagttgaaaagagaaataaaatgaaaaaacccaaactgtgatatttttcactcaaccattacttcctgagagtgatactatgaagaaagggaagattcaagttaaaccagggaattccttcctattttcaatttttataaagatagaaagaatgaagaacatttgcttctttctggatatagattcagaacactggaaataacaaagagatcacaaattcatacatttgtaataccatctaaaatttgtaatgactttccaattatcttaccaaagagaaaactgaaaataagggattgacaaataagaaaattagtgctatttcaattaaaatcaggtagcctgacaacagcacatgggttttattttgaaaagtgtaagcaggaggaagacttaaatatagatattctgacccagggtccagatctttctactacactaccatgtataaaaatggctagtcatcatgttttcttggtttgatgccaagaatgcaaggttggcttaatagagtaatgtaatttacctcattaacagcttaaaggataaataccatctgatcatttctgcagatgtcaaaataataattcaacaaaatataacatgtattcacgataaaaataaacaaattagaaatagaaaaaaacttcattttccagatatctttaaaaagtatatttatacaaaaacctttagaaagtaacacatttaatggcaaaatgttaaaagcattacatctaagagtaggaacaagctaaaaattcccaccattactactcctactggagtagcatagtaagataaaaaactatatacatatataggaattggaattatattattattaatataaaactcaaaagaattagcgaataaattattaataggtgagcttaaaagattaaataatttgttaaatttagtcattttaaaatgtgatgtattaaagctaccatcataatagttatacatacatatatatttcttaggaataaatctaagtacatataggtgctttataaagaaaatgagaaaactttaatgaaagactacagagacctaaatagatatctaaataattcatggataagaagatttgaagtgttaatttcccccaaagtaatccatgtattcaatgcaattccattgaaaattccaaaaggaatatttacgaaactggatgagatgattctgcagtttatacggaaacataacttggaaggaggattcgtcttgcagatctcatgcattttatgaagctatagtagttaagacagtgagatactggcatgtgtatgagaaataagccaatggaatagaacagaatgctcagaaataagcccatgcttatatggagatttgtcacagaaggatattgaagaccatcaggaaaatgacagacaattcaatcaatgatgcagagacatcattccaaatgcaaaaaccttaaatggcatatcctcctcacatgctacacaaaatacatccctggtgaattttattatatttaacaagaaaaatgggctgggcatggtggctcacgcctgtaatcccagcactttgggaggccaaggccagtggatcatgaggtcaggagattgagatcatcctggctaacatggtgaaaccctgtctctactaaaaaatacaaaaaattagctgggcgtggtggtgggcacctgtagtcccagctactcaggaggctgacgcagaagaatggtatgaactcgggaggtggagcttgcagtgagctgagatcacaccactgcactctagcctgggcgacagagcgagactctgcctcaaaaaaaaaaccaaaacattttttaggagaaataggagtttatgatcttcaggtagaagttcttaaacaaaacattaatacataatccattaaagaagatttgtaagtatggttacattaaaataaaaaatttctgttcaccaaaaggtattaagaagagtgaatacataagccaccaaatggagatattacatttataaatgacaaaggataagtatcatgaacacataactgataaaaattaagaaaaagacaaacaagtgatagaaaaatgtgcaaaaggtattgctatggtttgaatgtgttccccaaaattcatgtgttagaaacttaatctccaatgcaacagtgttgagaggtgtggcctaataagaggtgattagatcatgagagcaaagcctaataatattattatcatgggagtcagttggttgtcacaagagtgggcttttttgatcctctctgctctcttacacttgcactctcttgcccttccaccttccaccacaggatgatgcaacacaaaggccctcaccagatgccggtgccatgctcttggacttcccagcctccagaactgtgagccaaataaattcgtattgcttacacccagtctcatttattttgttatagcaacacaaaatggactaagacatacaacaaactgggagtttacaaaagagtaaatgcaaatgtcctatgaacaaaaatgttgtacttcactgataatcaggcaaataacaaaaatcacctaacacttagcattgtattatcacttcacactatcagactggcaattgtaagttttgatgaagatagagaaaaaaaaaaacaagcaatgcccgttgaccagtggttagagattaaagtagtacaacctcttgggaaacattttgacatgactcaagttttgtttattctcagatccaacaattccacttcttggcataaaccctggagaaactcttgcacaggaaacataattcaagaatgtacacacagtgttgtcacactcgtgaaaatatggaaacaagccagatgtttatcaacggtagactgaatcaatagatgtgctagattcacaattgcacattatatatcaatgttaaggaacctcaaagataatgtaaatttaagaagaaggagaagaatacttgcaggatgattccagttatatagagttaggcaaaactaaatgtattacttgggaataattccacagtaccacaaccaagaaaagcaatgaaattattcacccaaaatacagactggttgatacctccaggtggggtgggagagtgtgcagtcaagcaggggcacccaggggattcctaagtgccactaatgttgtttcctaaccatactggtagttatattgatgtttattttattcttcttctttatactagccatatgtttgatatattattttgtgcatatgatgtattttctgattctttaatataagaaataggcatatttggctttaaaccattgtgatgttaaaactcaaggtctcacagaccagaggtccaaactgcttagtgtgaactaataaaaaagaaacaggtaaacaaacatattaggtgtcctccacgttcacaaggcttgacatagatacaataataaggccatatggctttgcagtaaatgcaatatctctgcaaagtattgcaatccatagttcactgaccctcactataggcgttattattatgctctcttcatgtgtagtgtaaactggcccccgattcaggcagattcaaatggacaaatcagtgaaatggaagcctgcagtattcttttaaaaaaagactaataaagacataaaggcgttttctctacaacagtgagcacattctgcattgcgttaacctgctgacactatttgtaatggcatagaaaggtcactaaagcctaaatccgctcagcaagattcgctaccacgatcttctaaaaaacacgagctttattaaatatcagctctcatcttatttccaagaaggcaatccaaaggttatggtgggctcaggtgtgaggagcgtgtctattattgcgtcttgcatttgcatagcatctgccctcagaatcattcagcacgtctcctttacagtctcacattaatcggcaatctatcctggtatcagggggatgggataagctgggattccctgcttttttttaaatggggaaactaaagtcagacaagaagacaaagtatttttagtaatgagattaattctctccctcgttaaagcagtaattccaaaggatgtcagcctgtatgaactcaggccttggcatagttttacatggagtggaagaaatgagggggcccaacatcaacatgcttggagggctttgcaaccttccagattaccccagtgggtgagccccttagtatggcatcaggtacatgggaaagccacctcctgatttcactcctgcctccatgtgatgccctagttttactgggaggatttacttggggtgatgaaatacctaacttccactaaagacccaattcacttttatttgatttttttaaaaagtgaagtgattcacaaacttcaaatcaagagaaaacaaaagctgattttgtttctgttttgctggttgagatgcaaagaggagagatgttgtagtcaccctagtcccatttcttgagctttccatttcagcttctgctgcctcagtttcttcatgtctcccaattccagaccaaggaaactgctgcactcagctcatagtttgtggcagatccattagagtcatatgctaagggcattgtctggaatctgggctaccccttctccagtggggacatggtgagaggagatgaggaggggatggcgcttacaaaatccagctgcagcacatgggctgtgggtggctggctctcccttaggtggagtttgggagagggggagttggcagaaataaagcttcttgtttaattcacatcttaaagatatgtactacttaatgagaaaaagcctctgtatatactaacatgtacataaattcaacgtaataagccttcaaaatagaactgctaggttatctcaaaaataatttaagaaaatgaaatgcagcagtttaaacggggtcaacataaatgggtgaaacgatctttttcgaaatgccatgacatgttatgactctctttgcctaggtgctttattaagaattttttttcctatgactgtttctatttttaaattacttaacaagaagtgacttcatggctgtgggagaaaatgcaaaaataatcacctcgcctggcgacggggggtctctggtcataactcacttcctactcccagcggaagaaaaatagagccaagggagactgggtgatgtgtgcaaaattttaagccctttatcgggtgagaatatttcctgcagaggcctttggccaaagtaatcaaattctagcctggctgctcacagccaggaacacacagatggaagccccaggccagggctccatagaaagagctaatatttgatctcctgctctgagatgtggagggcagagtcctttgccctgcagcagaattctctgctcaacctcattcccctggctgtctcctgagaacagccctcctgcccttgcctctctcaagcctctgggcctgtccttccagtggtcatgtttctgacccccatgcctttgtgactcgcctccaaactgccctcaggtgtcagctggctccatctccctgcagtgtctgcaacactcagatgatcccacgcataccagtgaaatgggttagtatcgctgattccttaatataaaaatgctaatgtggaaaccaaatgagaaagagatcaaatgcttaatgccaaaagggaattcatgaattcttgtctattttctcatttatattcttgagtcgttaccataaattacaaccactctctgccccaatccctcgcccacttggggcatttctccaccataggatcctcattttttgcagctctgtcttcattatcatctcagggaggaagagcaaagggaaatgaagcgcatacaactccctttccccccagttctcatcctgtcctaacttagtgaaaggaaatatgtggcctttgtgctccagtccttccttctgtgccaggggagacaacatcagtaaatcacagaactctccgagcccagacacagcttctcaatacttctcatcgtagtgctgcccatgtcaggggcaactgaacagaaatagctcacaagatgaaacctatttgtcatctcccaccaaaaacaatcctgccagatccagagaatgccagctctccacaggttcttttcagatgttctctttctcatttttttttttttcttagaaagttcaagaagatatagaagaagaacatgcctatcactcaggctgccattttaggaaatcatacttggagcaaaagtgataggtgtacttctaaggcacatgacagtcaggtcattacagacaaacaagggggaaacagccccttatcacatgctttgctaaacttccatccttattcctgcagctctaatcatatcacagtgtccagaaggatgggagtaaaatccaaggaggcaggcagacccaggagtaaagtcagaccatgagaaccagggtcaaaaaggcagagagggaactctggaactgtgtaaggaagtatggatggctcatcattatcagaatcactccaggaaacttcatttgtgaggtgaacaaatattgtcttcaatgcttcctacctccccaacacccactagaacctattctgggtatcctgggtcctcctgactggaccccaggcctttttcaaattcctgcatgtgtttaataagcacctactctacgttaaccactttttgtaaagtgctgtgtgtatagaaaacatatgaggcagaggacctgtaacctggccacagacataagatattcaggacagttgatgattgagggcccaggtaagcggctctgggatgagcccctgggagtccaaggaggcagagccttatggtgactggagactatatagcggccatgaatggcgatatgaagtggttgtattttggctaggcttttaggaggtgaaaagccaagatcttaacatcagttctgccacagaccagcaattaatgttatctctctgggttttctcagctgttacacgagggaaataaactagatcagaaaccagcatgacctgagggccaaatccaacccaatgcctgtttttgtaaataaagttttattggaacatagccatatttgcttctttatctaagtttgctttcacactaccaagacaaaggtgagcagttgtgacaataattgtatgttccacaaggcctaaaatatttactatctggccctttgcagaaaaaaattgccatcctctgcaccatatcaaaaactcccaagatccagtgtctacatgaatctgacaggtaaatatacaccagtacaccagtaaagtagggaagatataagaaaaatcactgaatcctcttggtctagttttcatcttctcagttttgattataaacagagcatacagagggctatttctccactggaagaaaagcacaatgaaaaaaacaatgcaactggccctcagtctctgtgtggggtaggatctgtggcaaaccaggcaggacacccatgccctgcctgagggaagcctccactcagctgcaagaaaatactggcccactgttgcctgcttctgtgtgttttctagagaagctacgagtgtagatttttatgtgacatctctccacttaaaaaaaattaattttcagtttaggaacaagccaagctctctgcataacacccttgtcttgtggtggccactttttgaccttgggatcaacacgttgctgattggctggatctgtgttcgtggcctttctagggaagagcccttcagaagacagggaagaacaggagaacgaaggcctcccaaagggaaagcactgagaaggatggaagtagctgttaggagcaatgagtaggggaggaggacactcgagtgaggcaggagggaaagggaataatcttgggaggggctccctttccggattgaagcaggaggtagtgtctggattactcagaggatgaaatggtgttttgagatcaaattttatggtggagttacctaaagtgttggggaaaaagagtttgccaaaggatgaccaaagtttcccatttccctgggacggagccatttctttggacaccagacattcagcgatcaaactgggacagttctgggacaatggacatttggccagccttgtagagacaagatgagctttcagaaggctaccccagtagtccagatagaaggtgacaagattcctgagctaaggatatcccattctcttctgatggaaaacttcttgtcaaagtgtccataaaaaagaacagtctgctttgctttgttccaggtgcattttagccatagcctctggctgcaaaaccttaccccaatggactggttcagcagcaagaacatggccacgtgggctggcctggggagaagctattgagtaggagccatcgggtgcaggagggaaagcttgctgccactaatactaataaaggctcccatggaggggtacctgctatagcctggtacttcacttaatatttataaggacccacataatgcaaggattgttttcaccccgtgtggcaagtgaggcagctgaaaaggttgagtaatttgtctgttgtcaacaaacgtgggagccagaatgtaaattgagcatcattccaatctccattccccagcacacctcacctctccccactctacagtccttgcctcctctgtccttttgggggctctggccataagcacagaagcctatctcctgggaactcaatgagccgcctcagacaagacacatcaactaccagaaaggagccagtagcctgaagggaattcagaggagagccacatgaataattaagagcctagaaggattgatctgtcagggaagattagaagaatacagtatgtgtagtttggctaagctgagaccgaaggagcaggcgtctgggagtggggaggggctagagcacagagtccttgcagaatgggtgggctgtctgcttgttataacatgaggaagcagagctgggaagaagacatgagaaagagaaagtgcaaagtgaaggctgaagaatgatttcccaaggaacaaatttctccccagaatccagagaggaactcagtctagttcctctagaactagaacttttataccttcgtgtaggagccctacacgaaggtataaaagcccaatagctctgttttccctctttccaagtggaatgtatttccttagcaaaataataaattcaagttccttgccatatctctcgagtccccaggtcttctccaggtctctgacctctgacgttaaactgctttattctgtaacagtcaactctgaattacccaggagagagaaggcttggaggtatgatgggctgatctgagcactgactttgccatgccctgcaccaagcttagaataaaattctcatcctgtattcacttgcccaaggtcacataagtggtttagacagtctgcaatttttaaaaaattccaagccccactcttacttatttgtttcttaaggcaatttagcatcagttctgtcatgaactagcaattgatgttatctctctgggttttctcatctgtaaagtgagggaaataagcacttggccaaaaactgggtctgtagtggcaaccaaggcagggttggtccctactttcatgggatgtataatctgaatgaggaagatgaacattaaagtaatatttaacaggtcattgatgtaaaatggtgaaagtaaataatgcaatgtttatgatgttgtgaaacaagaagacagctccatctaaggagacagaagggcttctcctccaaggaaagtgtaagaaactaaggccagaatgttaggtcggaggggaggtgttatgcactgaagaattaacattacctaaagagagatctcaccttttccctttgctactgggaggtgatttctaggacccctggaatatcatgtttcataagggtatctctgtttgcctgagagttttggccaacaaatggtctagcaatgtgatttacaatgggagctttgggccatgttgtattagttatctaacctccaggagggatggagaataaaggtcagtcaggtgagaagtctcacatcctgctcagtgtgaccaagtcccctgtaaaaactctagatagtaaagatcaagcgagattctctggttgacatattgtcactcataaacaccaggaaagtaacattggtcctgactccatggagagggcaatgggactctcatattttgtactttcccaggtattcactgtatgtgcttcttttcttggctgccattaatctgtatcgttcccctggaataaactctaaccatgggcataatagacattactgagttctgtgattccttctacaaactaatgaacctgaaggtggttttgagaacccctcaaacttgcaattgttgtcagaagtgggatggtctcctgggggactgtccccttaaactctcacaggtgctgatagaggaaacgtctcctagacagaaggcagggtgtgagacagatgcctctattttacttttgacattacacctgttttctcttaatagcaataattgttttctgaatataccccaaactcattctcttttattcaattgactaaatattggccattacaagaaacattctgcatctaatgatttctgttggattttttttcatttgcattatcttctttctataatctcaaactctattcataaaactatattccatatatagttcttctttttctataagaaaacatgttttccaatgtcatggcaggcttcagaaatgctaaattcacaaaggaccagaaaagattcatgggcagtaaaatttgacactgcaattcaagaaggggaaattgagcttgtgatttttttcaaaggtaaatagaaattgcctgaagagtaggctgtataaccctggatggttgggtgcaggttggaggaattcagtgagcaggagagttgagcggtccagggacaccagataggaagggactgagaaagcaaagtcattcccagggagtttttcagacaaatctggggaaagaaaagtctgaaaccatcacctcaaggtccaaatagctatggaataaatcccatcgtaatggaaagggtttgatttttgtatagtgcattggatggtcattcttctgaagtccctttgtggatttctcattttctccaaccctgtccttaaatgccagtttccctccagggttcctttctctatccaaatgcctgaagccaactccaagacatgacaaatcttgaccactagaggctgatctagttggtttggggaaaaaatacaagttgtaactgttaagaaccaaacttaaatatcaagcagagccaagctggactcagcaaaacagatacacagtaaaacatgtcgcctccatataatgtatttattcaggtcttctcactttgtattaaaggaactttgttcaaaaatagcatcatggttaaaagtgtgatctctggagtcagactccagcttccaactttgccacgaaccagctatgcaactttgagcaagttactaaacttctcttcacttcagcttccttcaatacacaatggagataacaggtttttatgaggattaaatcagctaacacacacggacttcttagaataatgcctagcacatagtaatttcactaaagatagagaatggtaggctgaaggcaccattttctatacagtcagaggctggagtcattctagtgtccaaacatacagcacaacagtttaaatcctaattccaaaagttaatactaagatatctcattagatgggcaggaactgtatacttgtgcatcctgactgctgatggtcaggtggtcaccagccaagaacattgtccacagggacagaacttggttaggactaagccctatatcaaggcagaggtccagaaaagggggactctcaaaagcaacattagacagcaggactcttcagaaaaaaatgactttgatcttggaggagcagtgggtagggaaacaagacattgaaaagatggatatctcaggcaggaatcctattcttcaaacaatgtcaatgcaagatgccaaaacttgccctatagcagcagatcctggcctcagctgcatggtagaactccctagagagcttttgaaaaacgccgatgctcacattccatttcaaggcaacccaatcagaacttgagtattggcaatttttagaaagcctcctcgtaccccttaaccccacagttctagggtaaccagggttgagaaccacagctctggagtctacccaactgcttctcaaattttaacgtgcacagaatcaccaggggtccttgctgaaatgcagactctgattcaatgggtcggggtgagacccaagattctgcatttcccacaagctccctggtgatgccactgctgctagtcagtgggctgtgggcgctagggcctggcagcacaggcagtgtttggggagaagcccaaagtgggtgtgtaatagttataatttggctaccaagtccttggattggtgagtgtgtccaatcctaagccctactagaaaagacggatggaaaatccatcacgcctttctcatgccctggggtaggcagaagattacatttatgggcagtcagtgaattcagctgtgcaggactcgggaagcaggagacaggggctgacacaggcagcaattgtagccaggatgaaggagtctaagacttcaaagtaaaaggaggtagaggagttaggggagtctggtatatggcagcagtagctttttccccctcttcattcccccttacttctcacccttggcaatcatcattctgatttctgtctctatggtttattattatcatggtttattattctctataataatacattctagttcctcttataagtagaaccatatgctatttgtccttttgtgtctggcttatttccctaagcataatgttgttaaggttcatccatgttgtagcatatgtaagagttgtctttctttttaaggttgaataatattccattttacatatacagcatacctttttcatccatttatccgctgatagacacttgagttgcttctgccttttggccactatgaataatgctgctgtgaacatgggtatacaaatatctcaacatcctgctttcaattctgctggatatatacccagaagtggaattgctggatcgtatggtaattctatttttaaatttttgaggaactgccatatcgttttccaaacagcagctgcaccatgctacattctcaccaacagtgcgcaagagctccagcttccttagatccttgccaatacctgctattttctgtggattcgtgttatcattgccatcctgatgggtgtgaagtgacatctcattttggctttgatttgcatttccctaatgatgagtgatgttgagagcagccgttttggtggaaatggaaacatctcactcttggctttataggcagcgtctcctgatttcttgcttcatcatacgcttgttcatgttacctgccatgttacctgtcagcatgaatgctagtcttagtcccaatctaggttaaagaatgcttggatcgaggaggtgccatttctctcctgtggcctgggagcacgctgagtctggccaagctcatggtgacttctctgttcattgactctgtggaagggtctgtctatgtcccaccagatctcctcctcaatcatgctaccactttaaaactgtttgcctgagggctctggggccaggcagtgggagaactttctttccccacagagcatattacaaatgccaaatcagaagtgctggagaatgaatggccccagaactcactccaccagtggtgatgggaagatggtggataaatatcccggctgcatctcccttgagctgggataactctgaagtgtgttctaggctgtttcccacagtggtctgaatgtgtggcagatgctcacagtggaaacgggtttgataaagcttcccttttttgtttccctgcattgcttccccacttccctacaagtgttggctgggatcgctgccttaataaacaacctgagcttgaatccttaccttagggtccgcttctgggggaaaccaactcaatacagataatattatgcctctttcagctaccaatacctattaccagcatgtgtccagtcttggtcagtgtgaaaagcagttagtgaaagatttttaggtccacagaaatgctcaggggaacctgtgctttttccttgagctatttaccaggttcattattcacatttccccaaaatacacgtgtgcctaagggagattgctgtgtcccatatcctcacctctagttacaaaatacactaaggtagcatactgcacacatgaaattgctgaacaaaaaaatgaatagattatatatctaagaaatatggtttgtactctctcccattaaatatatttgtatccccagtataacaatgtaacatatattggaatctacaaagttctcatgccaaggaaacatccctgaagagtttaacgctggtaatagaataatatactcgctaatcaaggcaatctttaaggccagatggtgtctctgttggactcttcttggtggttttctataccttcataaacctggttcttgactgttctacagagagtgagactctataaaaattctcttataaacatatatgcacacatatgttcattgcagcactattcacaatagcaaagacatgaaatcaacctaaatgcccgtcaatgacagactggataaagaaaatgtgatacatacacaccagggaatactatgctgccataaaaaagaaagagatcgtatcctttgcgaggacatggatggagctagaagtcattatcctcagcaaatggaggaacagaaaatcaaatactgcatattctcacttataagtgggagctgaattatgagaacacatggacacatagggagaaacaaaacacattgggacctatttggcggatgggcagtgggagaagggagagcatcaggaagaatagctcatggatgctaaggcttaatacctaggtgatgggatgatgtgtgcagcaaagcaccacggcacacatttatataacaaataggcacatcctgcacatgcacccctgaacttttaaaataaagtacaagttagaaatttaaagtggggaaatcttttttaaaaaagaaagaaattctctgttcacacaactgttagatgagaaacataaaagtttttcctgtaggaaattatatacatgttttaaagcagaagagtaaaaattcatattagccaagtccaaaatagaaaagaggaaggaacggtgaaacgcctgttcccaacacagagaggtcatctgaactatcatcgtgggaaagtaaaagtttacccgagagaagcccacagatgctccaaaatggagccagaaatagtaaccagataatgcttataatacagcaaacagctgagcaaactgagatgacacagaatctttttaatgctcgtttcaaggttatagacattataatagcaggtcctgagcaactctgaatttcaatatatgaaaaacacaggccctctctaccaggcctctgctcattttctccatggaaaagagttttgggagtctgttctgatattttatgaagttcattgtttgatcctatgcccctgtaaggggaatgcactagttacaaaaaagaagaaaggtggagataatgactcagtggacattcagtggaggtttctctgtttaaggggtaatggttgaaaattttattttaaatatctccagctcttgaaaaggtaaaatgatttgtccaggattttaaagccatgattttactttatatattcgaaactctgaaactaaagcaattttagtgtgtatggggcgggatggggagagaaggcagaggaactaaggacaggtacaacatttagcaaactcataatcctataaagaaaacatttttagcttccaataagaccacactcctactcctaacataggaaccagggacatgcaaaacatatgaaatgcaactacattgatgacaggcaaatgcttctgctgtttacaaatccattctcatgtattagccattaatattgcttattaattttctttgattcatggtttctgacttctgatacttttctttgagaaaacatttgcattcatttgtcactagaagcaaaatatgcattcgcaaagctactcatttagaacccaagaatgaattcgagaaaagtatacagagaagaaaatcggcactgcaggaaggctcagggccttgcgcaaagccctgttagccaatcagggagaatgtccacaagtgagaactcactcccctcaaaaattagccatcaaaagaaaaagaggatgagcgcatgacagatcttatttgtcctggcttgaggttgtcattagtgacattcacaccacatgtttgaaatctatcttgaagagcaaatgctaagcctctgtttattctctttttaattccacaccatccagagccagaactacaagcccaaactctgtccctttgattggagcatctctctcacctgctacacgtgttcagctaactacggaaggaaacctacaggcaagaaacaaagtggtccttctagcttgacaccttgtgtgataggaatagtccaactccattggggggctttcagaaataaggagaagagattgggataccccacagacagtttttgtccagttacatttatatgctttctcaagcatcccctctcaccgagctccacgaacgataagggaatcagtcttaaaagagccgcgagttacaggcacacctgagagaaagagatgtttgtattcaccttagaactgactctagccctgggtcctagttctttactggggtccttacttcaatttctcactctctaccttctcattcttttcctctctccactggattcattatgagatgagttgttgaaggctggtggcaaaatctgtgcggcaaatatgctaaagtacatagatagagtttctccctgctgaattgacaactacaataaagggaaacactaattttcagggtttggaagctcagtctttcaaacaaaggaggacttgctcaatgaagttgcatttctaatcctttagctagagtcaaatgaagccagttttgaagagcatttcaaactctattgatgaccaaattgcactattgattgataccaactgtaaactcgtggctcctcatccacatccctttaattggtcttgaatgacactcttttaaatgactttgggaagtgaaggggaagaaatgtgccaaagataatttgcacaaagaaaatttacatctcgtctttgtttcattttttctggcatggatactgactaccaatttattattatttttttttcttgagggaagtagtgagaatacgaacagcagtctggatttttcttgttctgtttccataattagaaaaatagactaaaattatgcaggagcagattgagggaaaaatacaacctgctttcctatgatttagtgaactcttttttgaattcaaagatatcccctccttcccctggcccctatacatgtctttttatctctgagtagttactgtacctcttttaagtttattctccagtttaatgacaagagcattcttcaaaaagctttaagccatgaagtgtgttcataatcacatcactatttgtttgaaaacaatgtcctgataccctgctgtcttcccagtaggcccaggcaatacaaaccagtcccccataatcacatggtacttacaaaatcaggttgggcttgaagaaactggtcaaattgttttcacataagttgaaaacgtgacctaccaaatgacccattggttagttatcctacaagatgctgctaatacggggaacgactatgaaaattcattcagcccatgcatttttaaatgtacctggagagttattcaaagattcagtggtatttccacttagacacctgcctttccttccgtctccgtttttgttgaaaaaataaaaagcactttatgtaagcctagattcaaaccacaatcggctcacagataaagatgttaggggacagagaatttctcaacatgcaatcactttcaacaacatcgcctgttaaaaatcgtacatgtagactgggcatggtggctcacgtctgtaatcacagctacgcaggagaccaaggtaagaggatcacttgagctcaggaatttaagactagcttggacaacatagtgagacctcatctctaaaaaaattttttaaattagctgggtgtaatggctcacatctctaatcccagctactcaggtggctgaggcgggacaatcgcttgagccaaggaggtcgaggctgcagtgagctgtcatcatgccactgcactccagcctgggccacagagggagaccttgtcacaaaaacaaaaacaaaacaaaacaaacaacaacaacaacaaaaccgtatagagtcaccaaagactcagagaattagaacttcagaggttaaggctctgaaacatggattttatataaacttccaaggcagttctggttcatttaagttctgagaacccccgaggtagccaccagtcattaaggcttcactgagcagcattcgaaccccagcctccaggcccccctcctgcctccatatctaacagtgggtccagtgttttcacccctcaggctccgtatgcctccctgaagacttgcagtcatttcctaactgatcagcccacgaccatttcctcttcccaacgtagtcttctcatcacgtaactccctgctcaagaatctgtggtgaatcctcgtttccttcctatttcaaaacctattcttcagctttaaatgtaaaggctgaaagaaaatcccttctggcctgagtcccccaccgtcccctgcaccctccccgcattccctccttctgaacccccagcaagactggccgttcttccagcacctgtgatgtccttcgccctcgtgcatctcagtgctggggtgctgctctcccagcttctctaaccctgtgagttgaaccccaatgcatcttcgaggatcctacctctcatcgaggatgtggccctgcctccccagctggctgggatctgcctcggctttgggcctctgcagcattttgctcagcccttcccttgagctctcgccttattgggttttgttgttcatttctttacgcactcaatttggccttcactggccttcaacttgcccgcatcctaactccctgaatgaaggagctctcctggtttgcttttcactcccctcaggcaactaatgatacaggagctagaaagaaattatttaggcagacagtgagggtcaaagagtcctcggcagaatttcccttttaacaaaaagcagccccagagtaatttcttttctaacaaagagcagcctgaaaaattgagctgcaaacatagataagcaagctgaaagcttgcacgggtgaatgctggccgctgtgccaataggaaaaaggctacctggaagccaggtatgttcaacatggaggctccatcctcccttttctttgtcaccacgtgtacagtaaagaaacaggcacagggccggccaggtagcaaaagcatctgcataataaacgattagggtgggggctaccagaaattcgagcgctatgcaaagggcacacctagcccgaaccagttttttgcgccctatgcaaatggcacaccttgtccaaccaatcttatgtgccctatgtaaatcagacactgcctcctaaagctcagctatagaatcccttgcatttcaccatggaccagaaacccattcaggacccctctctctgcaggagagagctcttctcttttctttcactgttaaactttctgctcttaagctcgctccttgtgtgtccccatcttagttttctgtggctttgagacaacaaatcttgggtaatttccccagctgaaggatgccgcttcactagcatggggttcaaacacagcagaccctcaatgagagcttactagattgtttcatagactcttctgtcaccttctttacatgtccccaaggtggtgtttcctggcttgcatccctctgtgtgtctgtggccaccagtgcgccagcaacagagccctttgtggtcccacacttggaatcccacacaagcctccccacctgtctcctgaatttccacctcctcctcccccaccatcgcagtccctaattgaagaagagcttcttgaacatctccctgaatcctggaaaacagctatctcgacctttgtagaactgaccaatttagataaattcacaaagctttggaacataagaagggtcacattttctaagaaagtttcaatgccaattcaaccggctgagtgtgagatcccagaacatgagccatctggttctataggaccatgctgcatgcactacacatcctctctccctgcaaatgccctttccagtatgtccaattcattttatattatttcttatatttttcctaccaagcgtggccttctgctacatggtaccccccaccctcccacccacactcatttctgccatctctcacactctctctcccctctccatctttgctcaccctccagctcatgccttactcagttccaggtggtcatggcagccacgtcttgctctccagggctgttccatcttctccctcctgccccacaaaatcaagccaacccccatctgtctctcagaggttcctgacgactcctatgcaaagtgatttcttccttctttgtatttccaagcatgaataaactatgtagttgagcacttacatattccatttcatctggccttttgttactcaagttttagagagtatcttgatttttcaacccagagcataaggtcattgaagtgagggaccatgtcttaaaatttttcttatatggaactccctggtgttaaacaattaccagggctcagcatgtattcatagatgaaatttcaatcttagatatctgttcagtaaaatgtgcaaggtttctttgtgctttaggtttaaattaatttgatctttgaaaagcgtcataaaccatttcctcagtgaaagtaagaaagagcggggagcattctgagaataggcatgaaatttgggtatgattcttgggatacaaaattaaaaggccatctgcctttgagaggcagcagatgtgtaattgatattcactgctcatttgccacttgaattctgtagacatttaatgctgtaattgtttacacagtaagattcttaacacccttcagagaatagctcacttttcctgtagtctccgtacttctgatcagcctattagaatcagttctcattttcctggagcttcaaaagtagaattaaaaactaattcgcatgatatccctttgaagatgataattttataatatctacaaaaatttaaaatgatatacctttgatccagcatcatctatttaggaatctatcctacattatacacaagccatatgcacaaagatatatgcacataaatgttcattgcaggatagtttataattataaaatattaaaaatagcctaaatgtctatcaatgagggattgattaaataaattatgagtcattcatacaatataatactaggaagcacttacacagcatgaggtagcaaaactccattctataaaaaaaatacaaaaaattagccaggtgtggtggtgggcacctgcagtcccagctaatcaggaggctgaggtggaaggatcacctgagcctgagagatggaggctgcagtgagctgcaagtacgccactgcactctagcttgggcaacagagtgagaccctgtcacaaaaaaagaaaataaataaaaaagaatgagttaacactattggaattgacaagggaagatgttgcatatgtgcagataatttccaaaaggatacacaagaaactaaagtattaagaatctggagtagtaaggaaacctggttttaatgtataaccctttgtattttttttaaacttgtaaacgtatttttatttttaaaaactaagtccaggagtggtggctcacacctgtaatcccaatattttgggaggctgacatggtagaaccacttgagcccaggagttcctgaccagcttgggcaatatagtgagacctcatttctaccaaaaaaaaaaaatttttttttaattaaccaggtgtggtggtacatgtctgtattcccagctactcgggaggctgaggtgggaggatcacttgaccccaggatgttgaggctgcagtgagctatgattgcgcctctgcaatccaccttgggtaacagagcaagaccctgtctcagaaatacataaataaataaaaactaatttaaaaaattaatttgcaaaaaatgatattagcagttaaaaggatttggaaccaatattggaatggttaattatctacgaagagtttcagaaacatctttgtcatattgcctctttgtgtacacaatcataactgaaattataatgcttacgaaagagacaatgttttttgtttttctattttctttttgatcattagattccagctatttggtaactattatctctcagatttggacaggaatctgattggtgtcagctgtgtaaagagagatgcaacagggacagatgtttgtatgaacaattctttcacgtagatcactttcatggaatgatgactatattttcaatattttgaaatccccctaagaaactcatgtaacaaataaaagaaagcatctatctcatctattctattcacagacctatctatatccacacttatctagaagattcttttggttgtctgcacagcagccattactctgtatattcttccctacaggaagagcctaaaaatgcagctactcttttccccagcctccatgataactgccttgtgtatttttcaggattgttagttgcagacaacaaagtccaccctaattaggttaagcagaaagggatttactactggatattagacagtttaagaacatatgggaaaaccagatagccaagcacatttgccagaaagccagaagaaatgcccaaccacagctcaagactgttacagcaaagatgccactattgtcattcagccaccacctctgacactaaagagcagacactggcacttccacaggaactggtccaaaataacctaacacttttgccacctcgcatgcaagaaaatctgatccacaactgttccttcgagctactcactctcacctcacctctccatggctggcaccagtgagctggcatggtggaagtcaggccacgtacaggaccctagctgtaaggaaggcaagaaaatgtatcttttaagatctccagcctctatagtttaggaaggcatcctggtgaggggttatgggaggaggctatgtgagctaacctgccctattttggccagtgaaaaataaggggaagtgttctggggagcttctgggagagattttcctccctgataaaaagaaacacaaggagagctctctttaccactcctcctctttctgcttttggacacaggtgcaagggatacgatgcttagagctgctgcagccatcttggaaccatgaggggaagcactgtcaacatctacacccactcatatttttcatgttgcaatctctctgagcttccttccttgagtttatagcaatattcaccgttttcccatctctaaaatctctccctggtttcgtccgactcttcaggctaccatccaatgtctttcctccccatcgcctacaaatttatcctctctatgcttactcattcacctcctatctcctcctcattcacttgcagcctgggtctgagtatattatactcaagaagcatctcactataaagtcaccatgccatgtgattggcgaatcttatatatagttttttttttaatttttactttcctttatctctctgctgtacctaactcttcatcacttcttttttgtctttcttgaaagtttctactctctttatacgacaaattatattctcttggaattctagttacctttctgactgttcctttctttgccttttttacggactctccttccactccctcccctttcaatgcctcatccatggatcccggctcttctctgtctattctccccaggtggttttcatcctttctaaccatcacccgaatattgatgaccctgaatatgtatgtccagcccataatcttctcaagcttcacatacatacctctaaccacagctacatacctccactagaatgtctcatggatccttgaaatgaatgtgtccaaaaaaaagatatcattagtccttagaaacctatttcttctgtgatctccaccttcttcctcacccaacataaagatctgaggtcatccttgcctcctccctctgcctcatgtatgcgagtaaaagctaatcaactgctgatttcacctaatcatttcttacctgtgttcctacagcaattttctacatatcactggcagagtgatccagtcaaaatgcaaatctgattattttgttctcttgcctaaagttttttctaatgctttccattgtttacaagatatggatcaagctcctcagcagagtattgtgcttcatcttctgatttttcctccatttttgcttcagaacccctaaattccatgacttttcaaaaggtatcatgcaaccatatgatcctctactcttcctgatactttaaattctgccttaaactattcccttattgcatcacctggtctgaaccttcaagttcagatactagctcctctcacatgcccttactcatgtgacagatgtccactgaacacttactatgtgccagacactgagctaggagctaaagaatcaatggtggatgacatatagtccctgttctcaagaaagttatagtccacatactgatctccaattctaccaggtgggttgggtgccctgctctgtgctctagtcatagacactgttgattgcctatgcagcaaccacatccaccttctttttcccttgtatgagaccatgggaatctaccccattcccagctttagaagtagatattgatatatctgatccaagcatagtgattccatgcttcttggctagtgtccagttgaggatcccaggtgttgtggtttgaatatttattccctccaaaactcatgttaacatttaattgtcattgtaacaatattaagaggtagagttttcaagagaggattaggtcataaagattccaccttcatgggtggaattgtgctgttataaaagggtgagttcagccccctcttgctctttcttgcccctctgcctttgctgtgggatgatgtagcaagaagggcctccccagatgcccattcctcgatcttggatttctctgtccagtggaactgtgaaaaaatagatttatgttcattataaatttcccagtctctagtattttgtgatagcagcaaaaaaaaaaaaaaaaaagaagaagaagaagaagaaaccaggcttaagccaatcagtgcttgagtctttttcctggggagggaaagtgacctgagttggtcctctcagaaggaaagaaagaatttatcattcccattttgaggagagatgtttcttctttcccccaagcttgaacaaggaagcatattgaacagttgctgcaggcagcaatctggtgaccacatgaggaatatcaggctgaagacaaagcttacagataagagcagagccaaaagatctagtggtaacaggggatgggtggaaccagagccacagcctaggaacaactccatcctggacttaatatgtgaactaaagaagtgtcctgttttaaagccagtttaagcagcttttaatttagttcttaatgagagtcaatatgcaccatccactggaagttcccatgtgaaactcaagaatccacactctctcccattctcgcttttcctggcattagttcaagtccactttgtcgctcaattgtatgactttaatatctccttgttcagattcctttgcctcagattcacctcttctttcaatttattctccatatcatttccagcatgatatttctacatctgcactctgatcatgtccttccccacttaaaatcattgatgactatttgtagacttcaagataaagttcaaactccttgccatttattctgaagacatttcgtgtctgcccccagccaggatcttgacctctctttctctattcctttttgccttcctcatacccaaatgtcacatagttgctgggacgtgtgactctcccattgcattcatgtatgctgttccctgtacctggaactactgtccactaccacttacctcacccacctataatcctccagaaccttcagctctactttagaagtctctgcacggtgttcctgtgctttatagcattttgactatttctctgccatcacatttatctcactgtgttgcaactgtttgtttattggcctttccaactaaactctaaacttcttgagagcagggactaggtggtatttacacacatatccacatatcctcagcacataccacaatatctctgactgagaccctcttaaaatctttttacaaagagaaggaatggaaagagaagagaagagaataggaagggaacaggaagggagggaagaggaggggagagggaaggagaaaggagaggagaagacaagacaagagacggaaaaaaaaaaaaaaaaggaagaaagccagttctttcttcttgggaaaaaagaaggccaaaggagtccaaaaaatagtcacagattttactctgaacaggccaaataactaactgtcctgtctagatacagagtctgagttttaatgcattttcttgctagaaaattcaaagtatataaaaggatgtacactcaaaggacctccgcttcaaattttccctgccgttggtgcttcatgcccatgggatgtgtattaaagaggctacctcactcagtaattgtagagaatagaaggaaaacaaatagttgttgatacaggtaatgttcatgtttccccattgtagcagcatatggcactagttgtaatggcctaacgtaaagcattcctgaacaatattaatgaccaactaggttaatgaccaaagactcagcctcaggccccaaacatagtctcctgttcattaatccctaggaaatgacctcagccatgttcattatggctcaattacattcacactccctcatgagaaaagaaagcattgcagtcctgataccaagctatatccccccccacctttttttttttaccttgacacatgggcaataaagacacaaaacaagttattagtcccaaggccaagcatgtaaaggaaaaaaacattattgccttttcagctcccaatcatcaataagaactgaatttgggacctcagaggtcacagagcaggctgaccaggatttacacatcctctgagtgttctttgaaggtgtgacatgcactaagcacatgttagccccagatgttcagagtttggatgaaaatcggaaaactcaaaaggcagctctttgctagtatgcaaaaaaaaaaaaaaaaatgactccttcagatatcaacctatcactcattcaatcaatatttatacaatgtttcctctgagtaaagtcccatagacagtttgtgagtaattcagaaaagagcatcaaggaacatagaatcaagttacatagaatgaacataccctgtggtggcttgaaacatgtcctgaaccacatcgacatgtccttcatcaagaggcagtctatatcctctcaccttggatctagccttaatgacttgtttgtaaccaaggaaatgcaacaggagcaagtctgcatgacttctgaggctaggttatgagcgatcatatggctctgcctggctagctcagatactcagttttggagcctgggtcactctgcaaatccacctaccttgaagcagccatattttgaggtggcccacatcatgtggggagactctaacgttatggttcacagaaccagctgtggtctagctaacaatagcatctacccatacatatgagtgaagacttatctccagaagattccaagaccagttgttgaatcaccccagccatcagctcttcccagctgaagctccagtgtggaacagagacaagccattcccactgtactctgttggaactcctgacccataacatttatgagtgtaacaaaatactgaattttgtacaaaaattacaaagtgtgggatagtttgttttacagcagtagtaactgaatatctctctctcctctctctctctctctctcacacacacacacacacacatgataaatacatacagccaccttgtgaggtttagtaatagtttgcatgcatatgttcctagttcggccatgcctacagaaatctttgaggaagtgccgtcatctaatggaactgcatttaacctgcatctattaatagcaaaaatcaccaagacttcttcaatggggccatgcggcacattcaatgtgaagaaaattaattccaaagtcgagggaacattgattgggtacaaacactgtcttgcatcacaaggtgattacactccattagaatgcacctctctcaggcttggcctcctgttatttcctctctataatctcttcaggatttctgagcttcagtgccactgccagatctgcctcccataccaaatctaatccaggacctaacccagcctttacctccaactgcccaccctccacctctactggcaaatctcattatttcctcagcaccttcacctctgtagtcctcagtcaatagaaagctattcttattcaaatggtatttcccactccagagtggcttgtatgtgtcatggtccctgcacctccaggagtcacagagttgtcccagctggctcctccctgtgcgtgtcccctgtcatccatctcccatccaatcctgatggctctcccttcagaatgtttcagaattcattccccttcctcttttcttactgtcagctccgtgccacctctttacctcccgcccaaattcatgcaattgcctctaaactggccctctccctccaatgtccccagcacaccctgccttccaccactagattaaacaccccacttcccatgcctgcccattaagtcagtccaatccaagaacctggagaggcttcagtgcctgcagctccaatccagatgcccccaagagcatttgcaatgtcttgccttattctttagctagcagtccatctcttccatgacacagaccctttagcaaaatatcaatccctcctttcatactcccacatttgccctccccaaccccacccttggcggtttaacatttcctcctgaatttcctgatgattttgttccctccactgggaagctactccttccctctcttccccagccaacatgatatacacttttcaaaatagcttaacgccattttctacaaaccatgtggactagcgttctagatctcacacacctgtccctgcccctgcctctgatttcttcaaatgccttgttagtaaataccataccttccatgtagggccctttctcaacatgcagtgtgacctaagcattttcagtacttcttatttctctaatgagatataagttcccaggcaagggccatgcactatactcaccaaaattcctcccaaagcctggtgtgtgctaagctgccaggaagcagccaatcaataccttcattaccaaatatatcgagaagagtgcatgaagctggagtctgctgaactccttcccaccccggggccatggcccaggttggaatgccccatccatgacttttcacccttgcctgcttcttgcagctcacccttcagttcaaatgcaacctcttctaagaaggcgtcctcagtcactcctctaaagctgtcttccaagcactgtctccaaataaccatttttaattctctatagggcactcatagttcttctatttattttcaatgtgttatttttatttttatttttgtcttttcccaggagagtgtaagcttgatgacaacagaaagactttctgtctggttcaccactgtatccctcctattaaaacagtgtccagaagagagtatgtgatgggttaaatgaatggatgaatgaatgaaacaaatgaataaagtatagagaaatactctatacttatgaggcactcacaatctattaagaaaaacagatacaaaagtcaaatatcatctagtgataagtaaaattttacatatatatgaattatatatatgaatgaatatatatataattcatatatgtatatatgaaataaaggagaaagagaggaaggtagaatagcactccaaagaatagaaagtgtacattcagaagtgcacaggcttaatcctgcatatcatttgtcagggaaggaaatgtccaacactgtgagagtatgaattttgaggggtggaggaagggaccctgggacatgaggctgggcaggtaggcagagaccagatctgtaagtgagtaatgtggtatattaaaaagctagagccttatcctgtgtaaaatcaggtacaactggagaattttaggcagagaaattagacctttatttcataactaacactctagaaaaagtacagaagacaggcaacagtgataagagactagaaacaggaagaccaggtaagaggccctgcaggtagcccaggtgatatggtttgcatctgtgtccctgcccaaatctcaagtctgaattggaatccccagttttggggaaggggcctggtgggaggtgattgtatcatgggggcggacttctcccttgctgttcttgtgacagtgagtgagttctcatgagagctggttgtttcaaagtgtgtagcacttccccctttgctccctcttcctcctgctcccaccatgcaagatgtgcctccttcctcttcgtcttccaccatgattgtaagtttcctgaggcttctccagccaggcttcctatacagcctgcgaaactgtgagtcaattaaacctcttttctttataaattacccattctcaggtacttctttatagcaatgcaagaatgaactactacactaggtatgagagagtagaggcctggactaaggcaggggacgtgagtacataggaggggccagattcaagagaaactgaggcagcagaagcagcatggcccatgactagctgaaccaggtagatgacagaaagcaaggactccaaggctaatcccaggataacaagcacaaaggcaccaccaccaactaaggttggggagaagaccataaattctacatttgagctgggctgaggtgttctgagtttcacatacctgtggaacaagcaggagaataaatctgataaagcatttggacttgcagttactaggagcttggggcaaggcctgagtgaaagacatgatttgggagccattagcgtacagatgacagggaaaaccatgggtgtgcatgatgtacttggaaagatgaattggatctaccattcaggaaattgcttcttcaggtccagactgtgaggctaagatttcaatatccaggattataaaaagcactcatcacaatgcaacagaagttgcaggccagtgtttccttgacattggaattcactctccccacttgatacgaaccacatggtcttggtagagcatgtttccgggacctttgattactaccaggctaaataccgtatgttccattaagcttcatattctggcatagaagccaatgagaaactgctacttgcaccagtaatgtatgttctccaaaccactattatactttgcaaagctgctgtacaattaatttttagcagagatgcactcatagctgccccatcatgtgtaaaatgcacgcattttgcctttgccagagagaacatattgcagcccatattttagtcatctcccttcaaagggtaagaaaattttgtgagttattcaagataggaatgcaaatttaaatttgctcataactagaatggctcacatggccacaggaacatctgtttttctaaaagcgttagctgattgtccagaggtggtcactcattgtccagagactgggatggagaaagacagaactgggcaacttgtttcttagatggattttgtctcatgtaagagttgcatgagatgaattcaggtagacaatcatttcatatctttttaagacaaaggaagggactactagtatatactgtgctatttgctttgggccaaaaatagcactacgaactttacatgcatatctggttgaattatcccaaatcttacatggtagctattattatcttattttacagacggtgagatttgttcaaactagcataaaatatttaggcaattgtgcttctccatttatatttattttgaggaaaattgaagccatgatttgggattcactgatgctttacctccctgactagttttgcagattacctatcatggtatacaagatgcacagacaactgtaatgggtatctatcctttttgcccttcctagcatccccttctgataaaatagcatcctccctcctgataatacagctcttccttttttggaacctgcttttcccaccccatgtaattcagacagagttatcagccagttgattacttccttccttcctttcagtaggtctagacacattagccagcctgattagtcagaaatctccatctctgtacccagtaattggcccgcgaagagcctgttattcaagagatccaaagacagcttgtaagagatgaccatgaaagagagtcctgctcatttacctacattcactaactctaagaacaagtaaccctagagctgctgggagaagaatctgccagaaaatgaagtccacacaaagaaaagcagagccaagacatggcagagccagagaaacagggttcagatgccaccatgcaaagtccttgatccagcttctcctggagctcttttattcctgagactccctggtcacatcagtcagtaagtttccctttctgccaatgctagcagtttgagttagtctctgtcgattagactaacagaaacaggtccagcagaaaatgaaataaaaatatatttagcaaaaaatcatctgagttagttttacagttatggatttcaaatttcaccatttgaaacagataaatttgtacactaaatagtaactaaaaatattaatagcaagatctcaaagatacccattgggaaattttaccttgggtgcaataatttaagcttaagaagggtttttgccactgacttggaggtaacaatgacatgaccatttctcagggactttttgacaattatcttacttatgaataaaccagaaagatagatgatactaaatattagtttcgcccttagacccaaatatctaggacctctcccctgggccccatgcctggatggccccattctgtatacagtggtttaggtggcttcactgtattactatgtaattattattctccaaatttccataaaagttgtcaatatcactttttttcaaacatatgcatgaaccatcatgaaaacttgagtactatcttaatgctatttatttatttatttatttagagatggagtcccgctctgtcacccaagctggagtgcagtggcgtgcgccgatctcggctcacggcaacctctgcctccttggttcaagtgattctcctgcctcagcctcccaagcaggtgggactacaggtgcaccccaccacgccttgctaatttttgtatttttagtagagatggggtttcaccatgttggccaagctagtctcaaacacctgacctcaggtgatctgcctgcctcagcttcccaaagtgctgggattacaggcatgagccaccgcacctggcctgtatctaaattttatcgcaaattatctgagtcatcttgggcaagccctttgacttctctggaccccaacttcaccatataataggaagatgtcctgcctaacctgcctggagtgttgaggacatccggtgggacaacatctgcaaacgcactttgaaaaacatagagattattaatgtaagagcaagagtccttaagacaaaactcaattttattctatgctttttgacagttgggatctgcggaaaagccataggcttattacaaattctgaatctcttttcaggatctaatctgaatctatcagattagacctctcacaggtcaaatgtagagaaggattagattatagtaatagaactaggaccttgatcacatctccaactggcctttctgatcttgcaaccctttgtcacctacaggaaatctgcccaaaccagtctactccccgtctcccaaacaagatccagactttgttgtattcaaccactcccctcacctcaaatctgctctcttaactcatccatcactcaacatcttgcttgaacttcaagaacaagttcatccactctgacaaccagcgccccctagggctcacttggtgatgagttaggcactgttttgttatagttcttatgtgattctctgaagacgtcctgtaaatttctcattgttacagttcctgcgtatctccaacctgtcttgacaattagactgtaagtatgctaaagccagtcactgccttgtactcttcttgcacaaagtagatactcagcaaatatttgttggttagttaaaaaggaaattgtccaaaggaggaaaatggcttagaaaagaatttataaagaaatgaaatgagggagataaactcatagaacagcaggttacccattgaaatctattaaacatagacaagggagctggtctattcaaaagaagcccagaaatctgaaatcaaatatttagaatggaaagaaacttcaggataatccaattgacattcttcattcattgtggttaatcacccactaacttctctgacttgtgaattgagtttttatacatttaattttttatgttataaaatatgactctcagtaatttcctagaaacagagtctgagagaatagaaccttgaaaaaatggcagctatttcatcgatataaaaaaatattttttcttgctagagtcaagccagacatcttgagccagacttgtggtatcccttttttattttacacttcaatatggaaaagaacagatgattaacagaaagacaggattcctcacctggaaacacagaaaatgctgactggttcagaggggagctaacttcaggagcgaatccaaagtgttagaaggtcctagaagtcaaattgttgagctttgatatgctgtcagagaaagcactggcttgggactcagaggaccgagattttgagaacttgcttcatcagtttcacttatgtgaccattgacagtttcccaaattctaattatcagattttttttggtcttaaaaatagggtcatggatggaattaaatgagataatgtatttaaagacacttcatttatagaaaagcttaatttgcattatttattatccagttaatttccattaaaaactattttaatctagctgtcctgaaggtgagcctttataatctaagaaccgaaatggcatcataacacccttgaagccccttggttattcatccttatcctggctctaaagataaactaatcctcggctctagcatgttccagcccttgcagctttccctgaactcacacgccctcaacaaatgacacgtagccaagagcttcccgctctacaattagtcacatcaatctgaagcctcctcacgggttggtgaacacagcagtatcttctttcgctgcctgagattcttgcaaagatgggagaggcagcttttcaacagcctaaaaggccatctccaccaccagaatgtgtcttctctccaagtccccccttccgtggtcatatgagtggctctgtcctgtgtggagaggcatcactgccctctgtgagctgtccgttgaaagaatcagtgaggtcctcccacctcaagatggtccaggcatgcttaccacctgggacccctcccagctgaccgcaacccagccctagcttgaaaaggcctctgagacactgttcaaaagtcattggcttttgtccaatggaccaacttaggttcctgtggggtagactcctgatggcagagtatgaatgaacactaatgatcatccgtgtcagctaataatatgaaacatatctgccctagcataaaagccagagtgggaacacactccaccattttcatagcaatactgctcatgtgcaaggttggaaatagagacataacgctaaataaagccctcgaattggctatcctggaacttcatctgtacactgtttcttagagatcttaaattgtgtttaacagaatggaagggaacctagacatcagagagcactctcagttagcaaatggcatcaccaaggcagagaaaggaagggacattcccaggatcactcaatgagtggcaaggctagaatggagcacagggctgtccaaccctccagactctgtggccgcttctgtaaccaattaaacatgctctgccctgaagcatttagcatctaagctgaatgtaacctctgggtgtctccttatccaaaagcaaggggtgtggccagatcatctccccacctaccccttagccccgatgactccatagcacaaaatcagaactgcaatccaccaacctggtatcagcctcccacagactgtgtgtttatgagctctggctcttgctgttatgccaggctactttcctcagtgagcagacacgcgataaatactgacaactgattggctgatgaatgagctcataaataataatgtttacagcttccttcctgaactcacagccaaagcaactccgctaaatggcctcttttcctcctttctttcctcctcggcttgcttataaattttaagatgcatcatgcaagatgtcagggaagcaattactttggggtttacccttaaaaaggaaaaaaaatagcaccaaagtccataggggaaaatttccctgaactaaacatgaaccagaaaatgtatacagactttgattacacatggtactccagggttctttaatcaaacggtccatcagggtgtcaagagctctttcccctggtttccaagagaggagaacacgatccttttttccgggcaggaggagagtgccagggacagatctaagggcagaggccactgacaaatggaaggtgaagtctgagatgtagacactaccaggacagcagccataatatgtggaagacccaggaccagaagagcctgtgtgtgtgtgtgggtggggggggggggtgtataacagcagaaatggatgctattcatttaatttggataccaaggattcatgcttaggggcttggaataaagcagatacacatctttcttctaagtatagaagaaaggtccaagtaggaggctgagacaagcgggtctaactctccctaaagatatttttcaagaaaacttttctcctctatattaacacgatgcaggatttatttctgttagtgtactagataatataatatacatatgcatgtgtgtgtgtgtgtgtgtgtgtgtgtgtgtgtgcatatgtgtgcctgtatttcagagcatataacccaggctcccaggttcccagaagtctcctagaccccatagataatgcattttagtgccagccatcatcacgaatactcagtgatggaatgaaaattcctatccagtttatttgaccacaggtagacgatggaggataaagtatcatcagacgatagaattagtaagggaaagaagtcaggtaatgggtaatttctctggaaactgacaatttcatttcttctagtcctactcccccagtgaaatgagaagtcagcagaggcccatgagatagatttcaggcaattcaactaaatctgtggacccagtggaattttgagcaacgaagaaccaagatatctgttccttttaacatgacctggcttgccacccagggggcaggcttcccactgacggctcttccaagtcacctccataaactcatcaggccttgcaaagttgcatttcccctcctcattccgaagacacaaatcaatatacacagaagcacttatgcttggttcataaaatctcctgtgtaaatgctggaaacatttccatgccaagcctgatgcaggctacttccgacaacagccagtattaccgtggtgtgtgggaaccctgggaaaggagagagatgcaaaaccatggcaaaagccactgctgaacctagtgtcaagccaaaagccaattgggttggaacaagacagtgcccatgtccttgtgtgctttaatatggtaagagctagggctttcttaatatggtgaaaattccagaggggcataaggtgagtcagctgctcacacacagataaatgcctggacaagtcctgccaaggttggccatcaatggtagataggaaacaagctgctcccaactcagtagcccaagcatcactgaagccacagtgaacctcctccaccacctctacaggaaagtatgagcagatatatgggcgcctagaaagaagaccccattctgtcaccccatgggcaacagattccacagttgccctgagaagatatccaaaaacaaacacaatcagctcaatttagatgcaaaagacaagggggaaaggatgctgggagctggaggaggcatcctagcaatctatttcgaggggctcttagcacctgtttgcaagcacagctctcaaaatagcattcagcaacaagtttctgaaatggcaaatctacagcttcttttccctgcaagtgctttgtcatgctgatactctgacccaagaaagcatttccaaagagcctgcgggataaagcggagcaatgttgaacatgtctgcagccactgcagcggcagcagcagcccacggtgcaggggaggctggagtggacgctgcccgggccccacctcctgtctgaacactcaccatcagcaggccgagagctgagtcgggcaccagctgcactgccatggtctccgattcccatgcacgaatcctgctgccgagtcagtcctcctgggccccgggtggctacagagcatccaaaagcacctgcagaaaaagcagccaaaatccagacttagggagcaaaaggctcaaggggaagataggccacctttcacacagggtggggaggaggtcagggaagacagggtgggaactgtgcttagggaggaaaaaaaaaaaaagaagaaggaaaataggaagctgcaggttatttaaaagtgagccctccctagcttcgcaaagcggcacagacagggagaccgcatcaaacacaaacgtgaaagcttagaacacggaatgtttaactgctaccttcgccctggcagcaattcttcctttaactgacaattaaaataaaacattccctattgcagataaatcaagcagcccgagccaccccctctctctgcatctctcagcaattctgctgcataaacatgctgaatgtcacaacataccgctcgcaatctggtcagtgtcttctttgctgcagataggtgtgtccctttttgcaaaatcagatatctgggagtgagacagccgagtctgaccatgaggcaccaggcagtcactggagatcagcaaatgcccttaccatccccgaggaggaagtcacttaggaactgacccttccaccttccccagatctacttttcctctccaagtagactggccagctcagctcccggtagggctaacatacttaagaggaacatggaattgcactgcctgttctgtgagcgttctgatctccctggctgtaccacatgtacgccgcatacagacacactctacctctctctccctcccttcctcccgcccttcctccctcccatcccttccctcccatctctccacagggctgcctgttaggaattttgaaggagcctccctagttcagggaggcataggaggtgaatttgtcacaagggacactgcttaacaggaaaaggcaagttagccttgaaaatcatatcatgcagcattttccccggaagatgtcaatgaagggagaaagaaaaaacctgccgaatcttgttatataatgggtagctcaaagggctttccagagtcaaagacttaagaaaattagatatcttttcatgagcactgtcaagcttgtatcttcttctggagtccatgtattcaactaaaaatggttattcctgatacttctagtatgtccttttctgatttcttcctttactcacctcctgtaatggctccaaaaaatcctgaaaattaactagacagtgtgaaatgtagaaacatagagaacagttttcgaaataagaaactagggggaagaaattaatgacctttcatgttcctgtgcacgagcatagctactgttcctttattacttatacttttaaaactattgatttgggccaggtatgggagctcacacctgcattcccagcacttctgggggttgaggcaggaagatagcttgagacccaaaattcagggtgagcctaggcaacatagcaagacttcatctctacaaaaaaaaaaaaaaaaaagaaaaatagaaataaaagaattagccaagcatggtagtgtgtgcctagagtctcagctacttgggaggctgaggtgggaggatcagttcagtccaggagtttaaggctgaagggagctatgactgcactcctgcaatccagcctgggggacagagcaagactctgtctctaaaaaaatttaaaaataaaaagtatttgctcatcacagtgcttagcacagagtaagtactaaaatatattcaataaatgagtgaaggctgggtgcaatggctcacgcctgtagccccagtactttgggaggctgacgtgggcagatcacctatggtcaagagttcaagaccagcctggtcaagagttcaagaccagcctggtcaacatggcaaaaccctgttctatgaaaaacacaaaaattagccgggtgcggtgggcacccgtgttcctagatacttgggatactgagacaggagaatcgtttgaacctgggaggtagaggttgcactgtggtgagatcgcaccactgcactccagcctgggcaacagagcaaggctctgtctcaaaataaaaaaaaaaagaaaagaaaagaataaaacaaaataaaataagtgagtgaaaaattttctcccattttgtttttcctatagtggcccaatgagcttgaaccttgattccacagtgtgtggatggagtctcatgttactgatccccggaacaccagagcaaccctccttgccagcaggtgcctggagattcaaagcatgacttgagtcgcatgcatgtggccttgcacagaactgtcaggacattctgactgtgctggtggattgcaatactattcaaaataatatgtatagtcacatttgaaaaataataacaatgatttaaggaacaggtctataatagtgatttaagggaccttatcctaacttttcagatggatttctaaatgtattcaactgatatttgcagaatgccgactttgtacctctgccctcaaggaactttttatctggtagaatcattaatgatacaagataatatgtaagaaatgcaaaaaaaaaaatcccaaatagtttggatagcacagagtagggagggcttaccatttcttttttttgtagcttttgcactggaacttcaggaacagcagaacatctttttcaggacatttgctttctgattctacatggactatgtgtttggaaaataaccaaagctaagaaaaaacgttaatattggagctattgcaactggtggatatgggcagagaaaagacaaaccctgaggagagacaggcaggagcagcctcaggtatgggacagtctgggacatccttaggttgcagaggccggcctgagagattttgtgtcagcccttgacgttggcccccagaacacccgccttcctctctcagcacttcactcatggctcctttgcctggaaagcctcatcccctgtctgcttgaattgcagcccagattttctggaaaatagcctgcagcaaatcttctgcaagaagacatcattgggaggtgcaatttcagggtggcaagagtgggggtgtggggaaggtgaggcagggatggaatgagagcaggtacaaggtggggttgaccaaagtgggcataggacagctactcagtcctgaggaagagcttccagacaggtatggaacttccagtttttggcataacccatcaaggagacgaagggagagggagctaacagcctagtgctgtccattagttgactctttttggtcaaattgattccatcagacattaaccctcttgcgcttcagggttatgttaccaactcccgcaggtaggcatgaaaggcattgcatctgagcccagaagataaggaagaaaccatagcctctgtgagtcagtcagacaggacctgggccctggggtggtgaggctcctgcctcagtgtgtgggatggaaaccctccctgttctgtcctgggaggctaggacagctagcagtgccaggaattgaaatgacaatggcagcacctgggattcccaatgagcaagtggctcaatttgcccagggaagacaggaggagccaagtaaatctgggaaacacatacactgagtctggtaacagcatatacgttcacacaacattcagtgtcaaaagttgcatacttcatgaaattcttcccaattcctctatttgggcattcatagttgctttgtttgtacaacttttaaattccttctttaaaaaaattggcagtgatttgcttttctctagtatccccctactagagaggaacaaactaatttcggaactgagcattgctcttctctgtttacttctacagctccaagcatcgagctcaaacagcagcccatgctcaataagattaaatcaggcaccaatggagatatcaaaatgtaaagcgcaaagaggaagaggcaatggcaagacctcagggagtggataggacatggggagtttgtgaggacaggtcacaggctgatggagaaggagttgtcaaaggaggaaaaggagaagagagctcccaaattcgagtggcaatggtcattccacaaagatgcctgggtggggtggaagggtgtttcagtacagtttcggacacagaaatcgaactgcaaggggttatcgagcagcttgtgaggaagagaagttaattcatattaaataggccctcatcaaaaagcagtggaatatgagctatccaggtcctttcaagaactagttcaaggtcacagaaggaagaaggtgtggggacagcaatcccatcctctgagtcactaaactcgattcttggttaatcttacctcccaagaaagctatatatatatgaaatccatttcaatgtatcctcctttaaaaactcctcaaatgaagcatagttcaatgtcacacccatcgcaaaaaacagctcttcataaacctcttctgggccaggtgcagtggctcatgcctgtgatcccagcactttgggcggctgaggtgggtggatcacctgaggtcaggagtttgaaaccagcctagccaacatggcgaaaccccttccctaccaaaaatacaaaaattagctgggcatggtagcacgtgcctggagtcccacctacttgggaagctgaggcaggagaatcctttggaggaaggtgggaggtggaggttgcagtgagccaagtttgcaccaatgcactccagcctgggacacagagtgagactgtatctcaaaacaaacaaacaaatactcttctgtatttagcgtgaagctgttgttcagacattggccatgagaccacccactgccatctatataagttgccccaggtgagaaattcctctcagaatctagtacaaaggaaaatgtcattatcctgaaagagcctgtggtgtgggtggctttggccccagaacacctgccaggccattttactctcaggaatctgaaggcttattctgtcattttctctaggatcccgagcaagaattacaagggtgaggtgagactcaaagaaagtattatttattagagattttcttaagttgcacatagtagacattcaataactgtgagttctcttttggtccccttttaattctgataatgagaatagtgtacctaatcacacttggcacactggacttccagaatgcccaaaatctaattttactttcaatgacagcagatactatcataactggcattattacttccttcttttctttcaatcttatttttccttctaatgcatactctattactcttattgagtaggcctttttgtcagtaagccatctgaaattcatttttagtaagagatgggacataaatcactcattaatgtatacactgtgctcaagtagatttggcacactgtgaaatattttgcagctattaaaatggcaattatgaaactatttagaagtattgcaaatgtctgagatatgtttatttgcaagtaatatgagacatattctctaattgcaaccatgtaaatatttgtattttaagaatatgtgaagaactcctgcttctatccaagatggaattagagggagcaagtctacacttcacatgaaacaaacaaaaaatgtaaaatatacggaacaatacttttcaagttaatggacataagacaacaaatgccagtgatccatgaaagataagaaacaaattagagaagccttacaattgtcccaggttattgaatcaagagtatttccaggctacggaaccgagagtggagctacgtggaatcaagtgttctccagagtcatggagacagagctgagagtcaggaaagattgggatgaacacagttcacaagacagagcaccaaagagaagacaggtgtaaagagaaagagaacttctgagatcttcaaagagtccccatgagcactcagttgagtgctgatcaccacatacatgtggggaagccactcaaggctggggaaagaaccacataaaaagattggaaagaatggtgaccagtgctcacccagggccagaacagtgtctgctcacatccgccagactggagaacttcataattcctaatacattattagaacactcagatggctcttgcctcaacagtgagaaataattggtcatagattgatcactgtcctgaatctgcctaaccattctgaaaagtaagacccaaaaggattaaactatttccacgtaacttaactggattccaaacaaacttaaagaacatttataaaattacaaaaatatccaactctcaatgaggttaaatctataatgtaaatttacattgtgtataatttacatgtagatttataaactagaatgtcatctgataaaaattaccatgtacgaagaaagtaggaagatatggtcactaaatagaaaacaaatcaatcaaaatcatccagaatgaacatagatgttagagtcagcagaaaatattaaaacaattattattgtttaaataacattaattattaaaacaattttgaatatattgtattcaatatattcaaaaagttaattagaaacatggaaaatatttaaaaattcgaagaacaaaataagcatcagtcagctataggacatcttcaagtagcctgatagatatatcatttgtatccttgaaaaaagagacacacagaaaattgagttgaagaaataatagccaacatgttcacagattatatgctgaacaaattctaagcattagaaacatgaagaaaactacaccaaggcacttcataatcaaattgctcaatatcagtgataaagagaatattttggaagcaaccagagaggaaaaacatatatcacgtacacagggacaaagataagggtaacagtagatttcttttttggaaacaatgcaaagaagaatccagtagagcagcgttcttctaaaaatttaaagaaaaattatcagtataaatttctatacctacaaaactatctttcaaaaatgaaagccaaataaagattattttagacccacaaagtaaataaaaggcaaaccaatttgaaaagaagtaaaaattctcacaaagaaaaccccaggcccggatagatttactggtggatcctagcaaagatttaaggaagattataccaaatttacatacattctttgggaacactgaagaggagtcaatacttacgaactcatttttgtgacaccaatactaccctgttatcaaaatcaaagacaataaaagaaaagaaagcaacagatccttgtccctcataagcaagaatgcaaaaattttaaacaaaatgacaccacatagaatccaacagtatattaaaaagataatgcactgtggccaaccagtccatattccaggattgcaaggttagtttattattctaaaagcagtcagtgtaatttactatattaactaactaaaaaagaaaaaccatgtgattagctgaatggatgaataaaaagcatttgataaaatgcaacatctattcctgatcttttttaaaaaaattcagcaaacatggagtagaagggaacttccttaatctgataagcatgtacaaaaatgtatagctgtctgcataattaatgcaaaagattgaatgtttttcccctaaaatcagaaacaaggcaagggtgaccattctcagcacctttcctcaacattacactggaaattctagacattgcagtaagccaagaaatgaagataaaagctatccagattgaaaaagaaagtaaaactgtctatagtcatagccaatatgatctttcatataaaaaacccgatggaatctattaaatgctaataagcaagtttggcaaagttgaaggatgcaaggtcaattcaaaaatctattgtgtttttatatagcaacaacaaataaaaggaaatgtaaatttaaaacacacttcacagaaacttgtacacgaacatttgtgtcagctttatttgtcatagtgaaaacttggaaacaacccaaacatccatcaatgagtaaatatataaacaaattgtatatatgtataatgaaatcttattcagcaatgaaagggaatgaagtactagtatgctacaatacagatgaactcaaaaaatattacgtaaatgaaaaaactagatgcaaaagaccacacttcgcttatgaaatttacatgaaatatatatttaaaaaacccacacccatggagataggtgattgttacctgaatccacaaggggaagcagggagtggctgcaactggccacaaaaggtctttaaaagtgttctaaaatcgcactgtggtgacggttgcagagctctggaaatttactggaactgaacggtatgcatttgcaataggtgaattttatgatgtgtaaatcatacctttaaaaagctggagtttttaataaaaatgaatgagttattaatacagtcaacaatgtggatgaatctcaaaataattatactgagtgaaagaagtcagacaaaaaaagaattcataatctatggttccacttatgtaaaattctagataactcacactaatacatagtgacaaaaagcagatcagatgcctggggagcaggaacagcataagagaaacagggtaggagggggcagaggggagaaattacaaaggggaaactttgaggcagtggatatattcactatcttcattatggtgatggtttcacggctatatacatgtgtcaaaacccatttaaatacgtgcagatgactgtatgcctactctacctcagtatagtggctctttaagggacatgaacggtaggataactgcaaaaaaaatacaattagttgttacaacgctgcgagtaagagtgattttcttccttccttcctttctttctttctttctttcttttttttttttttttttttttttttgatggagtctcgccgtatcgcccaggctggagtgcagtggcgcaatcttggcttactgcaacctccacctcccgggttcaagcgattctcctgcctcagcctcctgagtagctgggatcacaggcatgtgacaccatgcccggctaatttttatatttttaatagagacggggttttgccatgttggccaggctggtcacaaactccatacctcaggtgatctgcccacctcagcctcccaaagtgctgggattacaggagtgagccactgcgcccgaccaagaaagatattctcatttcaaattgtttaacttgtcgttacattttcactaattaaaataacaatgtttttagaaatagcttatttttcaaataagaaggaaggcttggaaaaccagcagagtcaagggaagatgctgttgtcgttggtactgctgctaagggcagaagagccctgggtgtgttttaagacacaccaccagaagcccgtaagatgaaaagaaaaggcttctgtaaggagaattctgaaggagaacagaacccccagcggaggaattattttccctagggaagcgttttgtctcttcccatgagatgaaaagaaaaaaaaaaaggtaaaaatgcaagaactgttgataaatgtgaaagggtgtaaagagagatttttttttgagaccgagtctctcactgtcgcccaggctgcagtgtagtggcacgatcttggttcactgcatcctccgccttccggttcactgcatcctccgcctcccggttcaagcgattttcctgcctcagcctctccagtagctgggattacaggcgcctgccaccacgcccagctaattgtttgtatttttagtagagatggggtttcactatgttggtcaggctggtctcgaactcctgacctcgtgatgcgctcgcctcggcctcccaaagtgctgggattacaggcgtgagccaccacgcctggccccttgtaaatagagattttaatctggtaagaacttgcaggtcccttcattcaaagtcttgatctcatcagaggctctgtatgtttctgttcccatcttcttctgccttgaccatgataatggtagaccctggtagctgctggtcccaggttgatggcttgtgccctccagcatcctctcccatgccaggcccttcacgcggagttgctgcctaacatgactgcagaagattccagagtggatgcagaaaaagcccccaagatgcaagacggaatctgctctacacacccagagctctgggatctgagatgaaactgaccaggaaagatctgaccacccagtacaaagcctggctgggccaagtttctctgggcactctccctattgctgtctcagagccctcaggccaggactggacctatccccctgcagcccagccccaggctgaaacacctgcccctctgaagtagagctgcccatggtagccccactctggtctctgcggggactcctaggagggtcagggatgcctgtggccagcagactcagctgtctcagctcagagtcaatgtaaaccagagtgaggaacccactggtatcctgcattgtcccaaggggacctggtatttgcagccttcaccggccacatccttgctggggcagctggactcacatagctgcttctgcccatgtcctctgccaagcactccagtctcacccgactccaaccctggccccaaaccctaggtcatgtggctgtgatccaaaagccctagcgagctcttgactcttctggcaggctgcatcctcttctgtcctcattttctccagccccttgtccagctactgaccactgtcctgctggccaatgacc
